United States Patent 7,868,149 (PLANT GENOME SEQUENCE AND USES THEREOF) - sequence listing, part 21

SEQ ID NO: 10228 - DNA, 5611 bp, Oryza sativa
  unsure (1)..(5611): unsure at all n locations
agagagtttgaataatanaatctcattcttgcatgcctgcagtctactcttatgatccccagacttagtgacttaccgattgtatttggagacgataccagccggcgttggggccactaggcacgggcgcaccttcaggcgttgggcggtgggcggccagccagttagggcaggcgtcaggctttggatggacaggtagggtgcacaacagtgggcaggcagaccataggcagaggtgcagacgggagacaccgcgatagaccgagagatgagagtcgcacgtttgatttttggaggaggaagcattgaaacggtgccgcccctagcgccttgattcctggtcaccgcccttcccccttcctgtcgcgcgcacctggctcaggaaacataagcgacttctcaaatcctcctatctgttgggcgttgtagagctgtagttttggaccagagacttggaggggacttcctcggtttgggttgggggaggtgcctatgtgttggagatatgggagtaacaagttatttagaattttgggccggttcttgggcaacccatcccgacccattgggctctgcccctgcatgcatgcatggtggtgccgtatgcgcgcttttcttaccgtgatcatccggatgcccttggataggccgatcatgtgcattgatccatacataatattcaatcgtgtacatgtttgtgttccataggcggatgcatcagccggcgataccgggagccgagaggacaaccaccgtgcttgttagcggatacacagtaaattatattttgaatgttatttttataagatgcaccactagaaaactcatttttccatggggccaaaacctatttctccatgtggttggatcgtcgtttgcccggaaaggtctgtgaaaatagcgatttttccatgcggttgacaatttttttttatttttagactttttttattttttttaattttagtaatagatctttcccaaaagtatttttgaaaaccgaacaccagcaccaatggcgtggcacgagactggcgtggaaggacagcactgccacgctagctgcgtgtggcgtgacaaagttatttggccacaacaggcgggctggcgtggccaaaaagttcaaatttagaaatacttttgggaaaggtgtgaaaattaaaaaaaaaagaggtttaaaaaataaaaaatttcgtgggtggcacatccacgcaaaaatccgatttcggcatgcggttgtttatgttgtccacacacaaaaataaaaataataaattaataaaatctcaaaaaataaaaaaatcagaaccctagcttctctatggtggcagcggcgcggatctggccgtcacggggccggcagcggccgattgggaggcctcgtcgtcattgttgtcgtcggcggttgcaccgttgaggtccctgagctggccgccgcctactcccactcggaggagaggaagagagagagaggagatgagaggaaaataatatgaggagaggaggtgagggaaaaagggagaggagattaggatggtcaaatttgaagtgttgggagggaaaagggagaggatgagaaaaaaaaatctgtggatgcgagggggtatttttgcatgcggaccggttaagaggtccaaatgtaaaaatagactcatttttgtatgtggcccggtaagatggctacatgcgaaaatagatttttgcatgccggcatcttaaagaaccatatgcgaaatatgcgaaagggaaaataagattttgcatgggggcatattaaagagccatatgcgaaaggaataagttcactttaggtccctcaatttgtagtacagtatgattttcgtgctcagttctgaaaaccggatatgtcagatcccccaacttataaaaccatgcaaatgaggtccctcggcagtactaaccccggttttagctgatgtgacacctacgtggcgcgtatgtggcttctttgactaggtcttcggcccacgtggcattgacgtggcgctttcgtggcaattcgatcccgaaaaataataacacccgtgggagccacatgttagttaaacaacaaaaaatggtgaggccatatggccccacatgtcatcccaccactccctcctctctatatgtggccagtgcagaggggcggcagcgggcggaggggcggtgccggagcagtcatctcctcgccggtctcgccggactcccttccttcaactgcctcgccccggtggacggcgggggaaaggagtggcgtgcggcggcgggggagaagaggagcggcggtgggtcatgggcggagcagaggggcggagtggcgatgggccgcaagtggagtggggcgggcggatgagaaggacgtcgctggggtcgtccgcctcgcaggggtgggagaggagatgcgagcggcagccgacgagagaggagcaacgtgtgggctccggttggctagaggagaggagccgcgggcgacagaggacacgcgagcggcaattggcgggaaaggagtcgcgagcagtggctagagcagcgcgcgggtgaggagtcacgtcggcggcccgagcggccctgggcgcctgctagcgggaggagaggatccgctgcggcccgttgatgctccgcccgtggccctccacctcctcgtgggcctcatccctccctcctcacagcgctcccctctaacccgcgtgacgccgccacggagtgcatccacgtaaaggctgcgggcgcagtggagcggatggtcgtcgtcaaccgttgcagcgctcgccggcaacctcttcctccgccgcccgcggcttgcctctgccggcatgctctggccgctgcactccgcccgccctgctctccagctgctactgctccatgtgagaggagtgttgtgacgatgatgtggggctacatgggccctaccgttttttattattttgtgtgtgaaattgacatgttggtttcatagggttttattattttttctagatcaaattatcacgtaagtgccacatcaatgccacaggggccgaagacttagtcaaaggagctacgtaggttccacgtaagccaaaaccgggggataatactgccgaaggacctcgtttgcacggttttgtaagttgcaggatgcattgtatccggttttatggtcaagggataaattttgaactcggtgataaattaaggccccgtttagttcctcaaaagtttttttccaaaaacatcacatcgaatctttggacgcatgcatggagcattaaatatagattaaaagaaaaataattgcacaattaaggaggaaatcgcgagacgaatcttttgagcctaattagtccatgattagccataagtgctacagtaaaccccttccaacatccagtcaaacatccgatgtgacacccaaaaattttcatttcgcgaactaaacaggccctgagtgatccaaagtgaacttattcctatgcgaaaataacggtctatttttacaggcacgaccagttacagtccgtctgtaacctataggattctcgtgcagaaaattcgtttatgtggtaatgattggaataaaaatattctagcacagagtttgataaaataagatttgccaagactctaaaacttttagcagtccacattgtcacattgataacttccattagttcaaaggttgagtgatcatcacacgattaggtctcacacattgcagacaaacaggtactgttgcgataattcactggtggagaaaccatctttcgtcggtcggccgaatttcacaatagtcccggatgcaataaaaaccggggctaaagatgatctttagtcccggttaaaaagggtaacgggcatatttgatctttagtcccggttggtaacaccaaccaggactaaagatcatcatctttagtcccggttcaaatgctgtcagggcctgtcaggccccccaggatctttagtcccggttggtaacaccaaccgggactaaagatcgtaactttaccaaccgggactaaagatctcggggatctttagccccggttggtgactaaattcccacccctatatatatgtcttcttcctcctccagctgcccgagcaagcttcaaaatttcttcaaaaaagaggggaggtcatacaaatcggaggtgcctaaaaggtttgcaacttcatcctccaatgttttttttgtcatattacatttgcagctatgttttgcacacttttttgtctccaaaatttagttgtaagttgatgaggtagaaaatttgtgtagggaagaaagaatatatagaaatttagttgatttgctaaagaaggttttataaaatagttgacaaggaaaactatagtcaaagttaatcttgaatactagaaaacaaactaaaatgaaaattaaaagatgtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtatgattttttttcgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattcttcatccaggactattcatttccacttgtttgagtaggggttcatgccaagctataattgttggacatcccatggagagcacggtgttaaaatggaagaagatgaagtgaaagacgacaatattccggactttgctcagtacgttggatttgaaggaaatcaaacgggcgaggagaaaagggatgttgatggtaacgacgttgcggatgatcttggtcagatgttgcaggacgccaaggaggactgcgaaagtgaaaagggagcccataaattggacaagatgttacaggaccacagaacttcgttgtacccaggttgcgagcaggggcacaaaaagttggataccactctgaagttcttgcaatagaaggcaaataatggagttagtgacaaggcatttggcgatttattgaaactcgtcaagaacattcttccagagggaaacaaattgcccgagacaacgtacgaggctaagaagatagtctgccagctaggactggaagttcagaagattcacgcatgtccgaatgattgtatcctatattgcgatgaggagtatgagaacctagaagcatgccctgtttgcaaagcactacgatacaagattagacgagacgatccaggagaagttgacgggcagctaacaatgaagagaattcctgctaaggtgatgtggtatttccctataataccacggataaggcgtttgttcaggaacaaggggaatgctagactgatgcgatggcacgctgaagagcgtcaacaggacgggatgctgagacaccccgccgatggttcgcagtggcgaaacatagacagaaaatttaatgaatttggataggacgcacgaaacaatacggttttga

SEQ ID NO: 10229 - DNA, 1533 bp, Oryza sativa
  unsure (1)..(1533): unsure at all n locations
nggtgcattgatagacatcctggtaccccaacctggtaacgacatcgatgtgtacctaagaccactgatcgaagatcttaagttgttgtggaagaaggaaggtgtccccatgtgggacgaggacaaacaggaggagtttaacatacgagcgctgctgttcataaccatcaacgattggactgcacttagcaacctatccggacaatccaacaagggatacaaggcttgcactcactgtatggatgaaacagaaagtacgtatcttaagcattgtaggaaggttgtatacatgggtcatcgtcgattccttgcagcaaaccacccggtatggaagaaagacaagcacttcgaacataaggctgaccaccgtacgaagcctaaacatcgcaacgggaaaacagtgtttgctatggttaaagatcttaaagtagtgttcagaaaggggcctggaagccagcctatagagagcgaagatggtcacgcggcgatgtggaaaaagaactctatattttgtgagttaccctattgggaattcttggacgtacgccacgcaatcgacgtgatgcacctcactaagaacctttgcgtaaacctttttggctttctaggtgtatacggaaagtcgaaagatacactggaagcacgtagtgatctgaagcatatggaacaacgcggcgaccttcacccagaaccaaaggagaaaggaagccattacttgagtccagccagctacacacttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttgtaaccgtgctcgtccagaggcaagcatcgccaagggttatggaacagaggaggtcattgaattttgcgtagaatttatcgaagatcttcgcccaatcggggtacctgaatcacgccatgaagggagactacggggaaagagaactctcggaaggaaagcaataatgacggtagacaacaatttattccgtaaggcccatttcacggttctgcaacactcttcattggtagctccttacatcgaggagcacttggctctagttcgcgccaggaacatcggtaagtnnnnnnnnnnnnnnnnnnnnnnnnnnnnnnnnnnnnnnnnnnnnnnngcattcaacccg

SEQ ID NO: 10230 - DNA, 1943 bp, Oryza sativa
cgcggtgaatgcgattctagtcgtacccccgagtattgccgtaattattgtgtacacgatgtaaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattataattgactagagaatttttcaaagtttcaaatcatgcatgtggcatttacatatgttaattagagtttttcacaatttaatttactatcattcatatgctaattatatatgactattcgaatttttaaaatttttaaattatgcatgtggcatttacatatgttaattagagtttttaacaattaatttaatataattcctatgctaagtatatatgatgattacaatttttattaattttaaatcatgccgtatgtatatacatatgttaattagagtttttatcaatttaataatatcattcatatgctaagtatatatgattattagaatttttattaattttaaatcatatatttgcttattacgttttatccacttaatttattacagacaacaataatttttcgaagaaattgtcattaatctttgtactttaaaaaattgtaatgcattatcttttattttagaaacacatatgtaatagaaaataatattcagtgcgcttatcagtagtcccggttcttaaccctaaccgggtttaaaaagaatttggaaatagcgggaaaagatctttagtcccggttgaggagaacaaccgggagtaaagatatctttactcccggttgttgagaacaatcgggagtaaagatcttttctttagtcctggttgttctcaacaaccgggagtaaagatatctttactcccggttgttctcatcaaccgggattaaagatctagggctatatatattcccgatgcgcgccctcgtcttctctactagcacttagaactttttgcccgatcgatctctctcggcttctccttcgccgccactgcctagggcatccccgcgccgacgctgccgccgtatctcgccgtcgtctcgcgctcgtcatcgtcaccgccgcctccgcctcctccgccgccgccgcatatctggggtgagagccgccgcgcgccgcctccctttcgatctctctctccgatctcgatctctctctctccctctcggatgacaccggccgccgagttttagacgccgacggcgaccttgtaacgacacgacgccgtgccatgacgacgccgggccacgagacgggacgactccgcatgccggcgtcgcgccacgccgatgctgcgcgcggagccacgccgtcgccgagccagcccgacggcgattcgctgacggcactccgacgttccgctgccgccacaccgagaacgtgaacgagcgaacgaatgtgaacgagaacaaggtgaatgagcgtgaacgagaacgagcgaacgaacgtgaacgagccaacgaacgtgaatgagaacgagcgaacgaacgtgaacgagaacaaggtgaatgaacgtgaacgagaacgagcgaacaaacgtgaacgagccaacgaacgtgaatgagaacgagcgaacgaacatgaacgagaacaaggtgaatgaacgtgaacgagaacgttgtcggacgaacgtgaacgagccaacgaacgtgaacgtgaaatgccattataccccggttaatgaacgtgaacgaacaaacgtaggtgaatgaaacgtgaccttaacgagaacgcgaacgtgaacgatatcgtgaacgaaacgtgaacgtcaaatgcaatatatggtacttcgcggttatcataatacatctttt

SEQ ID NO: 10231 - DNA, 579 bp, Oryza sativa
  unsure (1)..(579): unsure at all n locations
aatgttctctattccatctngnnncnnggatcccgtaataaggtagaaattttattcaaccagcttctcgttgaagttcctcacctccatccttgatcaccgagaaatcagatgcctgcaaaaagcaataaatggtcagcatggtcaacatttcttatcaaggcaaaacactataatgaacatatagtgggcagactattgtactcatgttgacctacgcctccacaccatgccgcctcatatcaaaaaatgttttcatttgtacgacaattgcgcactacatttttaggaacatcaataagatattaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggca

SEQ ID NO: 10232 - DNA, 1365 bp, Oryza sativa
  unsure (1)..(1365): unsure at all n locations
gtggctcccttgattgcnatcggttctcggtacccgaactaactaaacttgtattatttttttcgcaattaattaattaatgcatagatggtggacagggcatggatggataaagagagatatcgtgcgtcatacattgaaggagtcgacatattcatgaaagcagctaataagaatgttgcatctaagaagaccaaagatattagatgtccatgcgtgcactgtaaaaatcagaaaagttggaacgatccatctgaaatcgagcaacacttggtgacgcttggatttgttgagggatacacaaactggtcacatcatggagagatcccaagcaagcaagttccgaaccaggctacagtacacgacgaagtgttgagctgggacgaggatgtcattgtagtagctgaagaagaagaagaagaagtgcatgcagtaaaacccgttgatgatgatgatgttggtggcaatggttagcatagtatagatgatgatgctgatgatggtaatgtcagtgtagatgatggtaaatttgcagatttggaagagatgttgcgtcatgctgaacctaaggttgttgctgggtccgctcatgggttggacaactttgatgcattgaaaaagacagcgaatgatcttttgtacaatgaggcaaagggctgtgagaaggatttcacattgttgcggatggtgcttgagcttatgagattgaaggacagaaatggttggtccgacagtagttttaatgacttgttgcttctgttgaagaaactttttccgcaacccaactccctgccaacaagcacctatgaagcgaagaagcttatatgccctttgtcactgggtgtgcgaaagatacacgcgtgtgttaaccactatatcctattccgtaaagagtacgaggatttggacagatgtccaacatgcaagagtagtcgatacaaaacaagccgtagccagtccgagggtctagattttgcccttgacgatgaagaagagtccgatccatgcaaagacagtaacaaaaagaagatttcccagcttgtcatgtggtaccttccggtgaaagatcgtttgaagcgtttgttctcaaacccgagggatgccgaatagatgcgctggcatcatgaaaagcgaaaaaaggatgggatgatcgacatcctgcagatgtaagacagtgaaaggaatttgacagaaattatataagttttcggaggacccaagaaaagtaaggttcgcattttccacttattgaatgaatccatccgtgacttggcaactaacacatcacggggcagaacttcttactatttcaacctcccaacgtggttgtttcaaaaagaaagattttctgttaccattcttgtt

SEQ ID NO: 10233 - DNA, 2902 bp, Oryza sativa
  unsure (1)..(2902): unsure at all n locations
ggccgccnntttgattgcatgccgtacccatacccgaagcgttgatacggggacgattcaaacatacgccattctatcgatgtcatgcacctagagaaaaatgtcttcgatagcaccattgggactatactgggcataccaactaagaccaaggataggctaaaatcacgtaaggacctcgtggatatgcaaataaggaaagagcttcatcctgtggatgaaggtaataatggaaaagtgtacctaccgcctgcttgctacaccttgacaagagacgagaaaatggcattgtgtaaatccctacatggggtgagagtgcctactggcttctccttaaacattaagcgactagtgtcgatgaaggatctgtcgctttcaggctacaattcccatgactgtcatgtaatgctcacagtattcctcgccattgcaattagaacaatcgagcagttcacgtaaagatggtcatcacaaagctctgttatttcttcaattccatatctcagaaaataattgatcctgaagagttaggtcctctccggactttcgctatacagacagtgtgcgagcttgagatgtgtttcccaccatcatttttcgatatgatgcaacacctcatagttcatatcgtgcctcagataattgcacttgggcccctgtacctgcattagatgtggcctttcgaacgatacatatccattctaaaaggctacgtacggaaccgcacccacccagaggaatccataatagagggatacacaaccgaggaggtcgttaagtgttgcattgattacctaaaagatgagaaagcaattggtttaccgatacctcgacatgaaggtagattatctaggaaaggaacaaaagggaagaaaagaatccacgacaatgactacaaaaaagtgaaagatgctcatttcactgcgctgcagcaactcgcaatagtggagccgtacatagagcaacacctgcatgaattacaagcaacaaatgcgggtcgatctaatagatggatcatgaagaaacacaagcatcactttactaaatggttcaagaacctcgatctactagatggcataccatagaagaaagaacaattaaaatgctagctgacgggccatcaagtgtgtatacctcatggcaagcatatgatctgaatggatacacgttttacacaaaagcgaaagacaaaaggagtgcatgccaaaacagtggcgttcgagtagaagcaatcgacacaactgggcaaaagagcacatattacggattcatagaagaaatctgcgaactagtctacgggccaaatatgcagattccactgttttggtgccaatgggtgaaacacccagccggcgtgtctgtggacaactttgggctgacaatagttgactttgaaaacgtaggccacaaggatgacccatgggtgcttgccgatcgggtcgctcaagttttctatgtgacagacccatctcatttgaagaaagacatagttatttcgggaaaacaaaggattttgggagttgatgatgtcgaagatgtcgaggcatacaatcaatatgagaacatgacactattaacagatttttgaaacaagatattatgcgtcgaagaatcaattggtgaatcgccgaagccatacatgagagatgaaggtgtagggaaaagtgttagatgctaattcattatatatgtatcatgttggacgtatcgatgaattttaatgtattataatgcgtgacaatgatggatgagatgaatttttgtatatggaatatggtgacatgataattgttggatcaagaaatagtttggtataaatttatttgtatgcatgcattaaaaaaatatcaggtgcaaacaataaaaaatcatattttattttttttcataaattaaccatatttgtgtaaaaataaataaaattattttttcagttgagaatgacatgtggggccaaagggttttcgctggcggccggctttgcccaccgctagcgaaaactgttttcgctagcggcccacataagctaccgccagcaaaaactattttcgcttgcggcccacataagcttgccgccagcgaaaacccttttcgctagcggcccatggaatcctccgccagcgaaaatgttttcgctcgcggttggcgcgttcctccgccagcgaagatgtcttcgcctataagttgctagcgcgcgtggctgaaaaatttcctaaagtccggggggcggccgaaccctataaatttgggccaccagggttgcccaaattttttattgcccgcctccagcgataacccctaattacccggcaaccggccggctgttttcctccttcattttggaccacaggttccttcatttggggcgcctccaccggccgccggcgggtttctttcttcttcttaaggccgtccctccacgcgctaatataattcaaattacggctttttttttgttgggcgggtctttaagaacaggtgtgctgtacatattttttggcggcccgagagtccacctaggtttctgctctacctccccaccttcgagaggagcctacctcctctccccaactcaaaagaggcgttgtatagtattctttatgcgatatctcccacctatcttttcttcctacgacttcaattggatagaatcctctcgccccgaggatctactcaacaaaaataatttctctcttcttttctggtcagacatcacaatactctctctctaatgtcgcttcacacccacatatacgaattctcgtcgtaatctctcatactctcgttcgtaggcatgttatactagctcaacctgtctgatatatcacaatcctctctctgtcacccngaactcaatcctatttgttcgtctatatcttcacagatactatcgctctntctt

SEQ ID NO: 10234 - DNA, 20436 bp, Oryza sativa
  unsure (1)..(20436): unsure at all n locations
accgggtcctcgtcgtccacccccctccctgccacctccaagacgccgccgccgcgcagggactcgtcgtcgccgcctcatttcaccacggtgagcccacgccctccgcctcacctcttctgtcttctctctgcttaaccccatcttctcctcctcagccgcgccgggactcgtcatcgcgccggtgtaccttggagatgccgtcgaccaattcatactatggcacatgaatgatattgaactagggtcaacggatggaactgatcgtccaccaaggataccggtgtcaccgtcgcgtccaccagtcgtagccagtccgagggatagtcctattgcttcaccccctagaccagagccaccagttgcatcacctttaggaccagagccaccagttgcatcacctcgaggaccagagccaccagttgcatcacctccagtaccagagccaccagttacatcacctccagtaccggagcctcccgttgcatcacctcagacattaaaggatgcagaagaaccatcagagcctgtacaagcagagcctacaaagctagcggcgggtgaaattgaagcggtgcctgatcagccaatgcccgatcaaccagagcaatcacaaccagagccatcgcaaccagaggaacctaagggtgctgatgtgccagtgatggtaaggacgcacaagcacaaagcaaaaagtgagtccaagaaacattatatggtaacagattccgaggaagggacaaagatatcataaatgccgaatttgataacagaaaattaaaagggttcaaacagacattcgttgactatctcaattatatcaattccccagacgtgccacacgagtttgagaatggcaaaccattcatttacgactggcaactaagagaaggaccgtgacaactaagaaggtggcacgattggtacattagggcaagcaccatgaaaggcatcgattcattcacagttgccgtgggggagaacatcttctggagcgatccttgtctactccaagtccatttctccgatatgcattccctctaccgtaggaagcagctagactccaatttgattgccatctggtgtctgtaagtgctacacttgaacgtgttaatagatcactacacctatatgcgtagctcatttgatcatccattgttggcaggatgaattacgtggaagcggaagcgatgaaaaagcctgtcgcctacctaaacccgtgcaggataagtaagccgaaccacacatacacgctaaatgagaagaagctaccagaacaaaagagaggaaagcttacatagtacaaaagcatcttgaaaagatgctcgatgtcgctacgtacgtagctattgcgcttgaatctacgtaggacaaggagtgtgtttatgcccaatatgcctttgagtaagttgtaatatatatgcactaagagtatatacatataatcatggcttgactaacaattccgttcgcagcgaccattggatagtctttcttctctatccaaagtacaatgaagtcatcgtcttggattctctcgacaaagatggcaacacctatcaggaatttctaagaattatcaatctgtaagtaagatattagcatgatgtgttttaacctctgatgaacacaaattatttatgtccgcaaaacagtgcatttaaaaggtattaccagcgaggcggacaacgcaaaaactcaagagaacgcatatccgtccgcaataagtggccggtaagtacatatatatgtatgccacacagtactacttaattttcataaatgcttgtgtgtttccatgtaataacctattataccttataattattttgatgttgaaagtgtcacaagcaaccggtgagaacagtactatgcggatattactgttgtgagttactaagggttaatgggaaatattgtgcgaattacgacgaggtaagtaatacagactagttaaattagtcgctaacttgtattattgtgaatagttaatttccttaattctgtcatgatctgatgcagcttccaaaattccccaagtctgaaagagagctcaatgatacatccattcagaacattcaggcggacatgtgctacttcatccaccgtgagtgcgcacatcagcttgggcggtttttcgacaacaaaggagtcttagccctgctggagaacgaatccctatctaactggaccaggcgtataatatagctagggttttctaattcattcaaaatacttgtaaatgttatgtcattggtcgaatttaatttgtcaatgtacatatatatataggtgcttccgaatatttatatatacgtatattattctgcttcatatatactcaatgcgtggctctaaaatacgcgaaagagaacatactctgtcgatagctcgattagttatatcaaccacgtctgactctgaaatacgcgcacgacgaaaagaaaaaatagtatatataataatgttttaattttttttaaaaaaattgcatcttcactggcgggccacgtgtcagaactaggacagtccatatcttcgctgtcgggccacgtgtccatccacagaagccttacttcatttttcctagcgtgccacgtggcctaaaatactgagccgccagcaaagaattatcttcgctggcggccgacctaaggctaacgcaaatggagatacttctttgctggcggccgcattatgtccgtcgccagcaaagacatgtcttcgctggcggccgtcctaaggctaccgccagcgaagacatctctttgctggcgggcgttcctttctcggccgccagcgaagatgcattttggctggcggtaaataaccgctagcgaaaatcgacattttcactggcctttgctttctggcggttgcgatttccgccagcggaaatccaaaatggctgccacgaaagatggttttcgtagtagtgactggtccaaatgcatgtctttgcgagtaaaagctgtggatactaacattttagctagcaaagtggatagggggaaggaaccatcctcaccttatgaaatgaaattgagggtgtgtttagttcacgctaaaattagaagtttggttgaaattggaacgatatgatagaaaagttggaagtttatatgtgtagaaaatttttgatgtgatggaaaagttagaagtttgattgtttgaagaaaaagtttagaactaaacaaggcctgagaatgcatccattagacttcggcatttacaggagtgcaattgaacaaatatgagttgatacattagaaataagggctcgtggttcgttgagtgttttgtagtaaacgaggggtccacctggaagatttgtttagcaccaaaaagtgctgtaaattactagccgaaaaatttgagcgagcgggcacaaataaactgttccacacactgcccccttttgtaaggcaaaaaattccattgctattatcagagcctacgtaaagagcacaacatgcacaccaattttgtactgctagaaaaaaaaaacataatcaccatgccattgctctttttattcatattagaatccatctcgttacttgcatagtacaggtacccgctgccatgagcccatgattctgatgtcctgaataaacggacgagtatataataccgccgattatccaaattgagcaaatgtcacatcaactccaaattgcattgcaccagttcgattgatttcatggaaaaacacaagaggacagtaagagacctgtgtaccccatccacagcccagtaactttccatgcaataatcccaacacaactactatactgctactttgctctgactgaaccaccactacaccatcaatttcgccgatgtcattctcgttattatcacttttggatatgcaattcaaccatccactaaccaatcaatcaatcagtataggaaagaaatgaactgcagatagaaattaacatatcctgaagacctctccaaagtgacagtgctgccgatctcaccgatgttgctatcctgtgtgtgtctctaagacgagagggatgcacttgactccatgaccagcatggttcacgagccagtcgtatgaaagattgtggcattcctccgaagcaacgagagccctacaacagctagcactaactagtgatgaaactctatgccatatgccagccaaaccaagagtgcacattcctggtgccacccatacccaacctgtagggtgtacgggctggtgcattacacttgttgtgggatggatggcacatgctatttcttgcaaagctgagataagggaatctaccccctgccaacacaattaatacttgtgatttgtacaaagcaaagatgagcaagaacagttgagcagctgacgaccgggaaatagttctgaacatggccagctgagactgacgcatttaatgagcatgtgatcttagaaaattcatatcaactattcatgtttttggttttagagcaccgaaaattcatcatacattttcattgtttttctcaagtttccaatcatgtttgacgggtgccgactcagaccacataaattgacattctcgctttttttagttatttggttggtctgcctcaaattttccgcaactattttgtttgattggtgcataccacagttgcaatcctggcaacctcgcccataccttgaataccttgttgttggcccatcgcgtcaaggcccagcactgggcctaggcaggttgtgtgaccgcctgagagccacagccgtgaggggtccaacccggtatcccttgggtacaaagtagtgcagtggcgcagccaattgcaactagggtactaggcccagagatgattcgagttcgattgaacggctcatcggtgtggattgccgaactgactccaatcccaaactcctaatgatcgtttactcgattcgtcgtctcctcctctcgacctctcctcaccatgacagaccagggtcacggactcacggtcatagggcgtaggcagcggatggcgacagcctcgacaccaccgcagcctgcagcttgcaggccacaacacagtaggcagcagcggctcccagcatgcacaactgcacatgtaggctaccccctgacaatttttgctacctatgcggcctacctataagacatccactatgcatagttaaattcgtaaattctttagtagtgttgctatgcatgatcttgagcttcagtagttagatgtgaagataacatttttacatggagagcttgaggaggagatatacatgaaacacccagaagggttcatagtacctggtaaggaggattatgtttgtaagttgaaaagatccttatatggtttgaaacagtctcctcgtcaacggtataaaggtatgattcatttatgttgtcacatggctttaagaggtctgaatatgatagctgtgtatacattaaatttgttaatggatcacctatatactacttgttatatgttgattttatgctgattgctgccaagagcaaagacgaaatcattccattgaagaaccatttgagtagtgagtttaagatgaaggattttgatgttgttaagaaaattttaggtatggaaattattagaggccgacattctggtttgttatttcttaatcagcaaagttacattaagaagtttgttcagcgtttcaacatgcatggtgcaaagcccgttagtacttctattgcacctcattttaaattatcagctttacaatgtgctagtactgatgagggggtagaatacatatcaagggttccacattctagtgatgttggttcttttatgtatgccatggtttgctttcgtccggatttatctcatgctatgcggttggtcagaagatacatggctaatccaagtaaagaacactggaaggctgttcagtggattttcaggtacttcgaggcatggtagatgctttcttgaagtttgtcaagactaataagggacttgttggctttgtggattcagattttgctgctaatttcgataagcgaagatcactcacaggttacgtgtttactattggtagttgtgttgtgagttggaaggtaacattgcagcctgttgttgcccagtctatcactgaagcagaatacatggatattgctgaagcatgtaagtaatcattttggttgaaatgattgtctgctgagctttatggagttgattcttgcattagcctattttgtgagagtcaaagtgctatatacctcactaaagatcagatgttacaaatcacattgatatcaagtatcattatattcacgatgtagtcgcacaaggtaagctaaaggtatacaatataagcactgtcatgataatcctgctgatacgatgacaaagccagttcatgttgctaagtttgagttttactcaagcttagttggtgtagtggtttagcccaagaggctatttagcgctgaaagtatttttctttgttgtgttcaaggtgaaggattgattaatgctacaagaagaaatttatttcaaggtggagtttgttgagttgtgatccaaactccggatggagcgaagcggaggcccgtcgctagaggcttgggccggagtgaggcggattgatttattgtgatctaaattcatttgcacatgtagtgattgatctattgttttttatcgtttatttgcctatcatttcctaacaaaacacgaacagattgtatatacgaaacatctcgccaaacatcgatttggcaaaggagcgggctgacttgccagctttgttcagtgtagtggggtagcaggtggtgttaaggctggactctggagaggtggaggctggagagggtgctcccgatgtgaacgtgttcctccagcgtgcccgccgtgcaaagctcggcaaccatctttaacctatcgccgaagattcgtgcacgaggcagggtttcttctgtcaccgttgccgccatccctactaggcactgccatcatctactccacgggaggggagggattgactggatatgtggggtggcgatggtgtcagcaccactgctgtggataactagcaagagggaaagggagagagagaagaaaaagaagaaattggcgaagaagatggaaaacatgacagcgatgatatgtttttaattttatgcgtattcaaatggcatggatacaaatagacaaatttacctaaaataacacatttgtaatggcatgaatcaaattaacccatttacatatggatatggttggtctatttggcagtagttggctacttggccttggaaaggggaaagagagagattttatttttaattcaatgtatatattttactacttactagtcccaaaattaatggaacttgtagggcaggctccttaccctgtagtattttacagtaagtatctgatattttttaaaagtttatttctctttgtagttatttatttttctttagcttcattagcccctatgcacttacatttatttgacaacatttttaacggccaaacaatttattttggtattatataaatagaagggagcgtaagttggctgtaagaacatttgacattaatacaatttttactgtagttcttctactgaccagcacatgaaaatctgcatgtacaggaagaatagtgctagtagtcactatgatcagcgtcccttttcatgtatctggtcaagctaattaaaagggcaccacagccaccgctggtgcgagtatgcaaacaatgggggaaccgggtactcccaatgcctccatttcctcatgatcctctttgtttcattgagttattttttcccaatcctccgccatggttgtcaccgcaagattgtgaattcaattacgaggcatgagcagccggaccatgggatattcaggcactcctggtgtttcacattcctaatggcctctactgtagctgccatgtaatgctagtcactctggccactttcttgccattattttacgaaatatatatatatccactcgagtaatggtgacatgaaaaatactaataaactatccagagcagattgcttactcccgctctgctatcaaaagagcatacacaaatctaaagcctaaccaaatgatgagcacctagcagcgaacaccctaatttatccttgcctctttcacgttaccaaatatgtagaagcttactgtcagtctcaattaaccaaatatagtactagctgcaaacaaggaatatatatgtgtgtgcatgtgtacgtacgcaagtgattgaatcgaacaagcaattcacccaaaagtacagtagactagaaaatatctcctacagttttcgtttcaatatatatatatatatatatatatatatatatatatatatataagcagcaaaccaataatttcgtattatatacggattcggtttacaatagcagaaaatgaaccctagacgaactcttctatccgatcacttttagcatgaacagtgagaataggattcacttgagtatccagaagtaaaaccagagacgatcacctaatagctggcggcgttcaccagacatctgctaggtcttggctgcgcagcagctaacaaaatcaatcctaatccctcgttacatggcctatggcctgtttatatacatgcacattaattaatacttctccgtttcatattatataagccgtttgactttttacttagtcaaaacttttaggtttgaccaaatctctactattataaaaattaaaaatgtttttaccagtattttggtatgtcattcgtgtatgagtcggtttttaagttcgtttacttttagaaatacatatccgtatttgagtcggtttctaagatcgttcactttcggtaatacagaagtaatcatataagaaatctgtttaaaaaaactcgtatgttagcttaagatgatcggtctcttaactacaggtcatgattttctaaaaatatatatattgaagcgaactcccataatgaaattcatcttaactaaaccatataacaataataacattaaaatagacttcacccgttgtaacgcacgggtattttttctagtttaataaaaaatagtaatatctacgacaccaaattaatttcattaaatttaatattgaatatattttgataatatgtttatttgttctcttcatcctcgcagtcgcagctgctgtacatatccttagttcggagatcggcctcggatcgattcgccggtgttttcttccaactcgatctctaatgtcacccaccggctccttgtgccatcgatacccacacagccagactctctatgtgttaacaccttcaccgatgtaacggcgagccagtggctgtggatttccaaagatggcgatttgttcctcttctctgttcttcgatggcttgttttcatgttctgaacgtttttattcacacagtagtgggcacaaaattttttgatatggagtaatttgttacactgaaaattttgggttacaagaaactaaaggtatttgattacacttaataaaattatgagttataggaaattactccctccggattgatattacttgtcgttttggacaagggtatgatttaaaaaaacaactttgaccattattttttattataatatgtatataaatattaacaaatatatgattttattaaagtatttttaagactaatctatacatataggcaccatatttcaaacataaatattttagaaattatttatcaccatagattttaaagtttgaccaccctcttatccaaaacgataggtattattacctggagggagtacaggttatttttaatgagtgaaaaaaaatccagaggttccaacgttcaagcagacttcttgtgtgccgtctaactttcttgcgttgtgaactaattaattttcatatcctactgttgttgccatgtatcgtggccacagtctacacgtgcttttagcactaatctctaactaatttcttgtaacaaagatgaacgaagggaaaggaatatagagatctttcttgactgcgttctttcataatcatcggtaagtatacatgaaagcaaattactctgttatcatcaactgcataggtcgcaattattgatcaactacctagtgtgtttttggcaagaaactacaagcataatttcataattacgtttctttggaccaaacaaaatacaagcgtcacctaagtatatgtgatagaagtgtgatagatatcatgggcgctcacagtgtgtccctgatatttaccattcctcatgtacaccaagtagacctccatactccacaatgagtacttattgtgggtccaccgaaaccatctattttacttttcatctcctaatctctgtttatatctaatctgtttcttttctcacctaacctgtttcttttctcaccggggaatttttcatcttctaatctctctctcctctctttcttttctcaccagggaatctgaagtggtggccggcggggcggtccgagaagcgatggcgctaggcggcagggcggtgcccgagtgcctcccctcctcctctcccggccgccacgaattgaggggcggagtggtcggggagctacgaccggtgcggatcaggtggcagggtggcaatagtgctctggttggcgcagatcaaagggcagcgcggccggcagcgagctccgtctgttgtgaaggcaggggccgtgatgagccccgtggcggcgctgtcctatctcccagtcggtggtgccactacaatctccggcgaggtgagctcaggaatggatggtggtttccctcgccaatgcctgcgccgaagccacacccacgaggctctgcccaccacaacgcgacaactcgcctttttccctgcttcacaagtcgttcttcgttcgaagaatgagtgtccaagtttggctccgagaaccttattcggttctgagtactgccgatgtggcgcccgatatttggtttttgccatggagctgaacgccacatccttgcagtgtgaacaccctaattagactagtcttattgtctggcagcctgggtaggtaccaattctagaccattcatctagcacgattgaacgactaagatagactcagtaacgagcagtaccactgtttgattccatgcagtaccaccacctgaagggcatttttgtaattttcacatagcctctgttcagatcagatcggctcggccagcctcccgcccactctccatccaaggctcccagcttccttggggcagcatggacggcgttggtagtgggctgcagcattcagggcgacgacaggctacgggatctagggcggtagcaggctgcgggatctggtacagcgggctacgtgatccgggtcaacggggtgcatgaagccaatgatgacaggttgtgggatgcaaagcacggcagcggactatgggatctagtcgagggagtgcgagacctgacaggtgagctccattctagctcgttcgcatcttgcctctctagtttaaacgtctagatcagtactatgtagtactagtaccgcggggtaccaaatgttgaacagtaaaaaaacctctttgcagattgctcatcgcaatccacatgagaaaattgtttcattgttagtagcctattatagatttttcgctagtttaatttgttgttgcagttctacctttcagtgcggctgacaactattcaagtacacgttcatggtcgtgaatgattgtgtgcaacgactctctatacttcaaaaatcatgcttcggacacaagttttggacacatgtgcatgctgctacaatgtacaccacatggtaggaaagctctctttgaatgacgccatgcaagaaacataagaaattgtaagatcaaacctaacaacggcatgactgaattccccgtgcttcccatcccgatctggaatgtatatttcctatatgcgtgtccggcgttcatgatgaattggggataaagcaagacgatcgacaaggctagtggaatcctctaactgttccacaagtggaagaataaattggaatcaatatgcagcagaaaaaaagtctgttgctacagcttgcatttgattttgtggacgctgtggcattttttatcgaactggcaaaggcaacaagtacgtgctaccaagttgcttttgttataattggaatcgatgagatgttattctccactggactgaaaatcttccaccgtatgttattgtcctttgaagagatgatcgactccatctctgataccatcccagctctcatgtattcctgatgtttctcaagcctcagaaagatgccgctatttccaccaaatgtgtgtgcatatattctcgaccctgagtaagagtgtgagatcgaagaacgtaaactgcacacttcataacataacctactcacagagctgaacttatattgttgtgagcttggggtggttcatgatatgcaaaatgttggatcgaacacaagtaaccaagcatacttaaaggggttgatggtagaaacaacagaaagaaaacttttagtggacataaaagttaccatcgtagccgatagagatcgatctgcccggtgtgcttcctctagtctaagagtgtccttgttgccgctctgactagtgtagatatgtggtggtgcttcttacgttgggcgttgaagtgtgctgataggcaagtttcatttcaagcatatgtaatttttttagtggtaattcagtatagataaattttcttttaatttaatcatgcatgtcaatataacagtcttagttttctaaggaggatgagcaatgcgacactctgattttgggtagatccagagtggcatccaaaagtacaaaagatgttggagcagctttggcacttcctggaacgtgccaatccgcgtaggctgcgttctgagcgcaccccgttatgttgaaaaaacaaacgcgatatgtatttgtgttcgagtcttagtaagagtcggcatcatgtacgttatggttgtatgggcctgtagtctctgtccaggttgcatacgtatatatatgagtcggggttagtgtcagttaagaaattgagttttttaccgagtctatgttagagttatgcaattttaaaatatgtttctcttctgtgttccatggtgatagcgtccgctgttttcatctgatcgattctggtgaattccaacaagcttcaccagcaaatagaggcactgttgacattaaattgatatacggtgagcagtgaatgcactttcgcgtttggtgaaaattaggtaatttcagcagcactgaaatttacgaaattccatgattttcggcactattttggaccaaaactatttgaaaatttaataaattttgactgaatttgaataaaatttgaccaaattcaatagaaatttgagatgatgacttgccggagccgaaattaccgaaattttcagaaatttcgaactgaaattgctattactgacagtgacatcgatttcttcttttcacagatgcatggaccaattgaaggaattaagatgaatatgcgctgtccgtctctgtctccgctgttgcaatactgttgtgtagtgtttgggcactctggtgtctccctttcccaatggctactactgtagctagcatgtaaaattagctattgtggtcatgccccttcttctcagctgcttgaattttgagaaatatcagcttgggtgttgtctcggatgctcaattgcattggtatatatttctggatgtcatgacaactctgattggagttgggcttttcttttcttttctttttttcatttcatcgatatcaaatcttttctcttgagatattcataaccaagttggttatatgaaagcttttgcacacaccgactgatgcgatttacacaattaccagatgtattcaaagatgcaatttatcagtggtattattcgaactgtcagagtattgaacaaaatggtattgccacacataatttttctgaattggggtcttgatgtctgttgccacatgatacgcaaatgctactcaactatcactcgccatacacttatcagactcaccttgttttacttcaagcatgtacagaaacagaagcataaattaatagcctaaattgaacgatagactttgcaatacacatttactaaaaacatttgagatgtacctagtggcctcaatccttcagtctcttctgaatctgagactcgatgtgccgcttgtaccctgtcttggcaattataattatatgacattgcatccatttgcagcttcactggccagctccaagcagccttcttgccgggcttcactatcgtttgctggtgcattacagtactatcgccttccattagttcttgattatggcaaatttctggccgaactgctgacttgtgttaaagagtgtaaagtaattcatttttccctatggtggctacgaattcctcgtgctcaccgacctgcgacccgtctcaccgagctgctcagcgattaattttttgagatgatgaaatgcgagtttgataactatttatacgacattgcagaagtgtgagatgaaagtcgatcagatcggctacctctacgaacttcaaatttgagggtcttttattttcactaaaagatttttggtttttggtatttctaccatttcaccctctctggtagatttggttattgtgtcctattctacaccggtcgagtactcaatgctaaagtgtgcctatacaacagggtaagtacaaacatgtactgtagtatcaactctctgtgcaacagtgaagattaatttgcccatctgttcaggcccgcgactactgctgccctgcacggtcgtcttgatctacaattgcaaggagaaaaaatgtcggacgagcgacagctgagattctaggagatcctgacacctccatttcctattgaagcttaatcttgtcgtttacccggcatctatatccacatggatatgctatgcatatctacttgatctattcatctcggagttgtgaatggcataggtatatatatggagatgcttgcgtagtggtgtgtacgttgtcatctgttgaagtgtatcgatcggcctaccatatcaaagtgttaattcaacacccaaaagtacatgaagcatcaatttatatagatggcaaaaaaagttactggtagggcttgatacacagtactaaaaggcaagtattccttccgatcacaaatacttacatttcttaggagaataaccgatcgaaattagaatatttgactataaagtaattttaaaatacatagtttgaaaacataaaaatggtatgtgcaaatttataacgagaggtacttttataatctcataaatttattgtaaagtaaatttgaggtcagagtcataccttaattaaagagacccagaaaaaagacgacttcatgcttggttctcacgagcagggagcagaaatagatcttatctgcatatatgattgtatgattttcgtcttattgttaacacagccaattaggcaaactcgcagtccattcaagataaagcattgtaacatgtctatattgttaccatataacatcttctcttatctataaaggataaataatcctactgtagtttacccatggtactcatctaccgcttccacagctgttgtgtatgtaggatcgaatcataagaactaagccaaccagaggggggtgaatgattggtatacccaaaaaccgaaaacttttagcggaaataaaagttaccctcgaaatcgacggaagtcggtctgaccgagattgatctgccggtctgaccggtgttgaatctccggtctgaccgccgaagtcgcctgccgcgcctgtcgccaccgccggtctgaccgccgtgctcctgccggtttgaccgccgcaatgccgccggtttgaccgccggtgagttgccggttagaacgtcgaaacccggtaaacacaaatcgaaaaactcttaaagtggatgacgactttattgattctctctgggtttacaaagtgcaccaacagtactccttacaaaaatttcgactaaactcgaaaccctaactcaaaactcaactctattgctctctaaagcggtaccgggaagcctcacgctccccctctatttatacatgaggtaggcagcctaaagccacgaaccaaactcatactaggagtcctaaacactttagaaaacccattagtacaagaaagaaactttacataatcaatcgtaccaaatttggactccttccaaattcgactccacatcccatacgcacacaataactccatcgtatgccatatggaatctccatcaaccacgtgcatcaactctagcctaagtatcccgcatgatctctgactacaacggacgtcgtcttatccccaagccgactcccggtccatcaccgcaaatactctcccgagacatcgagtcacctacacatggaacaaacaaagaaaccatattccgagaccaagctatctccaacttgactcattagcagtaaacaatagtattacatatgtatagtatccatctagaagtcataatcatgaaataaactcggatatccaaataaacaacccgaaaccgaaaccgacacagtgtcagccagtcagaccatgggctggccagtccgaccgctcgatcatcgccggtctgaccggcaacacctgcccggtctgaccggtcacataaaatgataaacctgtgattcacctgtaaatccaatcatctccaaaaccacttcgtgaataaattccaaataataaaactaataatctccaatacccaattgttcatcacagaataataatcaaaaacacatttgattttacagtgtatgtccgatcgatcacatagacttactccctatgtcccaaaaaaacataactagagtttgaattctgtcattaaaaaaaaaccaacttctatcatcatactccctccgtcttataatataagagattttgagtttttgtttgtattgtttgaccactcgtcttatttaaatttttttgcaaatataaaaacaaaaagttgtgcttaaagtgctttggataataaaataactcaaaaaaataataataataattccaaaattttttgaataagacgagtggttaaatagtacaatcaaaaactcaaaatcccttatattatgagacagagggagtactttcagcacagaaaacaagaagttttattccttgaatgccctttacctacctaccaccattactatcttttttattaatgatagtcattttggtcacttttacttctaactaaatttaccttgggatactagaaatctttttttttttcggagggagcaatacatatgagaatgcaactgtcacatgattcgctggaatatagtgccatatccactactcagcgtccctcgcttgtcagtcaccgcgctgagacaatgggactttctagtatctcattccatgaaggcatcactcttgcttttcgtccattgtgggctgatggcgtgcaaagatcaattggaaaggaaggtagggtaggaattcctgatgcctccctctccaagctcacaatgcgagagtttcaaccgccagccatcatggataaagagtttccaagacaaaattcttatcttacgttttctgtttcagctagtttttattcttggattcaagatatgattatttcagtttcgtttacaatgcccattattggagaataaccccatacttagagtgttgtataaactattgtataaaaggactaaaatactcataagagggtgttgtatatatgtagccaattaagggcaaagatgtaatttcccgttacttacgaataaaaggagctctccaaaggcaatagggggatctctcccccattccactctttctcatcctctctcatccacttatattctcctcacgagatctagcttgagctccctccctttggagggaggcccttgccatgcatgttggattttgcaacaacacccataatagatcggtgcacaaagagaaatacttgctaactcctatttgccaccaagtaactatacatgtgtatgcacaactagtagtggatattgcaagagaaggacttgaaggcactccttcttaggcctgcaggaggcgcacttgcaggcccgtcaaccagaataatggcgcagaaaactttttattgttgtttgaaacatttataagtaacgctctaattatttatttcaaatatgagcattttgccaacgtcaattatagcatgtgaagattttttttttcgggcgggaaaaggatgtgcagagtagttactgctattctagcacgacaagggatcaccggtggagaaaccctttgtagtcccggttcgtaatctccctttagtcccgatttccaaaccgggactaccaatccggaactaaagatcgctatctttagtcccgggtgaaataaccgggactaaagatcgatgtttagtcccggttggtaacaccaatcgggactaaagatggctcagccgtctcggttggtgttaccaaccgggactaaagatcgagctgacctcttttttcttgcatggccctgttgctgcatggtttatatatatataaaccgtgcatatatatgtttcagtacatatatgcttatataatatatgcatatatatatattatattatatttatatatgtttcaatacatatgtacaggcataatatatatgtatttatacatatatatgttatgcaaatgcatatgtatatatatatatatatgaccaaaatatatttacattatagaaaatatgtacacatgcatatagaaacatatatagtcatgtattaattacaatccattatatgtcctagctagctacgatttcgacgtagtagtagtcgctagctcagaagctaagaacctatgaattgtgtttctgtcgtagtagaattcacccttgggattaaggatttgttcattgatgaatcccatgggttgttcttgaaccgccgcgataaatttcttgtgtgtggtcaggttatccctcatgcgaataaactatatgaatgtatgaaattgattagtaattaaacaagaaatcgatatgtaatgaaattttgaatttatttgtacgtacatcgagctctcttgtgatgatgatttagtcttcaaggcagtggcaatactcgcacacgtaatagccgcacaagttagttcccttcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatgcagtttaaagctatgattcgtagtagcaattaacataacaagattttcttaattaacagaggaacttatgacggtacctgtctataagttcgaaaaccttgtcaaacgtagactcttttttatccattgagtcatatacgttgatggtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtctgaacgtcttgtaatgctgcgccttcaagagatggacgagattgtcctctgtggcttgcggatattggtcgagcattgcgacgtttactttccgagggtcgatgaatccagtatcgaaaaccccccgccgtcgggccctttgaatctccattctacaacgataaaagggagtatattattttctatagtctacttatatacaaggacctaattaattaaaggaggcgtagtaagaaatctaactgaacgatatacttacaaaatctagcaactcataatagagacgtcgagggcgtccagctggtatagttcatagattcccttgaaattgatccagagaatgtcatctccttgcaagaagtccgtgtccctgatcctcgctccgatcatctctctaccggtggcgctcatctccatgtacagctgatggaacttgtatatttgtgtgggtagggactgcagcagcttaggcttgacaagcggtttaccgagttcgtacatgtatttcacttccgccttttcgattggtgcgactcctagcaattgatccatagttagaccagtgtcagtaataaattcttctatcgtcatttttttaccgatcaccaacggctcgccctcctgggttggttgctctccaagctgagggactggtttggactttccagaagatgctttcttcagcgttcgctcatagtccgatagcttaatgnnnnnnnnnnnnnnnnnnnnnnnnnnnnnnnnnnnaagangtgttccacccacac

SEQ ID NO: 10235 - DNA, 3001 bp, Oryza sativa
  unsure (1)..(3001): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgatagcttaatggcctccttggcaggtgcagacatacccttgaagaagttcatgacactcgaatctataggaatcttcttttctggacttcgaggcttgaattgtctcttgatttctgatgccacgtaagcgtcaagctcctcttgcgtgcaatcgtaccccaggtccttgttcttggcagcgtcaattttcgccttcttcgttgcccttctgtgggcaggcggtggagcttggggggcccttgactttgaaggtgccagaagaggagcttgcggaggagtcggtgtaggagaccgaggaggagtcggtgcaggagcctgaggagcagtcggtgcaggagcctgaggtggagacggtgctggagcatgaggaggagacagtgcaggatcctgaggaggagatggcggagccggaggagatggtgcacgagacgccgcttgtcgcccagggaggatgatgtactgcctgtgccatagaataatggcatggcttgtgtctcgtagatgcgtctcaccgtctcctccagggtaatctagctcgaggtcctcgtacgcgccttcgaccaactcaacttcgaccttggagtatcctgctggaatcggcctgcagtggtaagtacctgaagggtccgttgggatggccatgcccgatgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacggggcaggtggattcgtcctgggtttgcatggcgtccatgctcagtgatcctacttgccccgttgaggcgcagttgctacggtttcctgacgggctcaccattgcaggaggaatggtcggctggggataattggactgatgtgcggccatgcgttcatcaaccttccttgccacctcctcttgcatgctgagctcatagctcgataccctgaactcaagatctgcaatcttcgcctcggtatctctcttgctcctcttccgactcctgtacgtgtggatgtcctccttgaacccaatcttccaaggaatcacctctttccctcgtgttcgtcctggatgctctggagtctgcagggcgagtgacagctcgtccctctctctgtccggtcggaacgtgccctgagaagaggcttccactgcgtctgttagtcgacgcgcagcctctcgtatctgatcgccgaagactagtgagccatcagctgggttgagcgtttcaccgtgagcatagtaccagaacttcgatcgttctggccaattagcggtggctggttcgatacccctctcaagcaagctagcctccatctcctcccacttcggcatcgcgacactatagccgcctgaccccaagtggtgatggtacttcttcttggcggcattttctttgtttcttttcatcatcgcctgcccttgttcacctatcttatatgcaacgaactcgtcccagtgatcccttagctttgggaatgtgtcgaagttcggtgtctgccccttcaggatatatttcttgtacagctctcccttgaagctctgaaactgttctgccattttctttagagtccaccttttcactttgtcctctgtacccgtgggaagggtgaatgtctcgagcattgtggtccacagcatctctttctccgaatttgggacaaagctctcatgatctccgcgtgcccttgttcttcgccagtacaccgtactgacaggcacgttataccgcacaacccaaccgctgtgacgtacatagttcttggcggcttctaccgaggcactaggtcgttcatcttcttccacttccgttatgatgtgccgaccctcaagcttcttcgcggcacctcgttgcctgcgtgccctcttctatccaacggagggttgacttccactagcctcctcctcctggttcccctccacatccctttccacgtgcccctcctggttcccctccgcatccctctccacgttcccttcctcgttcaaatactggtttggatcctcgttcccctcttctttgttccagtactggctgcttccctctgcgattgtatcgtacaatatctgttcctcatcgcgatcagccatctgttcatacaggaaacatctgctaagtcatgagacatttatgttttaacaatcttatattaaaactcaaataatcttatatgctaagactaaacgaacagtcatgtatgctaagtgtaactgtcgtatattagaaccgtacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactcaaataatcttatatgctaagacaaaaatagccatatatgctaagtgtaactgtcgtatattagaaccctacacaatcttagaagctaagtctaattacaaatctaataatcttatactaaaactcaaatagtgatgatatgtgctaagactaggtgacgtatattataggaccctagctagtcaataattatatactaagtctaattacaaatataataatcttatattaaaactctaataatattatatgctaagacaaaaatagccatgtatgctaagtgtaactgtcgtatattagaaccctacacaatcttacatgctaagtctaattacaaatnnnnnnnnnnnnnnnnnnnnnnnnnnnnnnnnnnnnnnnnngtttataattnaagnccagc

SEQ ID NO: 10236 - DNA, 816 bp, Oryza sativa
  unsure (1)..(816): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcggcaattcttccttttgcatacatacatattatctgtcccatgcatttgtttcttcaacttgctttccaattcatttttttggtcaaaagcccatggtagttctttttcggctatgcgtgatttgagctcaacgcatgcagacagcgagtccgttccatgcggcacgagccagactttccgaacgtctctgttatgtttttaggatggctgtcacaaccgaacatattttcatttcaccaagaacgagaagacaaccagtacaactgtgcagtttcgatagccacataaattttcattttaattttatttaattttccctttttttgggcccccaaaaggggggccccccaatttttaaatttttgaacaggcaacatgcatggcttcttcaagacaattaatggnggaanngnnnnnannnattnnnnnnnnnnnnctnnnnnnnnnnaaatgaagnnnngnnatggnatctggatctgngggcncnctggcgggtaataaccnnnnncncttnccnnccggcnntggtcgctgttgtgaaa

SEQ ID NO: 10237 - DNA, 1194 bp, Oryza sativa
  unsure (1)..(1194): unsure at all n locations
ctgacatccattcactcggacacccagcgctatgcccagaaccggttgttgccggtcagaccgctcggggtcgccggtcagaccggcggcatgcggccggtcggaccgcccctggtcactcgcacgtttgatttttggaggaggaagcattgaaacggtgccgcccctagcgccttgattcctggtcaccgcccttcccccttcctgtcgcgcgcacctggctcaggaaacataagcgacttctcaaatcctcctatctgttgggcgttgtagagctgtagttttggaccagagacttggaggggacttcctcggtttgggttgggggaggtgcctatgtgttggagatatgggagtaacaagttatttagaattttgggccggttcttgggcaacccatcccgacccattgggctctgcccctgcatgcatgcatggcggtgccgtatgcgcgcttttcttaccgggatcatccggatgcccttggataggccgatcatgtgcattgatccatacataatattcaatcgtgtacatgtttgtgttccataagcggatgcatcaaccggcgataccgggagccgagaggacaacacccggcttggtagcggatacacagtaaatcatattttggaatgctattttgattagatgcaccactagaaaaacttattttttcttgggggccaaaacctattttttcatggggttggaaccgtcctcttgcccgaaagggtctgcaaaatagcgactttctccattccgttgacactttcttttatattttacgactattttattttccttaaattaaagcaataaacctcccacaaaataatttttcaaaaccgcacaccggaaaattcgcctgtcctctttatttgcggaaatgtcattctctcgcccttcactttttctgtgtttaccacgaatttaggccatacatcacactgccgggttgctcctgaatgttttatacttgtattctcttcttatatgggtcttatatcacactattccgatcaggacactaaataattctacgtctgccctcccctttataaccctccgtttcgttttgtgctattctccttcctccaaccgtctctcttatcttngctctactcatcctcctccaagctcgctattccatctcgtttactctctattccggatcaatctgcctctccccct

SEQ ID NO: 10238 - DNA, 4366 bp, Oryza sativa
  unsure (1)..(4366): unsure at all n locations
ctgtnattgaattgatatcctactcgnacccatttcgctgccattcttgcgtttgggccatgtgtccttcgaggttgtgctagatttctcccgcctgcaactccagtgcgtccattctcctagtgagctctcccaaatatgtatactctccttcaacttcatacataaagccccatttttttttttgcaaatcaaattaacatgtaatctccaatattacctgatctcaattgatgggctgcgcaggtcctacatttgcacattgtgctccatgtggctagccgcagaggatagtgtggagtccgccggtgatggaggttgattgctatttttcttttgctcgtcatctctattgacaagaacaagaatgtttttttgcatttttttcgtccttgctagatgatggatggctgctaccacgcaacgtcgagctcatctctataccacatcgctacatccttccatgattccattgtcgactactgctcgcgccatgatcataagcactatataaataatcggaatcttgttaagagaatttttctttaattactcttaattacacaagtagacgtgtaattacattactcttaattacacaagtagacgtgtaattacgtcatgtacacaacttgtaatatactaccatacagtgaagagatttttaagccaattaaaatattcactataagtagaaaattttacatgcaaatattataaatgcagttttgctataaatctgtcgtcaaattttttacttagaatttgacatttttcaacctaccgattagcacctgattagggcaaggcactgatcgtttttagctttgccactgtatagaacgaaagtgattgaacgataatactactttaacacgggtgagagatctcccatgatgtatatttcgcaacagtgttttaaaagttgcaagttatagtataatttgtagttatatgtaagttgcaatgtaattactatataattgtactatgttcctttaaaatataaagttacagtcctatataactaaaattatatttataaattcagttgatatgacatgtaagtatattgtaactttgataaaaatgttatgtaaataaatatgtattcgttattttctttaaaatataaaattatagtcctatataactaaaattatatttgtaaattcaattgatatgacatgtaagtgcactgtaactttgataaaaataatgtgtaagtaaatatgtatttgtcattttcttttgtagtctgttggatgtaaatctaaaggtataaaaaatctgggtgatttttttttgttaaaaatcactcgacaaatggataggcagttccttataaatgatgagtggcatacgtaggggtggcaacagggaggggcgggcccaggttgggacatgaatgtccccccctgctacctagggatgggaacggggcgggttgggctacaacggccctgcccccgaacctctgcacctggccctggccccgagtggagatgcggggccaaattagctgagggccccgcaacccaaccgggtccccgtattgggtagccactccatccgatcagcacgaaaaaaaaaactttccatgatcgcaaatactttcacacatacatatttccatgatccatcattccatccatgaactaaatgcatggatgaccaaaaatactttcacacatcaactcattcaactacagcaattcaccaagataataaaatcatagtctcacaacaattcaaccaccatactaaagtcaccgtctcgcccgtgccgctctgctcgttgtccctgcgagtcgcccgctcgctttatctgcgcgccgcaactgcgactgtgcgccgtcgctgcgcctttgcaccgcccactcgccgtgctgcacgtcacccatgcgcatccccgccgcgttgagaccagaggcagagggctgtgcgaccagaggggagaggggacagggaaacatgaggggagaggacgacggcgagaagtggagagcggtgagagagagacgagatccgaagcggcgagagagagcggcatgggggctcggtcactcgggggaggataaggtagggtaggtttttctgctttattatatacctcagattcccactatgtttagatgggcttcttgggcctataatgggctatattttgaggggtaatatacccctgggccccatgggccacggggcacccgcgggttgaatgtctcccccggcccctcacccgcccaaatgcggggccctggccccgactctccgcggggcagaaatggcacccgtcttcgtccccgtaggggcgggtccccgtaggggaaattgctatccctactactacctgctacccgctacccgcattctgccccggctcctattaacggttgttaagtaccaatttcgaccgccaactagcacaatgaataaaaagaaaattagcatttcttacacgtataacaataataaatgtagttgtattagacttggagaattaacatggatgcatagattatacatcaaagtgttggagaaatgaagctgacatgcaaagaaatacactttcggcgaatcacgtgcgagtacacggattgaggggcccacaagttagctcaaaccgattcaaagtggggccaaccacccggccgggaaccgactaagtgccccacctggcggtgaagagaggcggtgccaagggttcggctgaactgacattgcggtgcctcatctccacccattggctcctaataacagttgtggatgcttaatcaccattgaaccttcataagctgcctatttaaaagctcacttcctcactttcagcgcacacctcaaggagaaattctctctatttcatattgtattctctatattttagtagaaataaagcatatgagttttggcgctatagttttctctgagagtcgggtatgtctttagtactatactcttcttgtaagactatagttgaattaaatgaattatcttacttatttgattatgctcatagtctatgtatttctttattgaatatatgttctatgagtagtatatactttgtgatgaaggcgatgcaatgagtggcaaggagacatcgcgatgacgagcgatgagatggcgctaagtggtgatgagtggctttacggcgcagaggagcaacaatagccgccgtctttgccatgaacggccgctgtgcgcctgggatagggtgtgggagattagggaatctgggtttactatatacatgatctgcttacttaactcaatgggctagttgggcctatattattgtaatgtactatttttagggaggtaactaccaccccaaggccccgacgggtctcccacatggtgaaattctcccccattcctaaccccatattgacggttccccggtcccaatggagaaattaccacccctaggcatccgaatgtagttgtccttaataagagtatgttttctggtagaggtggatactacttgtaatttcatgcataccatatactaataaatttagagctaacatgtattagattgtctctaacacacaatctccaataactctaacactctcacatttttattggagtttgtgtatgggttaccccttgcatgaggggtggctctttctgtctctccattcttctctcctccaccttaccatttagtcatatttgtcatcttgaggtttgtgtttagatgcccatagcacttgctctaatatctaatatttaagcaacatattggatcaattgtgcatgtactaattattgagcattcccgggaattccatgttaattaaaaaccttgccgccggttagttggatcaataagcacaaacatagatcgcattatgaatctttcttaagggcccctttgaatcgcatgaatggaaaaatagaggaataggaaaaacacgtgattctaacatgaatgcatgtgtaaaacagaggattgaaaaatacagaaaaaaacatagggatgactatttgattagcccatatgaaaaacgtagaaatcggatgagagagatagactcaagggaatttttcaatgaggttggacctcttgctaactttctccaaaatctctatggggattatccattccataggaattttaaagcatatgatatgattcaatcatttacttcgaaggcccccataggaattattttttataagattaaaattctacaaagtttccccccttttcatagaaaccacccggggccttaaatccaaatgggctattgaaaaaaccccagattctttagtttctactccagttagtgttcgggtgtcgtaaaattanagattcttnagggcnagcgaacgcattcaaaanncggcccca

SEQ ID NO: 10239 - DNA, 1865 bp, Oryza sativa
  unsure (1)..(1865): unsure at all n locations
aggttgttgactnnnnnnnnnnnnnnnnnnnnnnnnnnnnnnnnnnnnnnnnnnntagtgtgaagttgtaccacatatccgtttacatccccctctcctggcctgtttttgctcttctagcgagggtccctttgaaatacaaggaaaaacaaaggaaccatttaggaatcactaggaatgagcaaaggacaaatgtgggatattcttctttccctgcgattatagaggaaaatgggtaggaaatttaacgtccactccaacatcatggtgaaggcaaatcatctagttgttacagacttgttcgttgatttattgtagacatctgacacaatttacaccaataatataatctagaggaatttacatgttttttctacaaccaaataaatgcatagttctacaaaattcccatgttttttcaatagtttatttcacatatctgttcctatcttattcctttgtttttcctaattttatataaaagtcttgtgtttcaaatgagccaaattatgtaattttgtacatattaatagtttctctctacatataaactttccgaaacatgtatagtgatgcgccgaacgcatatagcactatagaaaaaggcttttcccaggcggccaaatcatattttcgcaggcggacaagccatccgcctacacctcaacgcctgcgaaaatagttgatttttgcaggcgggcaacacatccgactgcgaaaatagcttcgagtgctaaaagaaaaatgggcagccaccgccggacggcggtagcttcccgttcccaatccattcccgaatcaccgaatcaattgtggcaaagaaagcaaataaagacattcaaaaaaatcacggccgccgcctagccgtcgtccgtcgccgccgctgcatgtccgcgccacgccgtcgtccgccgctgcatgtccgccgccgccgcacggctgtggcccgccgtcgtccgcgccgccgccgctgctgcctcaacccccctcgccgctgtggccgcgccgcctcgtccctcctcgccaccaccgctcgccgccgtgctcctcccgcccccctgcggccagatctgggagggaggggccgggagccgcctgatatcgttatctacagcccattttggacagatctaagagggagggcgcgatatccgtactccctggtcttaaccctaactgggtttaaatagcattgggaaaaagcgggaaaagatctttattcccggttggagagaacccccgggagcaaaagccaggttcccggccggatgtctttctcctccccccttaaagcattatttggaatttaatattcgccggggcgggccgcttttccttgtcttaccttcccttataactatttggtccgcgccgcggctttttggctatttcctttcctcttcctttaggcagggaatctctccatctgacactctcagacgtaattttatatgtggtacctgtgccatgtcctttgtattcggtactcgtctttttttctgttctcttcgtacaatgctttgtgttgctccaacctcccccctctgccttacatatgctttatcttcccactttcctcaaataaatttctttcgttacctttantctctctccctggccttcatattcatcccgtgcgtttctctcctaatcttgttattttctatctctgctttgctttaatatcataagccttttattccctccttactattataacctgttcgtccgcagatcctaacctcgttacttctctattacctctcctctaattgctcttttatttatctgttactatctcctaatctgcctctatcctttctttagtatctttcttcatttttctctctttctcacatagtccg

SEQ ID NO: 10240 - DNA, 2232 bp, Oryza sativa
  unsure (1)..(2232): unsure at all n locations
gaggggnnnatganatcatgctcggcactcctagattttcgcatgcggacatcaaatttcaccctgacttatatttttgtaggccgttatttggctctaagcgtcatgtccgcctgcgaaaataagacccctatgttgggaaaaatgctttttctagtagtgtaggccaaacataacgcattttggtgcatatgtctagctgcataaatattcgcccactagaagtactccacatgtcacaattgttaaaactacggtgttctccatgacgggcgttttgatagtgggtgccatatggcaggccatgcactgtgccatgacatgtcattacttgccgtaacgtggtaaaatctttaatctgaaagctcagaattccatttacagttaagattttcctttggtatatcagatgagtactcttaacagaagacattttgattaaaaggagaaggaaaggaagtttctataactctaaagaaacaattcaacatctctttttttattgtcatgctgcacatttggtttggaatgctcttttcatggttctagctagaatacaagtgcccacttatgttgctaatcttctaggtggttggtcgacggacttagtacctaagcttagagatcaactcttcgtgggagttgcggctatctgttgggcactttggcttgctagtaatgatgtagttatcaatggctcaagtataaactttttcttgcaggttattttttgggggacgcactggagtcgccagtggtccttgcttcttaaagaaggtgacaaggaagctgtgaagatggggtgccaaaaatcgaaagttatcgttatggaattctactcaaagtctcgacggaattgtagaggaagattgaattgttagctgaaatttttttgttgtgagacttgttctggatgtttttgtcatctatttgccttctatggtggcgtttgcttttgaacttgtttgtcagcctaagtgtgtggtgatgtaatactgcggctgcgtacatccttcgggatgtataaggcaggttttatttaatccattatcttaaaaaaaaaagtcgttacttcccttggcccagtcactgtcccagcagcacaagatttgcagataaaatcatcgattgtcttgaaaaccactgagaaattagggctaattattctggacggttgcgtcaacatttatctgggcttccagtgtgcctgctatcaaagcttgtttgacttgaaggatgaagtgaagctgatcaactgggaaatttgagtcagctaatgtttcgtgtactacataagacttgacgcaaccgagctaactggataaacgtggataaatcatatgtgttggcaacttttttatgataagttgacaacaacgatcgcagcacctaatgctttgaggtgatcctagagtcgccaatcaccttaacctagcaaaaactagaccaagatgggttttgataactaaactagctagcggagccgattactagataactacccgtctcgtgggtaaaacggaaggttttcaggataaacctataaagaggtgtcgcactctcacagcggcgccggacgatttacggtgcaaatcgacaaagatggacaaactaagagaaaactaaaaacaatatgaaaaacgattcgattgattgattgtagattggttagttacagttgaaccggccatgtcccttatataggggttggtcttgacctctacagtcccctccttcatgtctaactcgagatagaatccaaagaaaacccgaaacatatcttcccaagcaaggaaacctcgagacccgacgaaacacactcggacttagacctgctggtcagaccggccacacaccgccggtctgaccggccctcaaccggcggtctgaccggtcaacacatggcggtcagaccggcccactcaaaggaaaccggtagatttttaaattttggcaattcttcctattttaatcttagatgtcaaatttaggtgtaaacaatatgtacctgcaaaatactcttgtttgaaacagcatggtttaagatatattgccgcgattaatttgcccattgtagttatcaccacgagtcttaattttcgttaccacactactagaacaaaattagattgtttggaaagaaaaatcctctgtcttgaagtgcccgtcaaagatnnnnnnnnnnnnnnnnnnnnnnnnnnnnnnnnngaatgagtntagtcaaacaaccgt

SEQ ID NO: 10241 - DNA, 1834 bp, Oryza sativa
  unsure (1)..(1834): unsure at all n locations
ggggcccctttgattgcgttcgttgcaccgcccagtttagtgatcaatggtctagaacatgaaagctatttttccctgatgccactcattccgataaaaggcgcgctggcctggtggtcggctggatgatgatgaacctcgatctgcacttaacgtgcttctgccttgtaacaaattaaatgcagaataatgtgtcgcgctgtcccaattgtggcttggccggtagaaatttctgtgtgaactaatgcttacagataataagtgatgtgtcgcgaacatgaatatatacaccaagagcgacggcaattagaaagcgctattccctttatatatgacttgtgggtgtgctaagtgtatgtaaccatacaatttatcatgtacacatatttatgtcaatgttagaacctttatacaataattcagacaggtgcacaactctactttctcttactcaacccaatggacatattctccattggctcagcatgtccgcggacatgacctgaagggagaagctctagcgaccgttttagaacatctcaccaaatatgttttcctgacgtgttctttccaactagttattgactgtactgtgcatcgatcagagctccacaatgaaaataagaaatcggttcacataagataaataactaagatattaaatggaaattaacttctggcaaaagaaaataattattttccaggcagggtagcaatgaattaaacaacaaaagtttcgcatgcctgctggtccaaaacatatgacatctaacttattctgttgctagctactttcttgcaatagaggattatgttcttttatgcaaacgattgttcccaaatcccaattatagttaaagaaacagattggtaaataacgtttgcactttttcctcggattcacctaaatatttatggtgttattaacggagtagccaaccaccttaatctaaaaaaactctaaattgatatggggtttaaatattaactgaaggtgaaacaacgattcaatagattgtagagattatggtcggggggttagaatcgaaccagccataacccttataaaaggtttggtcttgtcatcataggaccttcgtcatgttctattaggatcaagaaacctcacgcccgagcaagaaaactcgagaaatgataaactggacagagtcagactctgctggtttgagtggtcacatgccgctggtcagaccggacccacaccgtcggtctggtttgccctatgattatggtcaggcctcatatggcgaagatggtctttttcaaatctggccatatttttctatttatcttattaggtgctaaatatgggtgttaacagatactaggtactacttttctatggacacatacatcacagctagattgctgcgccaatacaagatacattcgcaccagatgaagatgttgtcacttcctcttgtccaaaacgctccctggctaagctagggagcaattcagtgtctatgccaatgaaggtgtttttcgtgatgccactcattccccaaaatataaataggtgaactgaagaatgtttagcgctccaattacacactgcacgatggcccacttttcctaatagtagtcagttggggaagaccaagatttgcctacggaatatgtgtagacaaatctatgtagaaattaaaggcatggggattatgtggcggcaattcttcattttgcataaataaatattatctgtcccatgcatttgtttattcaacttgctttccaattcatttttttggtggggatcctctaaagtcgncctgcnggcntnttngaatgggaatctacatatcaaacgctg

SEQ ID NO: 10242 - DNA, 6608 bp, Oryza sativa
  unsure (1)..(6608): unsure at all n locations
tgatggcgcgccnattgannatcgatagacnnnnnnnnnnnnnnnnnnnnnnnnnnnnnnnnnnnnnnnnnnaaagctagatttcacctatgacctagcagttttaactgaaaacagcgttaagttgaagttgtcattaatccgcgagggttcatccaccttccccaagcctcgcttggtcgggtttaccctcgcatctagttttccacacttccaacatcacaatgaccttcccacccatcgggcaaggtctcacctcattcctaatataagcaagattaaaatctatgaggctagtcaagaatagtacaagtcccggtgctcattaaccgcgagcacgactattcgaatagattggtttactcacgctgcagtggatgtacgcttttaatcccacactccgtgacttgcccaacacatgagcctagtcccaacacatgagacccggcttttcggtcattctcgcattttggcacccgctccaaggactataaatctccaatgcactcctagcacaacacaccccctcgagccagcagtgaggggagtcctggcacttacgggatcataagaagttacattacatatacggcatatataggtgcattttagatttcctgcgtgcaaaacaacacaacccttcatcaacatcacatcatcctcatacagatccaccatgacaggggtgccgccccacgagggattcttaatccaccgggtctataccccgtcgaggagtgtggtcgtactctgatcatttctgcctagcttcttgatttgggccttaacagagtagggtcgacgactagcccgttccagaaccacccatattctattcatggcacccagttgaaaacattttgtttcattaggttttcggtttttgcaaaggtttttgcatcgcgggtggcgctcatgtctccacccatcttctagcaatcactctcaacgagtgaccaccacaaacacatccataaccaactacgatggagtgtataattgtctataattaagcaaatctaagcaatgtcaatatttgaccacgcataaataatagactcaggcaacaaggatataataaaggtaacaaaatcaaggatggttcacatacaactttaggtacgcattttataattagcatgcaactttatttataaacaaaacatttataaaatgggttcaacatgctcaagagggaagcgcggtgatttgccttgcttttagaaattgatatcttcacgaaatccacgtccgttgaatatccgcaatatctgatacgcagtcagtacgagaaaaccatataacaacctccaaataaactaccaaacatttcaaagtgccatcggatagatcttgattttagaagaattccagaagttcaacggtgtcaatcggagtcacggtttgcaagatatgaatttccgaagtttttacggatttataatccaagaaaaaattattcctctcattggaaaggaatattcctcacggggtccactgtcagtagctcaggaaggccggtgcatggtagatcgggtctaccgagtgcgcggcaggccaaggtggtggaccacgcgcgggaacaagggtgggtcccacgtgtaagtgtctatcggtacagagtggattaataggagattacatgtggtgggacccatccataagtgactcagtggtgagagacacttgagggggatcaggaggggttactgcccgaggtgtggggagggatataataaagacttttggtggaggaggtggcggtctgtgggttttggcccgagggagtagaagggaggtgaaatagacttttggctggtcaaacggtctcagggagaagtcaagcacctacaaaaaaaatttccatgaaacaacagatctgtaaggtactccttgcttgcaaaaatatctgatcaaaaggcagagaactgtcccacactatgcccagggaattccaacaattgatcaaaaaggggcaaaggaagaaaagatgttgtaaatcttctaccagctgagaaggacaaagaacacagcacagatcacaatttggaggcgcaaaatgcttatgatgaagcatatacttagtatttaatctattcatcagaagcagccatccaaaaactttcacttttgaagtaactttgctattccataaccatataaattgctggggaggttgcaaagcgcaaaaattcagagcatagaattttttataactatatctcaaagttccccaaataaaagcccatatgtctttctcatgatccaaattatgttgctgcaactaaatctgaagtgtctggaactcctgcaaggcctcttgagacagaggtacattgaaattatcctctgaagggactgagagagatttttcgactgaggaattaggactcagagcaaaagaaaacaatctgagcatcaaaattgaaaggggggcatcttaccacacatcataccagaaagagcatgaaactccatcacccacattacatttagcaatacaaatgaacagatccatcagactacagacatccttccaccaaaaggaaccttttagatttgacaaatgtgggattctgttaccataataagaagaccaaataaggttcacccaaggcaagtctctcctattatagaatttctccaaaagcttgaacagtagagcctgattctgaattgagaggttaataactcccaaacctcctttcaatttaggcttacaaacctttatcccaagccgctagggactttttgtttgaattcaaatctgaatccactttttgttgctccggtgcaatatatgattaggaaatggtcagaaaatgtgaagtgcactgctccaactgaatgcacttctttgattactcgcatagcaaaggggcttggggttctttctcatgatcagatagcttacatttcagcccatcgtacctatgttgatgaatcttacttagtgcaaggtcacatacttaagcatggagtagatggctctctcatattctttttcccaggttgtacaaatgaaatcccattacccaatccagggtatcatttgtacaactgtcttgagctaaccattcccctatagacgttagaggaatttcgtctaggtacgatgcatagggagccatgtaacatggcaagagaagagcatgaaggatcaacgtcctcaccaccagtgcagatgtacgaggctgactgggaatagggatgcaaggggggcaggcaagcgggtttttttagcccacttatctcacttctagttcattttttcttctaaattttgtactactatgtggaaaatgaactagcaagcgggtttttatgcgggtagcaggactacccacttgtatccctaactgggaaccaaccggagacgctcccggatggacccaagtaccacactacaatgccggaggttcagcctggtagagtgctagtgaacaccggtggcaagtgtctcaagacacatcgtatgggaactcccgttcttccagcaccagtggcatgctgcgaatctccaagatgtggcgcttcaattcctctcgaggggtcttgggagagctcactaggagaatggacgcactggagttgcaggcgggagaaatctagcacaacctcgaaggacacatggcccaaacgcaagaatggcagcgaaatgctgatgttcaattcgccaacatcaacaatttgatgcagcgacagcaagttgacctgcaggcatactttcgcttccaaggattcaacccctattagggaccctaagcgaaaagcaagcttgggggagatgcctctcccccactgaggtaacttgtatcacattgtatatttctttcatgcactgcatttataaacttgaaaacaatataaaaatttgcaaaatagaaaataccgaaaagataggctagatttgtatgctaggtaagacaacctagttctgcatgttgatatgatgaatagttgctctgttctatatctcttatgtatatgctaatagttaagtattctctcaagtttaagtaaggaaagccaaatattattcgggaacctgagagaagtaagttgcacattgcatgatctaagtctaggttgttgtgagatatgagatagtgaaatagagttactatagccttactccaaagtttgacttaaattccagataatttgtttttcaaaatgataaaattctaaagttactcatttgatatgaattccagccaatgccaaaaatgttatgcatcgttgaaaccttatacattttggttgcttgtatgcccattaaattttgtcaaactttatgacttatgtagatgctttttatactttatgatcaagatcatgcacccacatatgtgcacatgtgctaagtttctacactggaagctagcatctattccattccatcatataccatatatgtcatccactaaataagtactccatgatatttatacctctttttcaaaagaaaaataaaagaggagattggctagagagagagagagagagaaatattctctctcatattggggcatgaactctctcaaaaatattcttgagaaaaaatatatttagccaaaaagactctctcaaaagctttaaaaaatgaggaagaggtatacaaaaggagtaattatgttcatttcatttccaccatatattccaaacacgatgcacgatcttgatcttaagtatgatttgctatctgctttatctagattttttgacttagtaataaatgtgattgcaagtatgccttgttcttaatccctaacaaaccgcacatattcagctttagtgtaggagacaaaaaggcataatcttggtgaggaacaatattcatacacattgagtgatttagagaatcacttgaggaacttggttttatttgcaaaatcatttgaaaacttccggaataagagttaggcaatggatgagataattgtactctatgatctatgttgtctctcaaccacccaaggtgaagagaagcatgtgttacgacatgagattgggtgtgtgggtaagccaccatgtctacttgcttaatacgagagagagtactcaaactttgcacttgtacattctagatatataacatagtagcaactcctgatcaacaaccaagtttaatttttgtgattcctttactcgggatgaacaaaggttcaagcttggggggtttgttgacggtcattacagaccaatttcgaccatcaatacaactagaataaaggagaactagttatgcttgcaatgcatatttgttttagaataatctatttccacttgtacttggattctatctgtctgtaaataaagagatacaatatggaggagaaccgatagcaaaatactcgaacaatcaatcagatgctttcgagaatcagatttgtggagaaatgggctagaaactcataattgacatgatcaaatgggcccataatttactgatctgagtctagaagcagaagaggagacgacctgccgagtactaggctggttggcctagcccagggttcagggtttggctgaacagtaccagcaccattcaatccaggactttgatcagacggtgggaattcactcccaatgacggttggagggtattaccgacctttccaaccgccacaactgttgttcttcagctataaaaggccctcacctcctccactccttttcacactcaagcaagttcaagatatctcttctacactttagtttagtattctagtgctaagtagagtagaatagaatatctctcggagtcttcggaggaatttcggtatggctttagtagttttccttctttcttttaagactctcggagtaaatgaaatattattctttatatcctctcgatactttagtatttctgagtactgtctttgctttatatctgtatcggtacagtcgtaaagttagccgaccaaagaggtgcagtggtgtgggtttaatgtccgatactcggttactctatgacatctcgagggatgtagagtagtatttaataatgtagacgtggtgtctagattattaagtattattatctgggcatatatgctatgtgtcagtcgaggtgggcagatgatggtgacagctcagtacgggtattcctccacaatagtatatattcctaagaaactttcctggggatggtactcctccgtatttagccccggttggacaaccatgacaggttgtcggaagaaactccgcaacctggtgcccagttggacaaccatgataggttgtcggaagaaactccgcaacccggtgtggtctctcaaagcaccaggagggcactgttagggggtattggctatatggttgtatactagtaggtgtaaagtaaagttgagtgtatactagaattatagggattgattgttcttctatttctcttccacttagtttaggaaagattgaatgagatatataagtgctttgcttcatgtcactctacccaaataaatatcttaaccccatgcctagattttgattatacaagtggcatgtatacattattagcatagttatctcttacaatcttccctgggattaaagaaatacgatacctgtaatggtccagatgctatcaatccccg

SEQ ID NO: 10243 - DNA, 635 bp, Oryza sativa
  unsure (1)..(635): unsure at all n locations
gcagcgtannttgattgcatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaacccccttataaaaacccccgggatagattcccgcttaggcccccattcccccatcaagcttctctactaaggcccatggcgatcctttgggtccatccttggtcttccgccatatgccgataggggcattctcctttgcgtgtttcaacatgcgttacctctcgggttctcccatgtcttcaccataggaacttcccctctatcatattcggacttcctggccccttatggtcctcatttgggtctaattaacgcgtttctcatcttggcccccccgtttgcggatgctaccctcccataacn

SEQ ID NO: 10244 - DNA, 642 bp, Oryza sativa
  unsure (1)..(642): unsure at all n locations
tgtgcccattgaagatcgctattnnnnnnnnnnnnnnnnnnnnnnnnnnnnnnnnnnnntatattattctgcttcatatatactcaatgcgtggctctaaaatacgcgaaagagaacatactctgtcgatagctcgattagttatatcaaccacgtctgactctgaaatacgcgcacgacgaaaagaaaaaatagtatatataataatgttttaattttttttaaaaaaattgcatcttcactggcgggccacgtgtcagaactaggacagtccatatcttcgctgtcgggccacgtgtccatccacagaagccttacttcatttttcctagcgtgccacgtggcctaaaatactgagccgccagcaaagaattatcttcgctggcggccgacctaaggctaacgcaaatggagatacttctttgctggcggccgcattatgtccgtcgccagcaaagacatgtcttcgctggcggccgtcctaaggctaccgccagcgaagacatctctttggtggcgggcgttcctttctcggccgccagcgaagatgcattttggctggcggtaaataaccgctagcgaaaatcgacattttcactggcctttgctttctggcgggtgcgatttccgccagcggaaatc

SEQ ID NO: 10245 - DNA, 641 bp, Oryza sativa
  unsure (1)..(641): unsure at all n locations
ggtgtgcgttgaaattgtnatgatanacatctcnnnnnnnnnnnnnnnnnnnnnnnnnnnnnnnnnnnnncgggggcgacagctgtgatgatgctctcggcacgccccggaccatcagtggtggcctcggtgtggggaacgaggatcacgtctgcctcgcgcaagatgcgtacggttttcacggtgaccagttccgggtcgcccgggccgactcccactccgaaaagcgtgcgtgacgtggcatcgttcatgtggttctcctcaggtaccctcgcctgacggtttgttcggcaggaaccgggcagagcgtctggctgcaccgcatggggtgtctcacagtggcgggaccgctccggaatctcaccggattgctcatcgctcgatcgcatatcgagcatagccgagacgagacaccacacacacctaatgctgcggtagcgaggaacacatcaccgcaccgcataacgggttctctgtcgccgccgtggtgttcttgcacactcacagcctgaaccaggtcatctgagaacaaagtggccgagtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 10246 - DNA, 3389 bp, Oryza sativa
  unsure (1)..(3389): unsure at all n locations
naatccgcctcnnnnnnnnnnnnnnnnnnnnnnnnnnnnnnnnnnnnnnnnnnnnnnnnnnnnnnnnnnnnnnnnnnngcaataaatttttttgtctttcttcacttcaaagcccaagggcgaaaatatccccttcttcgggcgggtgaaaccaggaatgcgtagttgattctttttctactgactcttgttgttaaaaccggactcagtgtgtatgaaaatccaacatttttttctctaagtgaagaaatgtttttttaagggctcatatcacaaaaattgaacttgattaatggttattattattttttcccgttgcaacgtgtaggatcgaatcacaagaactaagctaaccagaggggggtgaatggttggtataccaaaaaccgaaaacttttagcggaaataaaagttaccctcgaaatcgacggaagtcgggctgaccgagattaatctaccggtctgaccgagtagatgccgccggtctgaccacccgtatgccgcaggtctgactgccgcgtgccgccggtttgaccgacgatagattgccggttagactgccgaaacctggtaaacacaaattgaagaactcttaaagtggatgacgactttattgattctctctgtgtttacaaagtacaccaacaacactccttacaaaaatttcgactaaactcgaaaccctaactcaaaactcaactcaattgctctccaaagcgatacagggaagcctcacgctccccctctatttatacatgaggtagcaagcctaaagcccggaaccaaactcatactaggagtcataaacaccttaggaaacccactagtacaagaaagaaactttacataaccaatcataccaaatttggactccttccaaattcgactccgcatcccatatgcacacaatacctctatcgtatgccatatggaatctccatcaaccacgtgcatcaactctagccttagtataccgcatgatctctgaccaccacgaacgtcgtcttatccccaagccgactcccggtccatcaccgcaaatactctcccgagacatcgagtcacctacacatgaaataaacaaagaaaccatattccgagaccaagctatctccaacttgactcattagtagcaaacaacagtattacaaacgtatagtatccatttagaagccataatcatgaaataaactcggatatccaaacaaacaactcgaaaccgaaaccgacagtgtgtcggccggtcagaccgcgggctgcgccgttctgactacgcattacacgccggtctgaccggctaccagagtccggtctgaccggtcacatgaaataatgaatcctgcgatcacctgtgaatccaatcatctccaaaaccacttcaggaataaattccaaataacaaaaccaataatctccaatgcccaattgttcatcgcagaataataatcaaaagcacctttgattgtacaatctcccccttgatgaacacatttgcaaacccattaaaaatgttttgatgtttggaaaaatataaacaaaagtggtaaaaagcacacttcgtacaaatatacacatcgtgctcaaaaaatccaaaagaaaacttctccccctttttaaaagaaagaaattccctcatgaaccaaaaacatgctcttctcaataacaaaattcaccttgcttctcccaaaaatccaaaaattttcacataacttttcccccttttgacaatgatttcatcaagcataggaattatgttcattaatgttcaagagcttagcatacatataacatatcaagtcatgtgttgcaataaaaagaagatgaacccatctataatataacaagcatgcattaaagtataaccatgaaccaaagattttacaatttagcttgaatcaacatcttaacaagcacataggttgaaaaataaacactaaacacatatacctattgcatttatcactctttctcaaataaactttagcacaaaataaccaagagaatatttttaactttttcttttcttgagcctttttgctcatatttttctcttttattccaggtacgtccttgttgtcaagactgtttctagggattcgatacccattattttgctcacatcgaatacgtcctcgtcgtgaagacttgtttccaaggattcggtattcatttttttcatattttttattctcttttcacaatgagcaattaaagctatttgaggaataacaattcaataaagcatatatatataaagcatttataaatcaaaccatatgctagcatcaacattgcatatttgcttaattcaagtatagaatttaagtgtcatgcatcatctcccttaaaagcaaaatctaaacctcatgaaaagactagaatacatacaagctatgctagagacaaataaaccttcaaagtattgctagcatgcacaagaaaataccatatacataaacaaagctctcttttctcaatttttttcattggcatattatttcttgataaaaccatgaggtacaaactccccctcaaatcatgccaaaatgatgaattatgcccaattcaccacgaagaaaagcaaagcgattagaatccaaaggtttagtgaaaatatcagcaatttgcaactttgtgtccaaaaactgcaattcaacatctcccttctcaacataatccctcaaaaagtgaaaacgaatatcaatgtgctttgtgcgtgagtgttaaacaggattcttagcaatgttaatagcactagtattatcacaaaagagaggtagtttctcaaaagtaagaccataatctttcaaagtagataaaagccaaagaatctgtgaacaacaactagcagcagcaacatattcagattcagcagttgattgatcaacactagattgtttcctagaaaaccatgcaatcaatgatgtaccaagaaaatgacatgttccactagtacttttcctctcaattctacaaccaccaaaatcagcatcggaatatccacttaagcatatagaagatgaagtagaatatcaaattccaaactcaagtgtatgattcaaatacctcattagtcacttgaccgcttgacaatgtgaagcacgaggagaagtttgaaagcgtgcgcacaaacacacaggaaattgtatgtctgccctagaagcagttagatacaacaaagatccaatcatacttctatattccttttgatcaacaacttcaccatcttcatcaggatccaacacagctgtagaaccaattggtgttgaaattggcttgcaattctccatcttaaactatctcaaaagatccttcgtatacttcgtttgatgcacaaaagtaccttgaggagtttgcttaatttgcaatcccaaaaagtacgataactt

SEQ ID NO: 10247 - DNA, 1236 bp, Oryza sativa
  unsure (1)..(1236): unsure at all n locations
ccctcgagaaccgaaacgggtgtttttccaaaaacaacttttttttttagaacccggtccaaaaatggcaagaggttaaaagccaactgtttccaagatttcaatttaaggcgggttacccctttccggataggttgncaattttggtacaaaaaccacaacgggattgccacacttagaggggtccttaaccgtgagccggtcactttatacaaaaattgtccgacaatgtggcgtttatggccaaagacttgtactntaggttgaccggttttgatcatctcgggagagtagtatttcaggaggccttctaacaagaacacaagtacctcagctcggacgtggcttgtctgnggcactcatgtccggtctaacgtaggtgtncgcagtctgacgggctggcgcttgtttgccgggcctagcgaacttgtagcggtcgttgtcgtcgctctcgtcttggaaaaacgaccatcctccccgtgaacatgtgacagtgtacgtgaaatatcgggtgtagtacatgcactagcctcatcaaaagaaacttcgcaagtctcaacgattttgttagtctcaaaaataagtacacgatagccacgagtgtgtggggggtaaccaagaaacaatccatctgtagaacgtgcctcaaacttattcaaatttccagatttcaagacaaagcatttgcatcaaaaaatgcgcaaatgtgatactttgggttgatgtccaaatcgaagttcataagaagtttttccaagtttagatctcaagaaaactcgatttgaaatataacaagcagtgttgatagcctcagcccaaaattttcttggagttttatattcatccaacatcgttctagccatctcaaccaaaacacggtttttcctttcaacaacaccgttttgttgaggaacacgaggagaagaaaattcatgttcaagacctctttcgttgcaaaattgttcaaatgaagcatttttaaactcaccaccattatcacttcgaattcttttcaaagaaccaggaaattcaagatccaatcgatgaaacaaaccacgaaagtgttgaaaagcttcgtccttagttgccataaagaaaacccaagaatatcgagaaaaatcatcatcaataaccaacacatacccctttctttcaacagattgcactctagctggactaatagtgtccatttgtaatagctgggtgcgaaggagaaactcatcaaaanggacgtcg

SEQ ID NO: 10248 - DNA, 885 bp, Oryza sativa
  unsure (1)..(885): unsure at all n locations
agatgttttgattatctaannnnnnnnnnnnnnnnnnnnnnnnnnnnnnnnnnnnnnnnnnnnnnntgtggcacgtggttacacgtgaggaagatgtgtcttgtgggtaaagatgtacacctctaatcagagtataatctattcgaatagccgcgccctcggttatgggcaagccgagtaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcatgtgggttcacggccttgataaataatattgcatagttctagaatcgtgtttacaaaatagctttgagcaactaagcatctttaaatgctgtttactgcaaccctaaccctttatattataacccccttgtactcccttgcatttattatgcacttgtgggtgtgtcttgttgagtacggtggttgtactcagtcttgctcaatttttcccaacccagaagaggagcccctggatgatgaaggctttggtgtctagctcgtgcctgccgtcaagcgcctgtggtcgtcgccctagtcttccgctgtttctcggttgtctttgtgtgtgctgggccttcgtcggccatgtaataaattatctatttacgctttcgcttggtgaactctgaattggatcaacttttggtgtaccctgccttctgtgacaaagaattatgcacgcacttanggaacgcccgtgggttattttcgcgtcgtgaaaagtggtattaaaagcccctttgacctaggatgagctggagattcccaagccttaacaatatttttcaaaaan

SEQ ID NO: 10249 - DNA, 1585 bp, Oryza sativa
  unsure (1)..(1585): unsure at all n locations
naaaaataggcgaaaaaagatcgatcggccgaaaacgtttaagtgttggtgaagaagacgagggcgcaccgggaatatatatacccctggatctttactcccgattgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaagattaatgacaattacttcgaaaaattatttttgtctgtaataaattaagtggataaatcgtaataagcaaataaaattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgatagggggttgcccatccaactgaaagggggttgcccatccaactgaccgtaatcctcgtcagtcttgtcctcaactccgacgattttttttttgcctgggagaaccacttgacgcttaggcttatcaggccctctgcccttttttcctttgtagacatgtccttcacgaaaaagacttgcgttacatcattggcaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcaccgtaatacgtggcagttgttccntcgtgtcccttgggtgcagagtgtcatctaacngncacac

SEQ ID NO: 10250 - DNA, 2260 bp, Oryza sativa
  unsure (1)..(2260): unsure at all n locations
nttaaaatgtggacccattgttctcatatcccctggaatgtcgcgatcgacccaacgggtccccctcgccagaaaggcaagttgttgtttgatcgactcgttacccataagatgttgtcgtagccacgcggggaaagtatcaatgtgatgccgtgtagtccatgcatcggacttaccgatgttcctggcgcgaactagagccaagtgctcctcgatgtaagaagctaccaatgaagagtgttgcagaacagtgaaatgggctttacggaataaattgttgtgtaccgtcgttattgctttccttccgagagttccctttccccgtagtctctcttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttgtgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacgatacctttatgctctccaagcattcaaacatactttccttctctgccttgctaagagtgtagctggctggactcaagtaatggctttctttctcctttggttccgggtgaaggtcgccgcgttgttccatatgcttcagatcgttacgtgcttccagtgtatctttcgacattccgtatacacctaggaagccaagaaggtttatgcaaaggttcttagtgaggtgcatcacgtcgattgcgtggcgtacgtccaagaattcccaatatggtaactcccaaaatatagagttctttttccacatcgccacgtgaccatcttcgctctctatatgctggcttccaggcccctttccgaacactactttaagatctttaaccatatcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtacctcttgttggactgtccggataggttgctaagtgcaggccaatcgttgatggttacgaacagcagcgctcgtaggttaaactcctcctgtttgtcctcgtcccacacggggacaccttcttttttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttacctgcccgtcaacttctcctggatcgtcccgtctaatcttgtatcgtagtgctttgcaaacagggcatgcttttaggttttcatactcctcaccgcgatataggatacaatcgttcggacattcgctgacgggtggggcccacccatcatccccttcctaacgccgctcccgccgcctcgcccgtgccctagcgccgccgccgccgcaaatcccgccgctcccgtccgccccacgtgcnntcnggagggtncgaagtagcagtcaacaccct

SEQ ID NO: 10251 - DNA, 2703 bp, Oryza sativa
gttaagaaccagtggaaagagttgaaagaaaaggggtatatacgtctgagtacttccccctggggtgttcctgtgatttttgtggagaagaaagacaagacaaagaggatgtgcgttgactacagagctctcaatgaagtcaccatcaaaaacaagtaccctcttccccggatcgatgatctgttcgatcagcttaaaggtgccacggtattctccaagattgatcttcgttctggatatcaccagttgcgcatccgtgaagaagatattccgaagaccgcattcaccattcgatacggactgtatgaattcacggtgatgtcgttcggtttaaccaatgctcctgccttcttcatgaacttaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgagttctggttgtccgaagtcaccgattggaagcaacccaagacagtcactcaaattcgcagtttcttaggtttggcaggatactaccggaggttcatcgagaacttctccaaaatcactcgacccatgacacagttgttgaagaaagaggagaaatttgtgtggagcccgcaatgcgagaaggcgttcaaaactctcaaagaaaagctggtttcctcgccagtgttaatcttgctggatactcgcaaggacttcatggtgtattgtgacgcttcgcgccaaggattgggcgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtcgccgacgctctaagtcgaaaaagccattgcaacactcttaacgtccgtggcattccacccgaacttaatcaacagatggaagccctgaatctaagcatagtgggtcgcggattcttggctgcgttggaagccaagcccaccttgctcgatcaaatccgcgaggctcagaagaacgatccggacatgcatggactcctcaagaatatgaaacagggtaaagccactggtttcacagaggatgaacacggaaccctatggaacggaaatcgggtatgcgttccagataacagagaacttaaacagctgatacttcaggaagctcacgaaagcccttattccatccaccctggcagtacgaagatgtacttagacttgaaggagaaatactggtgggttagtatgaagcgggaaattgtagagttcgtggccctttatgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaaggccacctatggagggaacaaactagctgagctctactttgctaggatcgtgagtctccatggcgttcctaagaaaattgtatccgataggggaagccaattcacctctcacttttggaagaagctccaagaagagctgggcacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcattgtatgggcgcaaatgtcggacaccactattgtgggaccaagttggggaaagccaagtgttcgggaccgatatcctgagagaagctaaagctaaagtcagaaccattcgggataatctaaaggtggcccagtctcggcagaagagttatgcagacaaccgacgccgtgacctagaattcgcagtggatgactttgtgtatcttcgggtcacgcccctgcgaggtgtacacaggtttcagacaaaggggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgaatgaccaggaaccgggtaattcgtttttttaaggtccacttgagcaaccacgccgagaagaagctactttggagggtgaagactaactttagggcagccaaacccattttttacgctagtcttttcaatttgggggtacagattcttttaaact

SEQ ID NO: 10252 - DNA, 1320 bp, Oryza sativa
  unsure (1)..(1320): unsure at all n locations
ggtgtcntttgatagcgatcttgtacccgatgagaacaaccgagagtaaatttactcccggttgttctcatcaaccgggactaaagatattttcccgctatttccaaattctttttaaacccggttagggttaagaactgggactattgataagcgcactgaatattaatttccattacatatgtgtttctaaaatagaaaataatgcattaaaattatttaaagtcgaaaaattaatgacaattacttcgaaaaattattgttgtctgtagtaaattaagtggacaaaacgtaataaccaaatatatgatttaaaattaatataaattctaataatcatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaattaataaaaatttgaataatcatatataattagcatatgaatgatattaaattaattgttaaaaactctaattaacatatgtaaatgccacatgcataatttaaacttttaaaaattctaattatcgcatataactagcaattacatgatttaaaattgttaaaacctctaataaccgtacgtaattaacatatgccatacaacaattgatttatatggataatcaatacatccaaaatagtttacatcgtgtacacaataattacggcaatatatcggctgtgatggttgaccgcacgtactttctcctcactattgttccctccttgtgatcgctacgtgagtaaggggtgtctttatttgataggagtatgctagggtcaatcgtcaccgtgaaagggggttgcccatccaactgatcgtaatcctcgtcagtcttgtcctcaactccaacgatttttcttttgcctgggagaaccacgtgacgcttcggctcgtcaggccctctgcccttctttcttttgctagacatgtccttcacgtaaaagacttgcgttacatcattggcaaggacaaaaaggtcgtccgagtatccaaccttgttaaggtcaaccgttgtcatcccactgtcatcaatcattatgcctccactagtcaacctaacccattggcatcggaacagagggaccttgagaggaccatagtcaagttcccatatgtcctcgatggcaccgtaatacgtggggtaccgagctcgaattaggtcgatagtgcacggctattctaccggg

SEQ ID NO: 10253 - DNA, 13171 bp, Oryza sativa
  unsure (1)..(13171): unsure at all n locations
cgatgggctttgtttgactaagaacctncagnctgcangcccgcaggncgactctagaggatccccttttgggtcgtactcttcatgtcttgggctctcgtgtagaatgtgtacccattgatctcatatccctggaatgtcgcgatcgagatgttgtcatagccacacggggaaagtatcaatgtgatgccgtgtaatccatgcatcagacttaccgattattctggtgcgaactagagccaaattctcctcgatgtaaggagctaccaatgaagattgttgcagaaccgcgaaatgggctttacggaataaattgttgtctaccgtcattattgctttccttccgagagttccctttccccgtagtctccctttatggcgtgattcaggtaccctgattaggcgaaggtcttcaataaattctacgcaaaattcgatgacctcctctgttccataccctttggcgatgcttgcctctagacgagaacggttacgaacatactttttcataacgcccatgtacctctcgaaaggaaacatgttgtgtaggtatacaggcccgagaatactgatctctttgacaaggtgacaaagcagatgcgtcattatattgaaaaatgaaggtggaaatatcaactcaaaactgacaagacattgcagcacatcattctgaagggcttctaatctatccggatcgatgaccttctgcgaaattgcgttcatgaatgcacatagctttgttattgttgcccggacattgtctggaaggataccccttattacaattggtagcagttgtgtcatcaacacgtgacagtcatgagactttaggtttgtgaacttcttctccttcgtgcttattattcgcttgatattcgtggagtatctagacagtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccatatacacctaggaaaccaagaaggtttacgcaaaggtcttagtgaggtgcatcacgtcaattgtgtggcggacatccaagaattcccaataggataactcccaaaatatagagttctttttccacatcgccgcgtgaccatcttcgctctctataggctggcttccaggccccttttcgaacattactttaagatctttaaccatatcaaacactgttttcctgctgcgatgtttaggcttcgtacggtggtctgccttatgttcaaagtgcttgcctttcttccgtaccgggtggtttgcagcaaggaatcgacgatgacacatgtacacaaccttcctacagtgcttaagatacgtactttctgtttcatccatacagtgaatgcaagccttgtaccccttgttggactgaccggaaaggttgctaagtgcaggccaatcgttgatggttacgaacaacagcgctagtaggttaaactcctcttgtttgtcctcgtcccacatggggacacctttctttttccacaatagtttaagatcttcgaccagtggtcttaggtacacatcgatgtcgttaccaggttgcttgaagccttgaataataatcggcatcattatgtacttcctcttcatgcatagccaggggggaggttgtagatacacatcgtaacgggccaagtgctatggccgctgctcatctctccaaaacgattcatgccatccgtacttaatccaaaccgtatgtttcgtgcgtcctttccaaagtctttaaattttctgtcgatgtttcgccactgcgaatcatcggcggggtgtctcagcatcccgtcctgttgacgctcttcagcatgccatcgtatcattctagcattccccttgttcctgaacaaacgccttagccgtggtattatagggaaataccacatcaccttagcaggaattctcttctttctcctggatcgtctcgtctaatcttgtatcgtagtgctttgcaaacagggcatgcttctaggttctcgtactcctcaccgcgatataggatacaatcattcggacatgtgtgaatcttctgaacttccagtcctagagggcagactattttcttagcctcgtatgttgtctcgggcaatttgtttccctccggaagaatgttcttgacgagtttcaataaatcgccaaatgccttgtcactaacaccatttttttccttccattgcaagaactccagagtggtatccaactttttgtgccctgctcgcaacctgggtacaacgacgttctgtggtcctctaacatcttgtccaatttatgggctcccttttcactttcgcagtcctccttggcgtcctacaacatctgaacaagatcatccgcaacgtcgttaccatcagtatccctttcctcctcaccggtttgatttccttcaaatccaatgtactgagcaaagtccagaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttatgcctgttagcttcggccactctcaaaaaataatgcacgccgtcaataaactcttttgaccgccggtcagcatacatccattgccgatccatctacatgacatgaaaaaaaatcgtacacaaataattattcttacaataatgacggtcatacaataattataaaataattacaaactctttcaacagtcatacaatagatgacatatcattatgcatacaaaaattataaaatattacaccaaataattcttatttactatttctaaagtttcaaactaatattaatgtgttgtacttcttttaattttcattttagtttgttttctattatttaagattaactttcactatattttccttctcaactattttataaaaccttctttagcaaataatctaaatttctatatattctttcttccccccacacaaattttctctctcatcaacttacaactaaattttggagacataaaagtgtgcaaaacatagctccaaatgtaatatgacaaaaaaaacattggaggatgaagttgctaaccttttaggcacctctgatttatatataatcaccaaaataaattcacaagaaattttggcatgacctcccctcttttttgaagaaattttgaagcttgctcgggcagctggaggaggaagaagacatatatatataggggtgggactttagtcccgggtggtgttatgaatcgaggctaaagattgccgagatctttagtcccggttggtaaccaaccgggactaaagttacgatctttagatcccgggggggggggagggggctgacaaaccctgatagcatttgaaccgcatcttaccaaccgggactaaagaccaaatatgcccgttaccctttttaaccgggactaaagatcatctttagctccggtttttattgcaaccgggactattatggaattcggccgaccgacaaaaaatggtttctccaccagtgtgatctatgccttaatgtggatcttgggtatggcagtcgaagcatctgctcaattcatcaagctggctcccttttttttttgtctgacgataggtactggttctaaaaccggcatctatcacatggctcattaattagtgccgcttgtgtgacgccggttacagaaaccggcacctatgcaggcttacaaactggaagtaatctatgtttctgtagtagctagttctattttcagcccaataaacgtgaactaaagggctctcacagcttccgcccacctaaattggaaacactgatatgtgtttgtgcattgcttacacttctgctcataaaatacactctttttactgattttttaatctggtagcatgaaaacttaccagcatgatcatacatgttcaagcataagaaatcgagaattcagagaacctttcagctcttacaaaattatttaaataagaaaaattagattgtacataactctataaggatataattctggaaatttgctcagaaaccaaaacgtacttataaatatcaaggattaaatttccgcacaaagtgaaatattcaacagatcacactaaacgatatccctacatacactctacacaattatacaacagaaacaattactttttgaaaaaaaaaatccttgtgtcacattatatataagttcatcaatttttttgatgttatacaattaattttctcctttttctatttaatttatcacaaacaaaaacatgatattatcggtgtatttagttttcttaatgagcttacaaaactatactagcaaggtagcatttacatgcaaaatattgtgaaattttgcataataatttgtctgcactttcgttaaaccccatcaaggtagactgatatcgtcgagtatatcgaaatattgtcccaatatccaaattggaatggccttccagccatactggaattgacaagcttaattaatctgtagagttaattaaatccagaagatacaccccatgttgctgtagtaacctatatgaaagaaaacaaaaaaaattgagcaaatgcctataattaagccgtaggctataatcggtttgccacacatactgattataagccgtacatgttattataatctgtaggtgaaacttttatttatatgtctttattgatttaaaagctaatactaaaagcaagctctataaaaaaaattaaaaccaacttcaaaatttaatttgaaaattcaaaatttgcagacacttataagctatgtaaggcaaaatattgtaggaaaaaagagcgggattgtgggaaccatacatatgaaatctactggcttggctttttcttgataatatgctctcacgcatgatgtcgtcatttatacacttgtgcttgtttaccagagaactacaaatagtgggtgacaattaagtatacgataaccaactaaagatagcataataggctttgatgatctattgcataaattgtccccatctttcttatatggataacaaaatagaccgttattctcgcctttaatgggcattgacaccattgttgaatttggctgtgggaaaacccactagttttccgttctttttcggacatgtaatgcaatacgcattacgtacccattagtcatatttatttgacgttggtagctagtattaaatttacaaatataagcacatgcgatacagttacacggcatgggcagtcgatgcaaactagctgagtgaatatgtacgtgcacttcaacaattcaactggaagtggctaagagaggatggaaaaagtctgaaatattctctcgaacatttctttttatagaaataactgtttcacagaatatgggtactgcattgcgtggctcatgactcatcagagatatggaccaaaatgacatagacaaattggtcctctcgaatggggcccataacatcaaacacggaggtgcagctagcgggcccacattgatgcgggacagtgccgaccaggtggcgtctctctcgagtcttgacctagctatttcatcgcaaacgtcaccaccgactgaaaccagatcaaacctacgcgcccctatagttgtttttttattgacagccagtatacataattgaatgttttaaattaaaaagagcctatatcttgttctaactcactattatacctgttcatcttgctaggttcaagcccttgaagagtttctttcttcagaatcggcagcctttattttattccatcgaccatcgagggccttcctgatttctcgaggataagatagcatggtacttacatataaccgatcattgtccaacccccaaaatgtgatgactgatgacttgatatttgttaataatttggtgtttagcagacaatctgattactttctaatcacaagtctataattggtcccacagttggtctatgagtccgtacatccatggcgcatatgcattcctttggaatttatattttataatttgtagtattacagttgatttacattttctcgaaggcatacaataattcagatatacgtttgtatgttttcattcacgttagaccatgtcgtattactacctccgtcctaaaatatagctatttctagcacagtgtcttgtcctaaaatgaagctatttctccacctacctcctcctctcaaccaatcacaaccattattctttgtctattttctcttttcaaccaatcacatactttctctaatcattctcacatactttcttaatacccgtataacctaaaaaataactatattttgagatggaggaagtatctatttaagatctgttgcaatgcacggacacctgagtagaagaaacacaagctttaaaactaatgtatgttggacttagatagcttntcaacagactctagcagntacatctgccatatctaaatgcaaagggatatgtgtcattaacaggtcagaagcatgcatggttaatattcctgaaatcatcaaatctttaatttttctaaacgccaaactgcgcacccctgaaagctctattgttcagctggagttgcttattgcgattcatagtccactcatcatcatagggaatgttacgtaggacctcaaacatcattgacttgatgtgttcaacacatagtacatggaaaaattaacatgcgatgtgtcgcctctatactcgatctaaatctgaccaccttcaacacattcatgaacgaagtgatactttctgttgatgtgtttgctccggccatgaaatatcggattcctctttcttcctcactccgaacatgatcttgggtatcggttcatctttgccggttcatggttcctttatgaaccgatagtgacgaagctccatcaccgccgattcacaattgttatgcagtgagagtagctcgatctatctatatatagagccaaattattaattatgcaaacgaactaaagatagctgaatagagtacaatactccctctatactcgtaaaggaagtcgttttggacagcgacacggtctccaaaacacaactttaacttcttgtttctataaaaaaatttattgaaaaatgatatatgtatacttttatgaaagtatttttcaagacaaatctattcatataatttttacattttcaaactcaacaacttgagagttatttatgatttatatttctaaggtttgacttaaacattgtccaaaacgacttcctttacgagtacggagggagtatatcgcatgagagttaactgtatcactaccgtggatatgcaaataaccacaggctagaccgtcgttcttgcgtttaatgggcattgacaccattattgtctaagagtttggggcataggaaaacccgctaattccactctttccgagacatgccatgcaataatcaccatgtgctccaagctaagtacgcgcaggagctcggcttatatatacatcagcaaattcatgcagtatgcattatgcagtgacaaccaatcagcttggctgcatcacttcaaaatattggttcggacatctaataaagttgtaaacaagataaatttgttcggaaaaaaaatgtaagctgccactaatgatatatttgttcgggctagtactagtatttcatatatgggccagaaagtcagacggacaggtgcgggcccagttgtcagacagaagtgcaggcccagttgatccgcggtgtgttggactccagtaggagcagccgacctagggctacgcggctgtagctatctatctcatcgggggatgcgtgcaacgccgccaccgacagacacaccgcgtgttctggacgctgcccttggagaggagatggagcccgcaaatccgccgattccgccgccgccgccgccgccaccgcctaccaggaagcctaccaggaagaggggaaggggggcgacgaagggcgacgacccggtcccggatgaagcagcaccaccatgcaagccgtcgctgcctctggccacggggagcagaagggggcgcagccatgtacctccgccactcggagttggaggagacggcggcgaggagggcgtcgacttcgtcagccacctccctgacgccgttcttggcatcatcatctcgctcctcccgagcaaggacggcggtaagaccagaaccctctccaaacggtggcgccctgtctagcgcaccacgccgctcaacctcgaagccagcgatctcgcccccggcgccaacggggcggcgctagccgtcctcctcacccatatactcctcgctcatgcggggcccgtacgccgcttttgcatccccgcgcagcagatccacgagcgccccgccatggtcgaaggctggctgacatcgccaaggttcaacaacctcgaggagctcgagttcacggaagacctctgctatatgagacaactccttccgctgccgccatccattttccgcttctccaacaccctccgcgtcgctgccttcagccaatgccgcgtccctgattgcaccgacctgatgctccagttcccccatctcaagctgctctcattacggcaggtgaaaatctccgaaacctccctccatagcatcatcgccggctgccctgcccttgaaaggtttgctgctcagaaatagctacggattccgatgcctccggatcaactcccctaccattagaggcgtcgccttccattctccctactgtgggagtcacggcgatggagaggtgggttatcacttagaaaatgttatcatcgaatttgctccatgtcttgaaaagttgctccatattgaacgctcgatgggacttggagttcgtgtatccgtgattatggcacccaaactggagacattgggcatcctagacaacgttaacgatgtctattcccgactcaatttcggcacagtggttttcaaggtataatatatgtatatgtagttgtggcttccattatccctataaccccctagcaatttattgggattaattacaagctgcattttacattaatttctatgtgcgtatattgttaataatatgtggtgttagagtatagctatgtacgtccagtccattgtcttagagttctctctagatgatattaggctgatttagacaacatcattgagcatataatcattcgttcttcatgtcactgttctaaagactatggcatactaactagattatcgcttaagtttacaggatagcaagctcttgcacactatgattttgtttggttgtgtgcatcctcagtagatgtagcggctggatataatttttttacttgattagatatccattatctactcccgccatcccaaaatacgtttagacatcacctatagtactacaaatctgcagaaaccctacctagatttgaagttttaagttggtgtctaatcgtagtagtaggtagctatatttttagactgggggagtagaaaatatgatcgacatgtcctaatgttatgttccgtacttaataaagggattcgaggttgttaacttcacaaggccagtgtcgagtgtaaaggttttagctctcatcatggataatctcagcttggacagggttatcaagttaatgatatgctttccatgcttggagaaactgtacatcagggtaaaatacttttcttttcaagtactgtgttgccatacttcttttgttagtttacataatcagaaggtatttaatctattattccccaatttttttttcaggggatcaaatatggggaaactaattactggcgccgcaaatatgggaaaactatcaaaagccttaacatatgtctcaagactattgtgctggatgattatcgtggctcgaagccgcaagttcagttcgccagattcttcatatggaatgcggctaagcttgagaatatgatatttatgagtggacctaacaacgacaacacatatgttattgcagaacagcctaagctgctggagtttgagaaaagggcttcaaaaactgctcactttcattttagatccaagaaatgttattatgattgggtgcatatcaaggatgtccatgatttgtctctttcagatccttttgaatgtacctgttgagactgatgggtgaaattcttgtaccttttcaatattcgagctaggcaagaggactttgcggaggtgctctgttcgaatttaagactgatggatgttgtcactgagctgaagaactatattgatcatgttgaagatttatcttaattactgtacctttggatgtttatgaagaaaaggattgatgtattgggctgttgtttctcagataccattgcatgtgtgttgttccattttttgctgtaacagtactggttaataaaattgttgtagcagtcatattttttgattttttttctatcctcaatatttttttacacactagaaaagtgcctgtgcttttcaacgggtaaactaaatcatggcacattttatgtgcagtattcgagcgttatgagttgtgaaattgacacatatcactggtggagaaaccctttgtagtcccggttcgtaacccccctttagtcccggtttccaaaccgggagtaccaatccgggactaaagatcgctatctttagtcccgggtgaaataaccgggagtaaagatcgctatcttagccacgtggccggctgagccatcttaccaaccgggactaaagatcgagctgacctttttttttttttgcatgcccctgttgctgcatggtttatatatatatatatatatatatatatataaaccatgcatatatatgtttcaatacatatatatgcatacatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattataatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccaccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtatacttatatacaaggacctaattaattaaaggagacgtatagtaagaaatctaactgaacgatatacttacaaaatccagtaactcataatagagacgtcgagggcgtccagctggtatagttcgtagattcccctgaaattgatccagagaatgtcatctccttgcaagaagtcagtgtccttgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccagtgtcagtaataaattgttctatcgtcatttctttaccggtcaccaacggctcgatctcctggtttggttgctctccaagctgagggactggtttggactttccagaagatgctttcttcagcgttcgctcatagtctgatagcttgatggcctccttgacagatgcagacatacccctgaagaagttcctgacactagggtctataggaatcttcttttctggacttcgaggcttgaattgtctcttgacttttgatgcaacgtaagcgtcaagctcctcttgcgtgcaatcgtaccccgggtccttgttcttggcggcgtcaactttcgcctttttcgttgcccttgtgtgggcagacggtgtagttggagggcccttgactttgaaggtgccgaaagaggagcttgcgggggagtaggtgtaggagcacgaggaggagtcggtccaggatcctgaggaggagtagatgctggagcctgaggtgaagacggtgctggggaagcatgaggagaacccggtgcaggatcctaacagtanatgncgnagcgntgnagagtgttatcaagtnntcaataggtntcactgtgcgcca

SEQ ID NO: 10254 - DNA, 2788 bp, Oryza sativa
  unsure (1)..(2788): unsure at all n locations
ggggcnaattgagatgctcatcttgtcnnnnnnnnnnnnnnnnnnnnnnnnnnnnnnnaggagatggtgcatgagacgccgcttgttgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggataatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaactttgattgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccaaatttgggacaaagctctcatgatctccgcgtgcccttgttctgcgccagtacaccgtactgataggcacgttatcccgcacaacccaaccgctgtgtcgtacgtagttcttggctgcttccgccggggcactaggttgtctgacttcgtccacttccgttatgatgtgccgaccctctagcttctttgcggcacctcattgcccgcgtgccctcttctgtccagcggagggttgacttccactagcctcctcctcctggttcccctccacatccctctccacgttcccctcctggttcccctccgcatccttcttcacgttcccttcctcgttcaagtactggtttggatcctcattcccctcttcttcgttccagtactggctgcttccctccgcgattgtatcgtacaatatctgttcctcatcgcgatcagccatctgttcatacaagaaatagttgctaagtctataggtcatttttgctttaacaatcttatatgctaacaatcatatatgctaagtctaactgtcgtatattagaaccctacacaatcttatatgctaagtctaattacaaatctaataatcttatattaaaactataataatcttatactaaaactcaaatagtattgtattaaaactgtaatagtcaactatgctaagtctaagtgtcgtgtattaggaccctagacaataattatatactaagtctaattacaaatctaataatcttatattaaaactcaaataatcttgtattagaactctaataatcttatattaaaactcaaatagtcatatatgctaagtctaactgtcgtatattagaaccctacacaatcttatgtgctaagtctaattacaaatctaataatcttatattaaaaatataataatcttatattaaaactcaaataatattgtattaaaactctaattatgttgctaagtctaagtgtcgtatattaaatctaatagtcttaattgcattaaaaatctaacaatcatatatttacatcacttgcctgcgcgaattccttcgagggctagcgaccactccggcttgagggacgacgacgacaacgacttttctgcaacatacaaaaagatgtattaggataaacgcaaagtaacatatattgtatttcacgttcgcattctcgttaagttcacgtttcgttcatgatcgttcacgttcgcgttgtcattaagttcacgtttcattcacctacgttcgttcgttcccgtgagttcatgttaacgtacgttaagtaatgttcgcgttcttgttaagttcacttttcattcacgcacgttcgtgcgtttatgtatgttcacatacaacgttaagttcacgttcacattaggttcacgnnnnnnnnnnnnnnnnnnnnnnnnnnnnnnnnnnnnnnncatcaatctctcg

SEQ ID NO: 10255 - DNA, 644 bp, Oryza sativa
  unsure (1)..(644): unsure at all n locations
tggggcgcccatgantttcatanncnattgatnaccgtggtcggaacccccaagctccatcgcctgcccccacaagggcaacgaagaaggcgaaagttgacgccgccaagaacaaggacccggggtacgattgcacgcaagaggagcttgacgcttatgtggcatcggaagttaggagacaattgaagcctcgaagtccagaaaagaagattcctatagacccgagtgtcaggaacttcttcaggggtatgtctgcacgtgccaaggaggccataaagctatcggactatgagcgaacactcaagaaagcatcttctggaaagtccaaactagtccctcagcttggagagcaaccaaaccaggagatcgagccgttggtgactggtgaagattttggaatagaaaaatttattactgacaccgggctaactacggatcaattgctacgaggcgcaccaatcgaaaaggcggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10256 - DNA, 1576 bp, Oryza sativa
  unsure (1)..(1576): unsure at all n locations
ggcgacgggaaacgccggaatttccgacggccacgaaattagggcacgatcaaggcggcgaaaacgccggaagaaaggggataccgggtgggccccaccagtcagcgagggtggcggacggccccccccatcagcggcgcgcctggaaagtagaccaaatggcccgggggggagaggagagagaggaaaagaaatggtccgaaccggcccaagagggggaggggggaaaaagactttttagagcttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggagactttcacacggattttaattattctaggcataatttcgaggatgtattttagagttgttttcggacgcgacaaacctacccccttaaacggaatctcgaccccgagattcggaagaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggccaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcaccgagcaatgatacggaaaggacccacgaaccgaggtgcgagctttccctttgtctgaaacctgtgtacacccgcaggggcgtgacccgaagatacacaaagtcatccactgcgaattccaggtcacggcgtcggttgtctgcataaattttctgccgagactgggccacctttagattatcccgaatggttctgactttagctttagcttctctcaagatatcagtcccgaacacttggcttttcccaacttggtcccacaatagcaatgtcccgcatttcattcataccacgcttcataggtgccattngtttgctggcttggagctggtattgaagaaactcggatatggggactttattccagtttttccgaattttagcacttgcccgaagatatntttaggatttgattagacgctcggcttgtcatatgctgtgggtgaacctggtgctgaaattaaatcgggaccaccttttttgtagtttttcacaagggaagggaatggttccccattaaaacaatattttgggaccgccgggactcccaacctcccaaaaaaccgcgtgtttgtcctccaaggggcttcaagaaaaacggctcctggttttccccacacaccctttaagttccccttgtgttgaaaccggagaaacccccactttccctcctcttgcttggagaggaaaaccgcggttggtgtttttttccctgcacataaagggcgaccttttttct

SEQ ID NO: 10257 - DNA, 6308 bp, Oryza sativa
  unsure (1)..(6308): unsure at all n locations
cagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttagcagtcaaagacgaaagatacaaacgaaatgcctaagcataaaatcgacgaaggtgttcaatattccaagaattgttgatgagagtaccatcttcgcgcttgagtcgataagaacctggccgagtgacttcggcaattatgaacggtccttcccataagggagataatttacgccgatcctgtgtggtttgaattttcctcagaaccaggtcgccgactaaaaaggctcacgatcgaacattccgattatgataacggcgcaacccttgcaaatatcgagtcgactgaattaaagctacttctcgggcttcttctagtcgattgatgtcgtcaactcggccctcttcatagtcctcctcgttgaagttccgaaatcgtagtgattcaaattccacttcactcggcaacattgcttctgcaccataaaccaaaaagaacggcgactggccgatagcccgactggaagtagtgcgtaaagaccaaagtacggacggcagctgatctacccacttgccaacatagggacgcagtcagtcaaaaatgcgtgctttgatcccttgaagtatcatgccgttagcgtgctcgacttgtccgttactcatggggtgtgccacggaggcgtaacaaattttaatgccaaagtcttcacaaaagtctctaaatgctccgccagtgaattgagtgccattatcagtgatgatccgattaggttccccaaaccgatgcacaatgttgatgaaaaaatctctagctttatttgccgtgatcgtgatgaccggtttagcctcaatccacttggagaatttgtcgatagccacaaagagatgcgtgtaaccgccgactgcccttttaaacgggccgaccatgtcaagcccccagaccgcaaacggccaggacaacgggatagtttgcaactcttgggctggcagatgaatttgtctggcaaaaaattgacaaccttcgcatgtccgcacaatcttgtcagcatcagacacagctgtaggccagaaaaaaccttgccggtaagctttgccgacaatagtccgtgcagcagcatgattaccacaaataccagaatgtatatccttcaacaattgtctcccttcttccaaaaatacgcagcgctgcagtattcctgatggacttttcttgtacaactcagtcttatgaataatgtaaagtctgctgcgcctggaaatccgctcggcttcatttttgtcttgagggagttcttgtttggtcaaaaattttataagaggttctctccagtcggtttcaatcatgcttacgccttgagtatccatggcttcaagtgtttcttttctgggcacggttggttcataaagatgttcgacgaacacatctgaaggagctgcttcccgttttgaaccaaaattggccagcctgtcggcagcctcattgttatgtcggaggacatgggtgagctcgagtccatcgaatttatcttccaacttgcgtacctcttgtcgataagcagtcatattatcatctagacaagaccactctttcatgacttgattaacaaccaactgagagtctccacggacgattagtcagtgaatgcctagagagattgcaatccttaatccatggagtagcgcctcgtattccgccacgttatgggacacagaaaaatgtatccacaatacgtagctcaatctttctccagtcggggaaatcaagacgaccccagctccagtgcctgtaagcctcttcgacccatcaaaatgcatagtccaatgttccatcttttcctctggcatgtcttcttggcactcggtccactcggcaaggaaatcagctaacgcttgtgacttgatcgaagttcgtggcttgaacgatatgtccaaagacatcaactttaaggcccacttcgcaatccgtccatttgcttcgcgattatgaagtatatctccgagtggaaacgatgtgaccaccgtgaccgagtgactttgaaaatagtgagataacttcctgacggtaattaagacaccatataataacttttgaacctgaggatatcttgtcttggagtcgactaaaacctcgctaacaaaataaattggacgttggactttttgaatatggtcttcctcttcacgctcgacgaccaggaccgtactcaccacctgggaggttgccaacacatataacagtagcggttcttgtggatgtggcgaggctaaaactggtgtagtggtgagaagtttcttgaagtcttcaaaggctttttgtgcttcgggtccccactggaaattgtcagtcttcttcagcagcttgaagaagggcatcccccactcgccgagtcgtgagacgaaccggctgagcgccgccatgcaaccagtcagcttttggacgtgtttttgggagcttggcggtttcatgttgaggatggcgttgattttctccgggttggcctgtatgcctctttgagataccataaatccgagcaacttccctaacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggttgctcctgcgttctttaatccaaagggcatggtgatgtagcagtaggccccaaagggcgtaagaaacaaggtcttcaagcagtcggattcttttagtcggatctgatgatatcccgagtaacagtccaagaagctgagtaactcgcagccggccgttgagtcaaccacctggtcaatgcgaggtaacccaaaagggtctttgggacaatatttgttgaggtcggtataatcgacacacatgcgccattgccccgtctttttccgaaccaggactgggttagccagccagtcgggatgaaggacttccttaatgaagcctactgctaacagcttggttaattcctccttgatcgcatccttcctgtcctgtgcaaaatggcggagtcgttgcttgatgggtttggcctcttgcttaacatgtaaagagtgctcaatcacctctctaggaatactaggcatatcagatggtttccacgcaaagatatctttattattttgaagaaaggtgatgagcgcgctttcctatttacaatctaactcagcgcctattacagcagtcttatcaggatcggagggatctaagggaatctttttcatcttggcatcaccttcttcggtcttcgtcagcttggttgcaggcacttctccctcgcttgccgtggtcgcagccagtcggatctcttcgcgggcaagagtagtctcgtgggtttgggccatctcgcaactttctttgtcacatgtgacggcctgcttgatgtcgctccgtagtgatatgactcctcgaggaccaggcatcttcatcatcatgtaggtgtagtgtggggcggccatgaatttagctaaagccggtcgtccgagtatagcatgatatgctgtctcgaaatcagcaacttcgaagcaaacattttctgtgcgaaaattctcccaagtgccgaaggtaactagaagagtgatctggccgagtggtgtagctgacaatcctgggataacaccgtgaaagggtgcattactcggctttaattatgtgcgaggaatctgcatatcgtccagggtcttagcgaaaaggatgttaagtgcactgccaccatcgatgagagtccgtcggagcttgacattgcgaaccactaggtctagtaccaaggggtaccgccccgggtggaccactcggtcgggatgatcggagcggtcgaacttaattgctatctctgaccaccgaaggtattgctatctcccgttctgttagcttctgctttctcttagattcataagccaggggtccaccgaacatgtgattgagttctttgcggtgatcttgaaaaccagtcggggcatcgtcttcatcatctttcttctttgatgtgccttgatctccgtctgagggcttacgcgcgttcttgacatattgcttcacaaactgtttgtagacgaagcaatctttggccacgtggttggagttgggatgatgcggacattgggagttcattattttgtcgaaggtgttgacgcgggaacgttgttgggaagacggagaggtggtcgccacaagttcttcgggcttacgcttgcgatccttgtggttgttacttccactccctcctgcagtcggcgtatccttctttggctttcaagcggtgcccgactgcttggacgccgtgatagcattttcggctttggcatactcattggctttttcaaacatctacttgaccgtcttgggaggtttgcgtccgaacttgccgactaggtccttgtggcgaatgcctttagtaaaggcggcaatgatgacgtcgtcggcgatgaagtggtcgcgtagctctgcccatgatccgatcgtgccgcggggtagcccgtggagccatgaccgggcagaatccgctagggccacaggtagataattcgccatggctttgctgtctcctcctgctgcgcggattgcgagaccatagacggtgagccaagatttaggcttggtggtgccgtcatatttctcgattccagtcggcttaaagccggctagccaatccactcgacgcagatcgcttgtgaaggcagcaactccgtccatgtcgtcgtcatagcgatctggtgaatgatggcctcttgctgcgcggcgctggttgatggtgtcgcaaagatcgatggggcgccttcgatgtggggagtgtggtcgttcaactcggcgctccctatatcgttcggaaggcaaacgaatagaccgttcatcgtgtcccctgctcctgcgactagattcggcgccggcaatgctgaggcttggctggtgattgtcttgagatcgaagatgagggactcggctaccagtcggggtgtcgcgtcccaaaacgactctaaaatacatcctcgaaataatgcctagaataattaaaatccgtgtgaaagcctcccacaattaaaatgtgcaaagttaaaagtcaaataaggcttggaggatttttgtatatttcctaaaagcctaaaatgcgtaaataaattttagtggaattttcaaagcacaaataataattattaagaaataaacaaagttaaaatggttttataaaaagaaaagctctaaaaagtctttttccccccctccccctcttgggccggctcggcccatctccttccctctctctcctctccccgcggcccattcggcctcctccccgtgcgcgcgccgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattccctccctctttccccccatttttccctccctttctcccttggattcattcggaatctttccccctaaacctcgccggcgcatcaatggcggccggatcttccgcgcccgtttccccctcatccggctgccctctctcactcccaaccctatataaacactccccgtgccttcctccaccgtttacgccactcgccggtccctctctccgccggaatcgagcttgcgccgtcgatctttctcttcggcggaaccgccgagctccggactgccggcggcggcggcccggacctttctccgcttcggcgcccgcttcttcgggtatggcgcaaccttgccggactcggtcaccccttcgtttcgcccgccgaccggcggaacgcccgcgtccccgtttaaccgagccgggcccggcggcttccttcggttccgggcgccgg

SEQ ID NO: 10258 - DNA, 1234 bp, Oryza sativa
  unsure (1)..(1234): unsure at all n locations
natgatttcacggtatggtcatcgggttaanccaatgctctggcctttctncatgacttaaatgaccaaagtgtccatgaaatacttgaataagtttgttgtggttttcattgatgacattctggtatactcacaatcagaggaagaccatcagcaccatctccgtctggtattgggaaagttgcgggaacatcaattgtatgccaaacttagcaagtgtgagttctggttgtccgaagtcaagttcttagggcacgtgatatccgctaaaggagttgctgtggaccccgaaacagtgaccgccgtcactgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcatgccggatactcgcaaggacttcacggtgtattgtgacgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtcgcagacgcataagtcgaaaaagccaattgcaacacttcttaacgtcccgggcaattccaccccgaacttaaatcaacagattgaaagccctggatcctaagcataagggggtcgcgggattctttggctgcgttggaaaccaaagcccacctttgctcgatcaaattcgcgaggcttcagaagaacgatcccgacatgcatggactcctcaagaatatgaaacagggtaaagccacttgtttcacagaaggagaacaccggacccctatggaaccggaaaatcgttatggcgttccagataacaagagacattaaacaggtgatactttacgaaagctcacgaaagcccttatttcaatcacccttgga

SEQ ID NO: 10259 - DNA, 20625 bp, Oryza sativa
  unsure (1)..(20625): unsure at all n locations
gtcaactccttgtaacatacttattttattgnnnctcctcnncccttccttttttcttcttntnnttccttntctnngtttttttnttncnnccaaanccccnnnccncnnnaggtgatgattgcgaactcgctcgnnacccancancccgnnctgttgacgctcttcagcgtgccatcgcaacattctagcattccccttgttcctgaacaaacgccttagccgtggtattatagggaaataccacatcaccttagcaggaattctcttctttggtacctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgttttcccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggatgaagacatatatataggggtgggactttagtcccggttggtagcaccaaccggggctaaagatcaccgggatcattagtcccggttggtattaccaacggggactaaagttaagataccaaccggggctaaagatcaccgggatctttagtcccggttggttaagatctttagtcccggttggtgttaccaaccgggactaaagatcccgggggggcctgacaggtcctgacagcattcgaaccgggactaaagatgatctttagtcccggttggtaacacaaaccgggactaaagatcaaatatgcccgttaccctttcgaaccgggactaaagatcatctttagccccggtttttattgcatccgggactattgtggaaatcggccgaccgacgaaagatggtttcttcaccagtgtatagttattgaaagatattacagttgggggttactatttaattgaaactaaagtattggataggataaataaattgcctacaatatgcaagcatgcagtggcgcttctcttttctagaactaataaagagagatgtatgcacgcgccggatattctaggacagatcgatctggtgatctgttctttcctatgcatgcgagcaaccaaatctgagatggacatgggctgatgcgagcgtatatgaggatggcaagtgtatatatacgcggtcgtacgatgactgtagaggttccccgatgacggttgaatctgatacagtcgatgtatttgtactggaatcgaacgacttaccaaacaatcagcaaaaacatcttctatttttataatggtagagattgggcatcctttttatttttatatggaagtctgcagtgtgactataacctagccatattagggttgttacccttgctataagggagcagctaaaacatgtcactttggctgtatgtacatatgattggatgtaaagaccgggtttaccccattttcttaaaaaaaaaaaagctaaaccaggtctctgtcaaataatagactttcttcaaggaacatataaatatgccattcaaaattggagtgtgttggggcttattaccatatgaagaaaatcacgcatttttaaaatgggagtgcgttgttaccgttgcaaggcatgttttggcatggtatgtactccctccgtctcaaaatataaatatttttagctataaatctggacatgcaggcaaaagttgttacattttggaatggaggtagtacataggtagaatggtgacttttttaaggcagtgcagactataaaaattgttgaggtaaaaataaagttgcgtacatcatagtaaaatccctattaggattatttctataaaatcatttttggtgaatttatccataacgtacaaggtagctagacatgatttgtacattgcaatgttgctactcccttcgttttatattggaagatgtttgatgttttctgtcctagtcaaactccaagtttatagaaaaaattgacaatatctaaaatacaaaattaatattattaaatctaacatggcatatattttataatatgttttatacagataaattcatttgatcaagtgtgtggagcattttgtcaaacacatgaccggcattggcaaagttttctattcagaattgtaacaaactccaggacgccgagcacatgtcgccatgaactccaggacgccggctgatacttgaggatacctagtttttttttttcaaaaattggagagcctacctgctagaatcgccaccgccgctgggatgggggagttcggtatgagggatggctggatcttggacagcacgatggatgaggcagcaacggcacagtggaggagccagccgggaccgtgcgacgacgacgacatggagccatcggcgacacggtggaggaggcggcggggatggggggatgcgggaggagctgggaccacgcgatgacgatgacggcatggagttaggaggattcgggaggcgcagcgcgcatctggagcagcgtgaggaggcacggcggtgaagtcatcgcgttgggaaagcacagcggcggtcgtgggggcatagatagcacggttggagggtaagcgacaaccccggcggtagggaggcacggtggaggatttgaggggtaggcgacggtgccggcggtagggaggcacggccactaggggaggggaggcgcggtcactgccggggtggagggcggccgccggtttcgtcgaaagaaaatgattcgcgggtaggagtgcgggcgtaatcatggcgcggtcgagaggatagggtcgccgaggatagaatcagtggaagatttcaccaaacggattaatggattatattatttaacctaccggatggacggtacagattgatccggatgatttggcttatagaattggaaagggcaactcctactttttatattagtatagatgaagaaaatcgatcacgcgcacagcctccactggcagctgtgtcgtgtgtcttttacaaaatataagggtcataggatcgttgttgatccaaatttaattagcaatgatattaatttttgaagtcgatgttttacccacatttttttaatatatatatatatatatatatatatatatatatatttatatatttatatatatttatatggaagtctgcagtgtcagtaacctaccgaaattaggattgttacacaattacagtacttgctaagggaacagctaaatctacctcctccgtttcacaatgtaagtcattctagcatttcacattaatatgaatgtgagaaatgctagaatgacttacattgtgaaacggggggagtaattaacaggcgactatcaaattatagagtttccttagagcagcagctgaaagcaatgccattcaaaagggccttgggcttattcccatatgttgaaaatgattgcataggccgcaaacatgggcaatatcatgttttctgttttggaaaataaataggacacttattgcaaagagggtgatagattttatttagaaaaatggaaattgctaggcatcgccgcatcggtacactattttcttttcagttagaatcttgcccatctgatctatcttgagattttgaggacccattctagatcagacctgttatataatcccaaaccgcattagagacatggcatagttttccgatctaaaggggtgtgggattagataactcacaatctttttttggaagaagtacgaattgccccaccttcccccctccgaagtatcgtggtcaaccgaattaccctccgaaacccgaaaaatagacattctcaaccactaactatacaaaccagacaaataacccccctaagcaccgttttgagctattttcgacttgagcttgcacacgtggcaatccagtcagcaaagaaaattaaaaaaactcatggacccatctagcatcccttgccctccccaatccctctactctgtttctctccctctcgctcactcggcagacctcggtcagctggcggtggaggcggaggcggagagaactcgggtggccggcgctatcggcggggcgacaaggaggctgcagcgtgaggaaggcggccgccgcagcagtggctagggagcgagctcatgacggtggagcaggcagaggcggactgagcggtcggcgacagagaaggaggccgccttattcaccgacgcttccggccggcgccgtgcacagggctcgctacccatcgaattcccctcccacctccatttcctccttttccccatccacctccgctctccctcccacatcccctccacctcccacacactgccgggtgcagcccgcccccacgtgccgctacccaccgcccatctccgcgccgcgccatgcgcgccgtcgcccactgaccacgtatgacatgtgggtcaagtgaaagataggaagagaggaagagggggtatgacatgtgggtcccaccattttttaaaaaaataaaattttgactggactgccacgtgtacgccacgtaggacaaaaccgctctttattagattaagggggtaatttgtccggtattgaaagtttatggtgagcgatgtctggttttcgggtttaggggacaatttgattgaccacaatagttcaagggggataatttgtatttttttcctttttttaatataatacataacttacaattatgacataagtctcaattatttcaccccatttgcactactacggaaatcctaattggtgccggctgggaaacccccttagataccagttttcccaaccagcatagatgacttatgtcatcggtgccaaaccggcatctatatgtgtattagatgccggtttctcgatgcaccagctcgaatcgagctgatgcatcgagcgcatccacctcgtgttgccccaaaatatcaatccacaacaccacagaacaatgaactcccgaatctatcacatatcaacaagcattgaagaacaagactgaagcggaaggacagaaggccgactccaccgctgctcaccatcaccgtctgccagatccgctgcgggagaagccgacgccgctaccaccgctggatccgcccaaggcagactctcttcccgctgcctgccctccctccaaatctggcggagggagggcaccaccggctcctacactcccaccatcgtccgaggatccgtcgctgctgccgtcgccgcgccgccaccaccttctttcctgcgccaggttgccaccatatcccttttctccgcctcctggtggagggagggcgccgccgctgcctcctaagctctggcggaggggagggcgccacaactaggccaccgacgcctccatcggatctggcccacgtgaactgccacctcctttattgctggagagtgagaagaaagggggatgggacgggaaggagagggagtgagagggagagagatagacgggtcagaggaggaaatgggggggtgagatgaggagacagaattagttatgcatgtattcgatccaagttattcgctttcatttaattgggatctttacatttgagcatatatttgagtatatgagacttgtggtgttgattaatactcatcatttattcatatccttttatacttgtcgtgacggctttgtcatgatggaccgcgcgaggccatttgaagctacaagtaaccgcatcaatcatttgaagaatatatggtgaaatggtttcgacattggcgtcccttaagacaatgaaaggaagacggaaataaggcattcctattgttataattctattgctatttacatttgagtataagaatgtcgtactgttaagagggatgcaacgtcgaggtgtttgtgtatgtctcggtactcaaagtgacctatgatagtactaccttgagagaaacccaagctctaacctatcctttgagtggttttagactttgttttttgttgagttgagtagtcctctaagtgagctttccatagagtccaaaatcataaaaacatactcccgagcgaaaagttatagtcgtttttctctgcgcttttccgaaattctgaaaatggctgcgaaactgatattggcttctgtaaattttcggacatatttgaaaatgcttttcagaaattctgaaaattacagtcttggcctacaacggctagtttttgagaggctcggatatataaactcctccaaccctcctttgagtggatgctgttcttggcaacattagacacatccaaagccaaatagccatccccatttctctacctttgtggtgcctctttatgagaaggatttgagaagggattagagttggattgagaagttgagagctagtgagcttcactacatactttgagtactcgagttcatagcaagcaaagcttcgattgtgattgttactcctgggtactaaggtctcctagacgactaggcgttgccggtgagcacccaaggttgtggtgtgccatggaaagttgtgaaggcttcgatttcgcctccgcaagggaagaaatcaagagtaaaaccgaggagtgcatttatacaacctcgtgagggaagggttgaaatagacccggccttgtgacccctcaatggagacgtagaatccgtggatccgaacttcgggaaacaaatcaacgtgtctcctctcttggtttgctcgttcttgccttctcttatattgttcttgagcttgttttttactgatctacttacatgcttaattaatatagttggtgaccttatatcttgcttagataccttatttgtcaccttttgatttatatacattttgtttattcgagctacaagtttatacctagtgttttattccgttatccgccgaacttttcagttgagaccggaacttccaatcccataccagatgttccgatttgaactgaaagttctcatctctctaatatgctatgaagttgtgataattttctaggaaaacctattcagctcccccccttctaggcgacctcaagatcctttcaactacaaacatttctgtggtagttggtgaggtgaaatggcatggccacgacatatattttggttgttaacaaggtaaccattgcttttccaggaccggttagcgagacggtcgcataattttgagcggttgtcaatgcactagccacattgttttcaccttggattttctcctaattcaaacatctgggtattgtatctttttttatccaatattctataaaattgagctctacctactggttcaactgattatttcatttgagtgaaaatatgggtagcaattcatagtagagcaaacaagcttcgtcgtattcacacttaaaaggattatatgtggagccagcccaaactctccaactttggcgccgagaccaacgagtgatcgagatgccttggtgctgaatttattcaatatgcctcaatcatttaaggttggggaattccactagcacctcacttctgtatcaggtcatctgtgacaggcctaaccgagccgttacagatcacgtacctataacagacgatattttagccgttagggatcgacactcatttgtaacagctcaccaataggagccgttatagatgttagtcgccttatctgtaacggctcttattaaggagctgttatagatacgcccctcatctgtagtactcccattatgagccatcatagatgtcaacctcacatctataacggctccatttaaggagccattgtagatgtatctctcatctgcaacggctcctaatgtggaaccgttacagatgattttaactcgaatcaaccgcaagaaaaaaaatcccatccctcattttccccaccagccacatatctcacttatcatttcctctcctccttcctccacatcgctggtgcggtggagatgacaggcgtggcagtggtggatggcggtgggcgtcgggtgcaggtggaggtttttttatgcatgtgtgtgtggggggggggggcaatgcatggtcagcggagggcggtgggttgggcctccacgatgacggatcagcgaagacagcatccgaccaccgccaccactgacaatgcggactatgcctagacggatctagccaaacaccccatgacctcaactcggttggattctgaggaagggattttgaggagggaggaggaggtagaggtgaggagagagaaacggcgatggagataacgagtagggtggtgcgtgttctgctggtgtcagtggcggagtgcgcggcactgctagtgacaacaacggtgaaaaaggacaattagctcggtactcgtctcagcccctctccctttccctttgcttcatgcgccacctcatacccagatctggcagatgattctcatctttgatttctctatgttcgaattaggatgagggtgttctacagcatggcggggcaagtggatgtgatctagacgcggcggggtacacaacaaatgtggcatcaccaacgccatctccaagtacaagaacacaacaccgacgtcgagcagcaagaggccaggagcagggatgaagacctgtatgtttgtttgatgaatctccacatcaataacagctcatgggcttggattttctttttttaagctgaattttcacatctgcgacggctccaaattcttagccattacagatgagtcttcacatctataactgttgggttgtaatggctcgtctaaccattaaagatatgggtattcagccattacagatgtagggtaatgtgctagtgtttccttgactcactaccacataaatactcattggtgccggatccgaaggcctcatagtgccggcttcggacccgaggggcagaggtgctggatctggaaccgacacctatagttttcaacgaataaaaaaaagaaaaataatccgaaccgcccaccaccggccggccaccaccccgcccggcctacgcgtcaaccattttcactgtcgccgccatcaccagatctgaatgagacgggggggagggcggataaagaggatgagggaggggggcggtatgcctcctcctcctccgccactgccaccaggtccggcctctgcgctggccatttccatcgtcgatgccatcaccagaactagagggagatggccggcagagtgagcgagccgatgagcctcctcctcctttgccgcagccacccacctttgcaccggccttctctaccgccgccgccatcactagatctagaggggccaggaaagaaaggggtcggcgagtgaggaaaacggcagcgccacaccgcaccgtgctcctccttgccatccaaggtcgctgggggagagagggggccgacgagcctcctccacaccaccgccgtcgccgccgctaccttgcctggcctccacgcccagatggtccaccaccgcaggatctttgcaccggccagcttccgcgccgctactcggagagaaagaaagagagagagaggtagagagagagaaggggaggatggaggaggacggcacgaggagaagggaaacgttgcatatgcaagagagatgcgatgtgcatataagtatgagtggggcgacttgttggttcttttaaaaaaccggtacctatagtattgataccggttttttctaatgaaccgacacctataaaccttaaaggtgtgggttatttttttttcttcgtgcggaggtggaaaaaaacccaaaggtgctggttttaagtgaattggcacctataaggttcctatgagagtttctgtagtagtgactctttcttgatatcgcggctcatgtccgagaattcatgcatgattccttcatgaagcggcaatgatagatcatcattatcgatgttcatgacttattgatggtatagctcagcgtatcttatgatagtcaaattattaattattcaaaccatttaatgatagctaaagaaagttcactatatcttatgagttgttcgtatcaaataattaagcagataataacaacaggctagaccatcattcttgtctttaatgcgcactgataaagtaccatgcaataatatttacgacgtactttctctagttaaatttaggaaaaattggttatatagtatcggaagttcacgttttttgttttatagcaccgaaagataccggttcactttaatagcacccaaagttcaccctgttcctatttttagcacttccgtcaattctcgatcgtttttcgtccgtctccagccacacacacgatatgacgtttctacccctcacaaatacaagtagaatgcatgtcaatgagaggtagaaacgtcatatcgtgtgcgtaactgggtcaataacgatcaagacggtcggaaaaattgacggaagtgctaaaaatgagaacagggtaaactttaggtgctattaaagtaaaccggtatctttcggtgctataaaacaaaaaacgtgaactttcgatgctatataaccaattttgccttaaatttactccctttgccccaaataataaatctagtataaaagatgttccacattctattacttaacatgtttatggatgctactacaatatcgtgggcgctctatagtcgtaaccgtgacaactaccaaaaaggtacaccgtatctctccagcacgtgccattcaaaaacagcaccgcacgaaactttcgtgtgcgcccatttcctgctcggccaacccacgctgcccatgcaagagccgaagagtgacttaattagcttctcttcccacccatgtgcagccatacaattacacacataattaaggccaccgagaagaaaatattagaggtttgcgtgaccattcaccatcaataaaaagtaatataaaattgaaggttcatcgagcaactttgcaggtaaccatcccacatttccacatgaatatatgtaaaaaaaacacaaacatgcttttaagccgaaaaacatcttgacacttcgatcatttcagttcataaactatatatatatctatcttccgccgatacttccatgtatttattttttaatcctacataaaaggagaatggcagaaaggaccaatatacatatagttatatctgtattatgtatatgttactactaaataggttatattacatccataatcatattgccaaaatttgtgtccggcttgccattaattagttccaaaatttgtataaacaactttaaacatcgttaaatcagaaaataaatagtactgaagttacttttattaggaatacctaagttacttctatcttagaccatgcatgtaaaaacaaagttgcttgtatctaaaaccaaattaagtttcttctatctgtaccgaagttacttatatctggaaacaaagttcttctatataaaatcaaaattatttatatctgaaaacatagttatttctatctaaacaccaaagttacttttatgctaaacaaaagtttcatctatttaaaactaaagttacttctatgtaaaaccaaattaagttacttttatattaaaacaaagttaattctatttagaaacaaagttacatctatttttgaaaccaaaattacttctatttagaactgaagttacttctatctaaaaccaaagttacttttatctaaaataagtgttctttttctttgaaaataaaacatatcaggttttaggtatagacacatgtgattatagagttacatctatctaaaccaaagttacttttatctaaaagttacttctatttaaaactaaaactacttttatctgaaaagaaaagtatctggtcggatatatttatgtaattcgtaaaatatcaaaatgattaagaagacctaaacatatcattttaaatgatatcaacctaaacaaatcccacatatcatattataccctagggcggtttgacaaccatgcccacaccgccgaacgcatcaaattttcgccccaaaaatgggtggtgcactgatgtattccctttgctcactaaatggactcaccaagtgaaatttatgtgtgtaaacacacttaacaaactaaggtactaacaaaaaaaaactcaaatgagaatgtcaatgccttcgccttcgtatatctatccattttcagatattagaaattagaaatcagaaatcaagcataaaaactgcacgtgcattatcaaacttcaacatatcagctgcatatgtcaccaaggccaaatttttaaaaaagagagagagagagagagagagaggcaaaaatcctctaatcagcagtgaagccagtaagacgaaagagaaattgacagagaaatccaacagctagccggaggagctcctctaggtagtcggctcctgtgtcctcaagctcaccacccaacttgttatattgatccgtagtttgctcccaacaatttcatacaaattaacccgtcgcgatagcatctgcagtttgctcccagaatattgcatacaaacatacgtatcacaaaagctgtgttgcatacattcagaatactgaatatgtacaggcgctcgcccccgtcttccacgggcttcttccagcgcctgccgcaaccaacgatgacgccatttcctccactgttttcctcgccgccgttgacaggcacaccggcctgcgcccgctcccccgtcgcttgttcggaatagtatatatgggccagaaagtcagacggagaggggcaggcccagctgtcagtcagacaagcgcaggcccagctgatccgctgtgtgttggactccagtaggacctagggctacgcggctagctgtagccttgtagctatctatctcatcggggggtgcgtgcaacgccgccaccgacacagacaccgcgtgttccggacgccgcccttggagaggagatgcagcccgcagatccgccgattccgccgccgcggccgccgccgccgatgccctccaggaagaggggaagggggcccacgaagggcgacgacccggccccggatgaagcagcacctccacgcaagccgtcgccgcctctgggctcggggagcagaagggctcgcaaccatgttcctccaccgctcggagttggaggagacggccgcgaggagggcgtcgacttcgtcagccacctccctgacgccgttcttggcatcatcatctcgctcctcccgagcaaggacggcggtaagaccagaaccctctccaaacggtggcgccctgtctacgcaccacgccgctcaacctcgacgccagcgatctcgcccccggcgccaacggggcggcgctggccgtcctcctcacccagtactcctcgctcatgcggggcccgtacgccgcttctgcatccccgcgcagcagatccacgagcgccccgccatggtcgaaggctggctgacatcgccaaggttcaacaacctcgaggagctcgagttcacagaagacctctgctatatgagacaactccttccgctgccgccatccattttccgcttctccaacaccctccgcgtcgctgccttcagccaatgccgcgtccctgattgcaccgacctgatgctccagttcccccatctcaagctgctctcattacggcaggtgaaaatctccgaaacttccctccatagcatcatcgccggctgccctgccctcgaaggtttgctgctcagaaatagctacggattccgatgcctccggatcaactcccctaccactagaggcgtcgccttccattctccctactgttggagtcatggcgatggagaggtgtgttaccacttggaagatgttatcgtcgaatttgctccatgtcttgaaaagttgctccatatagaacaatcggtgggattgggagtccgcgtatccgttgttgtggcacccaaattggagacattggacgtccttgacgatgttaaagacggctattccgtactcgattttggcacggtagttttcaaggtatgtgacttcctattatccctataccccctcgcaatctatagggattaattacaagttgcatttgcattaatttctatgtgcatatattgttaatgagatgtggtgttaagagtttacccatgtacgtccagttcggagtccgggttttaatctattctctaaaaaaatatgtcgtcttggagttctctttagatgatattagtttgattcagataacattatttgaacatatcctcattctttcttgaagttactgttctagagactatggcgtacacacttcattattgtctgagttactggatagcaagctctcgcaacactatgatttgtttggttgtgtgcatcctcagtagatgtagcagccagatgtaatttcattgcttgattatatatccattatctactacttccgtcccaaaatacatgtagacgtcacctagtactataaatctgcacagaacctatctagatttgaagtataagtggtgtctaatcgcagaattaggtacctatagttttagactgcgggatagaaaatatggtcgacaaatatatattattcacaaatggcctaatgttatgttccgtgcttaatatagggattcgaggtcgttaacttcacaacgccggtgtcgagtgtcaaggttttatctctcgtcatgaaaaatctcagcttggacagggttatcatgttaatgatttgctttccatgcttggagaaattgtacatcaaaggaaaaattcttttattttcaagtattgtgttacaatacttcttttgtcagtttaaataattagaaggtatttaatttgaagaacttaaattattccccatttcttatttcaggggttcaagtgtggggaaactaattattgacgccgcaagtatctgaaaactatcaaaagccataacatatctctaaagactgttgtgctggatgattatcgtggcacgaaccggcaaagttcagttcgccacattcttcatacggaacgcgagaaatcttgagaacatgatatttacgggtggacctaacaaatacaacgcatattttattgcacaacagcctaagctgctagagtttgagaaaagggcttcaaaaactgctcactttcattttagaccgaagcgatgttataatgattgggtgcatatcaaggatgtccatgatttgtctcttgccgatccttttgaatgtacctgttgagactgatgggtggaattattgtaccttttgaaggttcgagctaggcaagagtactttgtggaggtgctcgtttcgaatttaagagtactgatggatgttgtcactgagctgaagagctatattgatcatgttgaagatttatcttaatatatgtacctttggatgttgttgaagaaaaggattgatctggtgtattgggctgttgtttctcagataccattgtatgtgtttttttttccaatttctgctgtaataatactggttaataaaattgttgttgatgccatttagctgtcatattttttgattattttttgttctatcctcaatctttttttatacattatattgggcatccttttttttatatggaagtctgaagtgtgactataacctagcgaaattagggttgttattgttgctgtaattaagggagaagctaaaacaggtcactatcaaataatagactttcttcaaggagcagctaaaaaatgccattcaaaagtggagtgctttggggtttattaccatactagtacagtgcccgtgcgttgtgtaaaatcaaaggtgcttttgattattattctgtgatgaacaattgggcattggagattattggttttgttatttggaatttattcccgaagtggttttgaagatgattggattcacaggtgatcgcaggattcattatttcatgtgaccggtcagaccgggctctggtagccggtcagaccggcgtgtaatgcgcggtcagaccgacgcagcccgcgatctgaccggccgacactgtatcggttttggtttcgggttgtttgtttggatatctgagtttatttcatgattatggcttctagatggatactatacgtatgtaatactgttgtttgctactaatgagtcaagttggagatagtttggtctcggaatatggtttctttgtttatttcatgtgtaggtgactcgatgtctcgggagagtatttgcggtgatggaccgggagtcggcttggggataagacgacgtccatggtggtcagagatcatgcgggatactaaggctagagttgatgcacgtggttgatatagatttcatatggcatacgatggaggtattgtgtgcatatgggatgcggagtccaatttggaaggagtccaaatttggtatgattggttatgtaaagtttctttcttgtactagtgggtttcctaaggtgtttaggactcctagtatgagtttggttcgtggctttaggctgcctacctcatgtataaatagagggggagcgtgaggcttccctatatcgctttggagagcaattgagttgagttttgagttagggttccgagtttagtcgaaatttttgtaaggagtgctgttggtgcactttgtaaacacagagagaatcaataaagtcgtcatccactttaagagttcttcgatttgtgtttactgggttttggcggtctaaccggcaatctatcggtggtcagaccggcggcacagggcggtcagaccgacggcatacgggcggtcagaccggcggcggcgacaggcgcggcaggcaacttcggtggtcagaccggagattcaacatcggttagaccggcggcatccactcggtcagaccggtagattaatctcggtcagaccgacttccgtcgatttcgagggtaacttttatttccgctaaaagttttcggtttttggtataccaaccattcaccccccacctctggttggcttagttgttgtgattcgatcctacaagtggtatcagagccttgttttcttgtatggatttttatcgatctagagtttttgccatggctactcccgctaggttttcaactaaggctcatgttttcgatggaacggatttttcttatttggtgtagtaggatgcaatcttatattatggctgaagattatgatatttggagaaaagtttctcatccttatgtgattcctgaagctattaatactgctgctgaaaaactgcttttgaacaaaattgcaaagctcgcaatattcttttgagtggtatttctcgttcggattatgatcgtgttgctcatcttcaaactgctcatgagatttggactgctttgagtaattttcatcaaggaacaaataatattaaagaacttcatcgtgatcttttcaaaaaggagtatattaaatttgagatgaaacctggagaagctttggatgactatcttcctcggtttaataaaaattttgagtgatcttagatctgttgattcttcttatgatgctaattatccacaatctgagatttctcgccactttttgaatggtcttgacatgtctatttgggagatgaaagttacatctattcaggagtccattaacatgtctactttgaccttggttatacaaaattgaaaacgcatgagatgaacgttctttctcgtaaagttgattctaagtcaagtgctttggtttcttcttcttcttctttgcatgttgatgcttctccatctaagtcttcttttcttgctatttttaatgccacatccgatgaacaagtcgaatagatcgaggaggaggatttggctttggttgctaacagaattgctcgagctatgaataattccaggaataggaaaagaggtggtccaaaaagttgctttgaatgtggttcaattgatcatcttcgttcacattgtcctaagcttgggagaggcaaaagagaagacaaagatggtgagaagaccaacaacaacaagcccaacaacaacaagtcgaagggttcatcccaagggaggaagctggacaatctcaggaaggcttttcaacaagtttgcgccgccttcgagccactaagtgatgtagatggtgaaagttgagatgatgataagggaaagaacgtctccgatgtttgcttcatggcgcgtggtgaatctgacacagagtatgaagataatgaggtgagtgcttttgaggaagctattaatattttgagtgcaaaaaataagaagtgtgagaagatgtatagaaaacaggaatttatcattgaatctcttaaatctgaatctgataggttaaaacctcttattcctaatgatgatgattgctcaaattatgaggttttaatgagtgagatttcaaaaattagacatgttaatgctgtacatgatttgaaaaatagatcttctcttgtttgtagttttgctttgcacacacgcactttggatgagttgtttttaactaaaaagttgttgcaaaaatatcaaattgcttttcatgctaacttgatgtttaatatgatttctgctaaaaagtcaaaacaatctcatgatgttttggattgctcaacatgtaatttgaataagttgaaattgaaagatgctttaggtcgtgttgagttcatggaagatgttgtgaaaaacaatgaagtgctttcttgccctaaatgtcgtaaaagcaaaggtgtcatggtagattgtgaaaattgtgctaatttggaaaaagaggtttcttatttgaaaattctttgctaagattttctgatggtaaaaagaacctcaacatgatcttggatcaatcaaaggttagcacacataaccgtggtttaggttttaatccttatgctcataattctagacatcatcctgttgtgttaggtgttggtgctagaagtggtgagattttggttaaacctgatactaacaaaactgtgtttaaatctgctggtttcatgtctaccttgaatgcatcttcttcaaaatccaatgttgtgcatgcaaaatctcctgttattgcttgtgttgctaaatcttctaatgctaccaatgtgtctaatcatcgtgaaaaatatacttgttctttttgtggcaaagatggacatattattggtttttgtttcaggttagctcataaacagaaaaatgagagagagattgcttttgcaaaatcaaagtggcaaaaatcgggttttccctcgaggaaaccggtcagaccgcagtgggtcccacggtcagaccgatgactagtcagaccggctactgagcgtcggtcagaccgggcaccggtcagaccggtggtacagaggcggtcagactggccactgtaccttggtcagaccggcctcggaggaatttttctgaaaattctaaaattgattttgcacgtggatatatgcctattggatctgctggtcgtgtgtctcagtactggattcctaaatttttattatcatctaaccccagtactgaggcttcgacttctgcttgtgtgtaggctttgatagcaaggaaggacaacgtgtggatcatggattccggttgttcgcgacacatgaccggtgacatctccaacctctccaagtaccagaatnnnnnnnnnnnnnnnnnnnnnnnnnnnnnnnnnnnnnnnnngatatacaaaatgaantacaacacact

SEQ ID NO: 10260 - DNA, 1028 bp, Oryza sativa
  unsure (1)..(1028): unsure at all n locations
gcgtgattaggacatcttcttgcagcacgccngcaagacgactatagaggatccccagactaaaataatcatgtatgctaagtgtttcctgtgcatatgctaaggctaattaagactactgtngccaattgctaggaggggcaccaattccgtagtcaataatgtcatactcagcctaattagcaataaataatcttacattaaaactcaaataatattagaacactacacaatcttatatgatcagggtaattacaggtctaataatcttaattaattggattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatatatatatatatattgcatttcacgttaacgttcgtcctcgttcgttcgctcgttcacgttccctagctcgttcacgttcgttcgctcgttctcattcacgttcgttcgcttgttctcattcacgtttgttccctcattctcgcttgtcttcgttcgatcgttctcgttctcgttctcgctctcgttcgttcgatcgttctcgttctcgttcacgttctcgcggcaacgtacgttgacgtgttcgttctcgctctcgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcagcgtgccgacggcggcggcggcgtggcgttccggggccatggcggtggcggcgtggcgtggcgtgacggcggcggcgtggcgtggcggcggcggcgttgcgcgcgcggcggcgaannnnnnnnnnnnnnnnnnnnnnnnnnnnnnnnnnnnnnnnnnnnnatacaantcacactc

SEQ ID NO: 10261 - DNA, 933 bp, Oryza sativa
  unsure (1)..(933): unsure at all n locations
agcgaggtagacatgctagctcggnaccgaacaannggntaatgatttttatcaaaatcattaagttaaggtagatacacatgttgtcatatgatcaaatggtctcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgnnnnnnnnnnnnnnnnnnnnnnnnnnnnnnnnnnnnnnnnnnnnnnnnnnnnnnnnatcaaggccacg

SEQ ID NO: 10262 - DNA, 761 bp, Oryza sativa
  unsure (1)..(761): unsure at all n locations
ccgcgttgatagtcgagctcggtacccctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcgccagaggagatggtagaactcatcaaggattatgatgtgggaattcactatcatcctggtaaggcaaacgtggatgatttggagttagcccgggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtcgccgacgctctaagtcgaaaaagccattgcaacactcttaacggccgtggcattccacccgaacttaatcaacagatggaagcctgaatctaagcatagtgggtcgcggattcttggctgcgttggaagccaagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10263 - DNA, 6916 bp, Oryza sativa
  unsure (1)..(6916): unsure at all n locations
aaaaaaaaggggaaaggggcccggcccccccccccaaaaaatttttaaaacccccggcccccaaaaaaaaccccggccctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaaaaagggccctttttggcccaattggccccttggcccaggagttcgacctctagaggatccccttttataaaacctttttaactttgtttatttcttcttaattattatttgtgctctgaaaattccactaaaatttatttacgcattttaggcttttaggaagtatacaaaaatcctccaagccttatttgacttttaactttgcacattttaattgtgggaggctttcacatggattttaattattctaggcattatttcgaggatgtattttagagtcattttgggacgcgacaaacctaccccccttaaacggaatctcgaccccgagattcggaagaactgacgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttactctgagtcggccttctcggatggcactcgaagacatttcttgagttgcgacacatggaacacatcatgcacgttgcccaaggaggcgggcagctccaactggtaagcgacttctccgcgccgtgcaatgatacggaaaggacccacaaaccgaggtgcgagcttcccctttgtctgaaacctgtgtacacctcgcaaggacgtgacccgaagatacacaaagtcatccactgcgaattctaggtcacggcgtcggttgtctgcataactcttctgccgagactgggccacctttagattatcccgaatggttctgactttagcttcagcttctctcaggatatcggtcccgaacacttggctttccccaacttggtcccacaatagtggtgtccgacatttgcgcccatacaatgcttcataaggtgccattagtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgtggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcgtatccaccttgggtttttgaaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctctttatgttctctgttatctggaacgcatacccgatttccgttccatagggttccgtgttcatcctctgtgaaaccagcggctttaccctgtttcatattcttgaggagtccacgcatgtccgggtcgttcttctgagcctcgcggatttgatcgagtaaggtgggcttggcttccaacgcagccaagaatccgcgacccactatgcttagattcagggcttccatctgttgattaagttcgggtggaatgccacggacgttaagagtgttgcaatggctttttcgacttagagcgtcggcgaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccgtcctgcatgagcacgcaccccaatccttggcgcgaagcgtcacaatacaccgtgaagtccttgcgagtatccggcatgattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcagtgacggcggtcactgtttcggggtccacagcaactcctttagcggatatcacgtgccctaagaacttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccatgaatggcacagatataaacgagtgggaagctccagagtcgaacaaaatggtagcagggatggaatggatgaggaacgtaccaacgatgacgtctggagttgtcagcacgtcctcggccgtcacgtggttcacacgaccccaaatgacatccttaccaccgttgttggagcggggaggcgcttggccttgctggcgcctcggcttcgggcatttatccgcaaagtgcccgggctcgaagcagttgaagcacagacgctgcggaccttgaacgtccctgcggccttgtccagactgcgcggctggcgtaggaggacggggcgcacgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcgaaaattcgccaagcgacgcttgtgcgactccagttccttgtgcttggcttccaagcggatgctcttgtccaccagacgttggaaatccggatagtccccggagactagacggacggacagctcaggatccattcctgccaagaacttctcctgcttttcctcatcttcccgtacatcctccggggcgtaccgggccaggttgttgaactcatgcaaatactccatcacggagcggttgccttgcttcaactctcgaaattcccttttcttaagggccatgactccggcgggcacatgggtcctccggaaggcggcggtgaagcgggcccaagtaataggctgcccctctggctgtgtagcctggaaatggtcccaccatagagatgcgggcccctgcagttggtgggcggcgaagacgactttctcctcatcgctgcactgcacggtgtctagcttttttgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctggcaatcaaaaatgaacagcagcggactagcgggcctatggctccatcttcacaggcgctcaactggggtataagccaggactccacctaagacatcttctccaaagcttctcttactgaagaggggaaagattgagcaagaatgagtacaaccacagtactcagcaagccacaccggcggatgcatgattaatgcaagggggtacaaggggataataatattggggttaagttttgcagtaaacagcatttaaaagtcacttagttgcccaaagccattttataaggacgatcctagagctacacaatgttattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcagcttgcccataaccgagggcgcggctattcgaatagattatactctgatcagaggtgtacatctttacccacaagacacatctccctcacgtgtaaccacgtgccacataccaccacggtatacggacggaagacgtgacatagttcccaacccatcctagccataaacaagagtaccgacccaaccccacttacggccggaacccccgggacagccagccaggattgagccccctagcagcaggacaccagccctgtgccatgacatctcgactaccgggccgcagctcgtgtagccttcatttgccctggagaatgtccatcgacccccgatttcatccatctccaatccgtgtacttttgtttataaccagactgagccacaaactaagccttacccactagacatgtgaaagtacggtagtgctttgcaacagaggcccgaagactggtccttatatacccgaggtgctactatcaaaacccaaccatgcaccccgagcccagcctaaaaccattttggggattttgaatagagggggcggtgtgaatccaattctacaatactccaacaattccaaagtgtccaggtgatatgaatatcccaaagtctagagttgtaaaaccgcctaatgttacctaattaaaaagcgaagcatctacctaacatcatactagtggtaccatgagtagagtgtccactagttggggttttgtttaatctagggtgaataaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaatgtcggcttcaacctccacgaagagtggatcttccgaagctgcagcgtctacacgaccaacagaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaatattaatttaaaatggatttattgcgtcagccgaggggaggggcgcgcggaccgggtccacgggagtggggcccacgcggcagcctcacggtccatggtggaccgggtgcacccggctcacaccggccggcgccgtgggtcccacgcgtcagccgcacccgagggcgcgggcggctgacggccggcccccacatggcagccgcggggcgcgcccgaaggcggccacgccggcacagccgacgggaggcggcgcacccgcgccccgatggtcgccgccggtgt

SEQ ID NO: 10264 - DNA, 4212 bp, Oryza sativa
  unsure (1)..(4212): unsure at all n locations
gcgtgtttgaatttgtanatcnnnnnnnnnnnnnnnnnnnnnnnnnnnnnnnnnnnnnnnnnnnnncgacgaggacgacggtgctccggcggtcggcgggcgatacggaggagtggactagatgggcaaggacacggcgatgccgaagcaagcgatgccgaagcgggaggaggtccggggcgacggcggcggtgaaccggagctcggcggcgacggcggagagagaggacgacggcgcgggctcgaatccgacggagagagagtgcggcgagggtcggaaacggaggagggaggcacagggagcgtttaaatagcggtgggagtgagagagggcggccggaggagaaggaaaccggcgcggaagatccggccgccattgatggcgccggcgaggtttgcgggaggaaatctgaacgattccgagggagagagagagggaaaaacggggggaaagggagagggaatcacggggagtgatttccccctctttatggcgcgcggggacggcaggatgcggcggaatccgcggcggcggcggcgctagggcacgggcgagcggcgggcgcggcgcgaggtcggggatgacgggtgggccccacccgtcaacgagggtggcgggcgggcccgcccgtcagcggcgcgcgcgcggggaggagccgatgggccgcgggggagaggagagagagggagggagttgggccgagccggcccaagaagggaagggggggaaagaagacttttagggtttttctttttacaaaacctttttaactttgtttatttcttcttaattattatttgcgctttgaaaattccactaaaatttgagggctccttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacatttttccccacggcatgcaaccaatccaacgcatccacagggttattggagctagagaaggttggtggacggatgcggaggaactcggcgagtttagagtgttgtgggggtggtggtggagcattatgatgtggcggattttggatgtggtggaggaaaacagccatcatgttggcctgctgggcgaggatttgggtgagaatggcgttggtgtctggtggtggtggtggaggaggtggaggaggtgaaggtggnctnccatggttgttgtggttgctgccttcaggttggttgccatcactggtggcagcatttctcctggtcgtcaccatctgaaaaccccacacagaaccagcaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgccccacaagaccccaacaagaagacaaacgagaaagaacacacgcgcaagcctactaactgctcgtctaccgctgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctcttgcgggcggtgatcttctggctgcggcagacacggcagcgcttggggcgacagacctctccctgggcgatcttgagctgatgcagctgcgcctccactacgtctaggtccttcttcagctgcagattctcctgacgcagctccaagatcttcatgttgttctcgaccatcccagggcgcaccatctgatggaagtcgatacgagccgcgtcgtacgcctacaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgctgatggcgaggagagcggcgctctggcaagcggcggagaaagaatctccacctgcggtgactgccaacgaagtcctctcgggtgagccagtgaggatcactgcagtaacctcccaagcagcgtggggctctgcatcgtcaccctcctgctccgggagcggcctgccctggtagtccactccatgcggataccccaggacaacgcacatgccccgcagctccaagacgaaaccagtcaggtccagaccacgacggctgacgctgccggccatctacaaacaaaaacaaaaagaaaagccacatttaaaagtcagattttggcgataaatgaagcagcaggacagagagagactagagagttttcacaaatagcaaaggatttttatttttgataatattgctaaggcttgggatctacggctcgtcctagggtcaagggggctatgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcgcttgacggcaggcacgatctagacaccaaagccttcatcatccaggggctcctcttctgggttgggaaaaattgagcaagactgagtacaaccaccgtactcaaaaaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacatgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacgcccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattctacaatactccaacaattccaaagtgtccaggtgatatgaatatcccaaagtctagagttgtaaaaccgcctaatgttacctaattaaaaagcgaagcatctacctaacatcatactagtggtaccatgagtagagtgtccactagttggggttttgtttaatctagggtgaataaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaagnnnnnnnnnnnnnnnnnnnnnnnnnnnnnnnnnnnatgagatctacccgcgcg

SEQ ID NO: 10265 - DNA, 18551 bp, Oryza sativa
  unsure (1)..(18551): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaaaatgggttcttgacttcttaaggaaaaattagagacttgaacggtccaattccgagttcaaatggccaagttatggccatttgaaggttatatgctctttaaatgaatatttgcgaatttcttcatttaaatattaatttaaaatggatttattgcgtcagccgaggggaggggcgcgcggaccgggtccacgggagtggggcccacgcggcagcctcacggtccatggtggaccgggtgcacccggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggtgaccaccggcgcggtagagcggcgcccgagagaggggagggaagggggaaacgaatcggcggtccacagctcaccccgggtcgacggcgacgacgggaacggcgaccggagcggagaaagccggcggcgcggctcgggtagacggggacggcggcgttccggctgtcggcgggcgaaacggaggggtggacgaggtcggcgaggttgcggtgaaaccgaaggaggcggcgccgaagcggaagaaggtccggggcgacgacggcggcagaccggagctcggcggtgacggcggagagagagagcgacggcgcgagctcgattccggcggagagagggagcggcgagtggcggaaacggtggagggaggcacggggagtgtttatatagggttgggagtgagagagggcggccggatgagggggaaacgggcgcggaagatccggccgccattgatgcgccgacgaggtttagggggaaagattccgaacgaatccgagggagagagggagggaaaaatggggggaaagagggagggaatcacggggaatatttcccccctcttgattgcacgtggggcggacgggagcggcgggatttgcggcggcggcggcgctagggcacgggcgaggcggcgggagcggcgggaggaaggggatgatgggtgggccccacccgtcagcgagggtggcgggcgggcccgcccgtcagcggcgcgcgcgcggggaggaggccgaatgggccgcggggagaggagagagagggaaggagatgggccgagccggcccaagagggggagggggggaaaaagactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcattatttcgaggatgtattttagagtcgttttgggacgcgacacgcgccctcggttatgggcaagccgagcaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggcgttgataaataatattgcatagttctagaatcgtgtttacaaaataactttgagcaactaagcatctttaaatgctgtttactgcaaccctaaccctttatattataacccccttgtactcccttgcatttattatgcacttgtgggtgtgtcttgttgagtacggtggttgtactcagtcttgctcaatttttcccaacccagaagaggagcccctggatgatgaaggctttggtgtctagctcgtgcctgccgtcaagcgcctgtggtcgtcgccctagtcttccgctgtttctcgtttgtctttgtgtgtgctgggccaccgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacacggggtgcgggtgcttgcagagttggctggaaccgaggcagcgatcatggtcttcgtctggttcaagatgttgacaacatgatcggcttggttgagtgcgtcttccttgaggagggtgtcgaggagagtgattgctacaaccgcgttctgctgggggggtgcgaaagaccgctgtcccatcgatgtcttgttgcccaatgagctctctcactcgccgcccagattgcaaggcgcgttgtcgtcgatcttcagcctcctttgcaatctgttcacgatcttgttactcatgctgtagtcgttctcgctcctgtcactgtcgctcttcctccagtcggcgacgttcagcttcttgtcgtgcgcgatcttggtccgcttctcgggattggcgcttttcctccgtttcgttgtcagccatgaatacgccgaagaagaggagcgtgtagttatcctcatagctgtcgtcgaagttgtcgaggtcgccgtggtcgtagtggtagccgaagtcgtcatagtcgaggatctcggttggtcgagaactaacgccaggagagctaaggtagccatccaactcttccgtcgagactgtcccaagaggttggagtataacgccaacctccctggatctagatcggatcggggccgaagccggagctcgcctagatcttcgagtgggagatgtcttgactgtgaagacagcggccaaatcattaggaagtttcatcaggattgagggataggacccgtcgtcttgatctggtcgcggaaatgtagattggatctcgtccgagtggtttgaagccgactcgggagagatgatcttggagtaggcctcggccgagttcggaataccgaacggcacagggacctggtctctccccgactggtttgaatccgagtcaaggagagagatcttgcgcgaagtcgttggtgatgaagttgaggctgccgaaccggaacgcctgcccgggagggaaggcgaagtcgtcgatgccagaaacggaacccatcgcacttagtcggcaaaaacttgacgctacccctacctggcgcgccaactgtcgaagcaagatttcgacaataataaaagggggtggctatcaagctaggaaagtggatgggtttggagacaagggattttatacaggttcaggccttcttattcaagaagtaataccctactcctgtccggggataattcctccgagtgtgttattgattgtataaactggaaaaaagaatcgtgccccgagaggcacatggaccttccttatataggggaaggagtccgctttacaaagtaccgtccatatcctaacggaatatggtatcatagataaaatacaatcataaccgactaggatcccgggtattttcttgacatacaagtttagaatctaacccgagtcctcatagagatattctatctatatttggtaccatatatccgactaaattataactgtcatgtagatatggggtatccataatctccacagctaggcatccacggcgtcgggccagtgaaggagctggtaagtggagatgcacaggcggcggtaggggcccgggtgggcggagagtgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttcccccctccccctcttgggccggctcggcccatttctctccctctctctcctctcccccgcagcccattcggcctcctccccgcgcgcgtgccgctgacgggcgggcccgcccgcctccctcgctgacgggtggggcccacccgtcatccccttcctcccgccgctcccgccgccccgcccgcgccctagcgccgccgccgccgtgaatcccgccgcccccgtccgccccgcgtgcaatcaagaggggggaaatattccccgggattccctccctctttccccccatttttccctctctctctccctcggattcgtttggaaactttccccctaaccttgccggcgccatcaatggcggccgggactcccgcgcctgtttgcccctcctccgggcaccccctccctatcttaaccctatataaaccctccgcgtgcctcccttcaacggtttcgccactcatcgctctttctccccgccggaatcgagctcgcgccatcgctctctctctccgccggggccgccgagctccggtccgccgccgttgtcgccccgtaccacctctcccctcggggtcgcctccttcggcttcgccggatcctcgccgacctcgtccacccctccgtttcgcacgccgaccgccggagcaccgtcgaccccgtccacccgagccgcgccgccggctttctccgctccggtcgtcgttcccgtcgtcgccgtcgacctggggtgagccgtggaccgccgattcgtttcccccttccctcccctttctcggccgccgctccgccgtacatatggccgccgccggcgaccataggggcgcgggcgcgccgcctcccgccgctgcgccggcgtggccgccttcgggcgcgccccgcggctgccgtgtggggcccggctgtcagccgcccacgcccttaggtgcggctgacgcgtgggacccacggcgccggccggtgagagcccgggtgcgcccggtccaccgtgggccgtgaggctgcagcgtgggccccaccccccgtggacccggtccgcgcgcccctcccctcggctgacgcaataaatctattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagccggcgtttgggaaagcgagcaaggcaagtcacatcatccttgagcatattgaatcccagtttataaaattattttaatttaaattaatgcattaccgctttatttaaattcccgcgttagcactgttttatttagccatgcctatttacctttgttaagacattattattgctattgttattattaccttgttcacccttggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttgtcttgggacgagctgggacccagggtcgggttgccagttcggtctgaatcatcgtaggccttgggttaaggcaggttcgtgtgggttcacggccttgataaataatattgcatagttctagaatcgtgtttacaaaatagctttgagcaactaagtatctttaaatgctgtttactgcaaccctaaccctttatattataactcccttgtactcccttacatttattatgcacttgtgggtgtgtcttgttgagtacggtggttgtactcagtcttgctcaattttttcccaaacccagaagaggagtatctggaagatgaaggttttggtgtctagctcgtgcctgccgtcaagcgcctgtggtcgtcgccctagtcttccgctgtttctcgtttgtctttgtgtgtgttgggccttcgctgcccatgtaataaattaactatttacgcttccgcttgttgaactctgaattgtatcaacttttggtgtaccttgcctcctgggacaaggaataatgcacgcacgtaaggaacgcccgttgggttatttccggtcgtgacaaagaggatgcgggagacggcgcgggtgagggcgtccttcctcgcgcggagaggacggtagttgaggttgagcggcgtggagcaccagaggtggtgccaccgggaggcgaggacctgcgtgctgccagcttccttggtggggaggcgggcgatgatctcgccgaggatggcgtctgggaggttgctgatgatgtcgacgccttcttcttcctccgcgtccccaatctcgggtgcctttgacctccgcttcttcggactgtgacccgcgttcccgacgtggtccatggctggcgcaggcgggactctatgagcgatgcgagaggacggcggcggccggcgtgcggcggcgtccgatgcggagttagtgcacgggagaggcaaaatgcggcgcgggggattaggggtttcggggaggggaatcggtggccgatgtcttctttcttttttctgtgtgtaacccaagtaaggccattattgggccagcgaatcgacccagcaaccagcatgattcttctttttcttcttcttcttttttttttgttttgacttttcacccgttgctggcaagtgtgtactggaactggaagagaaaattcacagaaaacttcatgactcattcacaatcaagtgtttaagtggcactaaaataatggataaaaattgaagtgtttttgccttacaagagaaattaggttaaataactaaaatcggcgtgcttgtgggcatgcctaacttatagcccgtgtacattatttggatctttcgagcatagtaattttcaagtatttactttaattatttcataacttgtacaataaaattttacatctagaagtagcattttaattaataattttaatcttactttgccagtagtggactattcgtgtatattttttttcttactttgcaaaattggtgaagatgatattaagtacactttttctttctaaatactgtgactttcataaaggcagaaaattttgcatttacacctctaaaaatatataattatgtcttatttttcttcctaccctggactggacatgacctttttataataggtttaaaattttatgcttggtaaaggttcctcaaatcaaagtatacatttttcttcctaccctggaatggacatgacctttaataggtttaaaattttatgcttgttaaaggttcctcaaatcaaagtacatttgactgggcatgacctttaatatacaggtttcaatttttatgcttgttaaaggttcctcaaatcaaaatacgatgtcaaagtgggacatcgtacaatacttgccttgacgtcaatttcattttcaattctcgagcggaaaactatatatgatattaaaacaggaaaatcgtggttaataaaacatattttccgtttctatacactactagaaaatcaatttttcatgacgtttacctattttttctctggcggctataagcgaaaactgccagcgaaaatttaatgaggatgaggtactaataacgctggcggccggattatgaggaccacttgcaaaaatagatgtctttttacaagcgggcctttaagtgaccgccaccgactgcaaaaagtttttcgctatattaaaacaccaagtgtgcgcagactcttattatccactcactccatcttatcctcttctcacatgcgctcgcgcctccctgctctcggctgccacagcaagaagacgacggtgacggcggacaaggcggcaacggcggacaaggcagcgacggcgacggcgaaagcgacgcgcacgaggtgcgcgcggggtggattagtccgtgggatgggcacgtccgggcctccccttgccctccagcgtcacgctgccaacctcctctccgactccaacttgtcccctgacctcctctacctcaccatcgccactccagctcgctccaccctccctcccccctcccattctgcctcccctgccgcaccgcgatgggaggcctagatctgggcggaggggagacgaccggcgggtggcggcgttcgtccacctctctcccctctccaccggcgagatcgatccgccgccaccgctatcggcgcggatccggcctcgtctttgttctcatcctcggcggtttgtccatggcgagtacgacaaagggcaaggaggatggtggcggtgaccgcgaggaggaggaggccgccgcgagccggtcgtcggtggggcccaagaccatgtgcggcatgcatcgggagcgcagatctggtgccggcgacacccttgatttgcaatgtgaatttgatatgtgaatttgtatttgtgacatgttcttgatttgatttgcaatgtggaatgggaatgcagggttgttgcatctggcaattttcaattttcagagaacagatgcattcacatgtttttatttttttttaataaaagatgagcttcactggcagtcgtcttaacaaatacgccagcaaaaatgcaccattgcgagcggcccgcataacacaaccgccggcaaaaatctgttttcactggcggtacgtgtaatagagccgcgagccgccagtgaaaatatattttttgctagcggttaagttccacttgtgaaaactttttttttctctggccttcgatttcaggtggctagcctaaccgtcagcaaagattgattttggccgccaggaaaaaccattttttaagtagtggtatgcatttgatttcagcatttattattttctatttcttacaaatatagatattagtaaactgtacttgcctcatattttaacctgcagtaatcgtatttttatggaaagatttataagcattctagataaaatggtatgcaaaccaaaattagaaattttattctcttctgtatattattgtttatttagttttctaccttttgtttctcttcctatcctgccaatcttatctcttctttcaccgcagtgaaaacgttagcagtacagtagtagagaggagtaaagacaggatacccaagagataatgatatatataggtcagctcgcacgagcgagcggcaggccgccagcagttgcgctctctctctctcttcctttcagctgtggcgagctagtgcacgctgcacgccgtcttggggaggttctatctactactgttgcgctctctctcttcctttctgcgtctcctcgcggtgatgaggccagtaatggcgcgacgggccaagaccacaccacaccgtatcaccgtctcgttcgccgacgacggcgactgcgaaccgatgagcacctcgggcaaggcgagcttgtccggtgagagggtggagataaacaaagtgaaattaagctcctacaatcctatctcgtcgatcactcggttcttatacgcttctccggtcctcgatacgtatcttcattattgcatatacttcagaatatagctataaagagcataagcaaatatgcaagtgcattagatagagccaacacgtactgtgtgattcagttccctgaatttactaaacatggaacacaagggatgaaaaaatggccaagaacatgatgctaattaattacacaaatttcactgaaataattgtacatgaaagaaaattgtggctacctgaatctctatgatgccaagttttagcatggagatgccaagccagcccatgatctccagctttgatgcaacaccactgaaatggcttaggcacggacaagatatagcaatcatttgcgacaaggggcatccagggtttgcactttcgttagccaccgaatatccactatttcgctgaccgaaattatttgaaatttaatatattttgactgaatttgaccagattcacaaatatttgaaaaaattcgaaaaattcgatggaggtttgtgcttgccagttggtccaaaatttcaaaccatgggggtatcctcgacaatgacttcctccaacgttgaccgccttccgtagccaaccagcacaccgatgctctaagccttggggagctgattcggacacaatggaagccatatatgtgttccagcagcaaggtctctaggagagggcaggcgatgatgatggcatgtagggcgacctcggagagggtgatgtacttggtcgccatcatgaatgcatgattttctacgcaagaatgtaacaggtcatggggatggcaattaagatccttaaacttccatgcatcctagtagctaagtaaagcttgaaagactaggttaacaaattgtagctttcggttccaagaaagagaactccaaaaaatcgacccaagttcttgtgaacttgcacactttgtttctctttctctgttttgctctatcctccttgttggaatacatcacagtgagtgagaaattgagtgtgtgatcaatgcctaaccaacaattggtataagagcaatgtcgatcataataggggacgctcgttgaggggggggggcacggggaatgagttcctctacacacaactgacaactggcaactacacctcctggttgatttcggtgcgggcgatgatagatgaccaaggaatttggaggcgttcgatacaacagtcgggatggctattcgatgcgaagaagaagacatctgctcaatcacctccctgattctttggtcctccattatagcctgtacttgaatcacccacctggtgtaatttccgccattagttgcgggtagagttactcactcttcatgttgcgtccatcatatcatcacgattgacatggctttgataccaatttttggctatgcacaagaaagcacacccaattcctcactcagtattacgtattccaacaaggagaacacatcaaaacagagaaaagcacacaaagtgcgcaaattaacaagaacgtggggaaattttttgcgttttttttcttttcttggaatcaaaagctaaacttgctatgactcacacttacaacctttagttactgctatttatagaactcatggaagtttaaggattgtgccatctcacggccttgtctagcatggttatgaggtgagttcgagtagagcttgttctcaggctagttcaaagcgggaagatggttgtgaaccacatgggggctgagcactgaggttatcgatggcagtaatcgacggccatattggaagaaatgggtcaaatgactactcggaggtgataattttggcccagcaatgttgggtgggtgggcctatgcaacaaaatatgttatggtgtggaatcttaaaactagagtgataattgagatagtttaagttatttttccgtggagaaaatacgagcgtgccatccatcaatgtgccgagtactaacactctttttccatattctagtcttgtctgggctgctaatgggtccattccaacatgcccttttgtgtttctttttctctcggcaccatttttttctacactactaaaataactctaaaaccgacacttatatgtactagttaatctaaagccagcacttatgaccctttcccaccccccgaaagtatataaaagtaaaaaaccggcacctttgaccccttataagtgtcggtttattaacatctttaataaaacaacacttataacatggttattggtgtcagtttttttaaagaaaccgacacctttggggagccgagttgatgaacctcaccgattttttctgggcgacttgagtctccactcattcactctctagcagccttatgcccccttccttacccccaacactcaactacacaccagctcacattcttatcctctctagctctccctccccccctctatctatctatctatctatctaacaacagcgaccggtggcggtggctccatgagacgacagcggtggtggcggcacgcctgtacccggaaacacgacggctccacgacgacgacgacaatgactccactaggacggatctctaggaccggcgacgcctcgacctccgcttctatcctctcccaggcagcggctgtggctatggcggtggtgacaacttggcttaaccgggatagatctctggtgctggagatgcctcggcctccgcttttggctcccgtacaatctcctccaccgcactgaagggagccaccacaaccccttcaccccggtggcttggccggtgctgcagggattcgccgtgctggtgacgaagccgaggaccctgactgctcactcttttccaactggtaccccttttgcttttttgcattgggatttctcaattttttgggaagggaaaatgtgcgggatttcatgttgtagggcctttgagtttgtgttggatccaaacatgaattgttgtgtgcaatgtagctaccttattgttgtggattcagatgtgataaatgtattttatttgttcttccatgagatgtaatgaatattcttgatctttctttcatggcttcttgacactggtagagaaagcgtttgtagtcccggttcgtaatccccctttagtcctggttttcaaaccggcactaccaatccgggactaaagatcgctatctttagtcccgggtgaaatacatgcactacttgtttcaatacatatatatgcacataatatatatatatatatattatatttatatatgtttcaatacatatacacgcataatatatatgtatttatacatatatatgttatgcaaatgcatatgtatatatatatatatatatatgaaagcacttaacattttatgtgcatatatatatatatatgaccaaaatatatatttacattaaagaaaatgtgtacatgcatatagaaaaatagacatgtattaattacaatccattatgatgtcctagctagctacgattttgacgtagtagtagtcgttatctcagaagcgctaaggacctatgaattgtatttccgttgtagtagaattcacccttgggatcaaggatttgttcgttgatgaatcccatgagttgttcttgaaccgccgcgataaattccttgtgtgtgatcaggttatccctcatgcgaataaactataatgaatgtatgaaattaattagtaactaaacaacaaatcaatacgtacgcaatgaaaatttgaatttatttgtacgtacatcgagctctcttgtggtgatgatttggtttgcaaggcagtggcaatactcacacacgtagtagccgcacaagttagttccctgcttttgctttgcgcactacaaataaatgacaaacggcgagagatctaattaatataaatgtagagcatgtgtactcacaggaaaattgaacttccgcctaagtctttctctccatttgccgcggaccaaatgacggaaccgataccaagccctacatggagtttaaagctatgattcgtagtagcaattaattataacaaaattcttaattaacataggaacttatgacagtacctgtctataagttcgaaaaccttgtcaaacgtagactcttttttatccattgagtcatatacgttgacggtgcaggcctccaggtcgaagagtaaaaggacccagtggaatctgcaatgtgcgtgggatacattacatatgaaacacttagaatgttcgtacgggaatgaaatttggtataggaagacagtaaaattaaactaactctgtgttatatggcaatagtatgaacgtcttgtaatgctgcgcctttaggagatggacgagattgtcctctgtggcttgcagatactggtcgagcattgcgacgtttactttccgagggtcgatgaatccaatatcgaaaaccccccgccgtcggaccctttgaatctccattctacaacgataaaaggaagtatatattatatatagtctgcttatatacaaggacctaattaactaaaggaaacgtaataagaaatctaactgaacgatacttacaaaatccagcaactcataatagaggcatcgagggcgtccagctggtatagttcgtagatacccttgaaattgatccagagaatgtcatctccttgcaagaagtccgtgtccctgatcctcgctccgatcatctctctaccggtggcactcatctccatgtacagttgatggaacttgtacatttgtgtgggtaaggactgcagctgctcaagcttgacaagcggtttaccgagttcgtacatgtatttcacttccgccttttcgattggtgcgcctcgtagcaattgatccgtagttagcccggtgtcagtaataaatttttctattccaaaatcttcaccagtcaccaacggctcgatctcctggtttggttgctctccaagctgagggactagtttggactttccagaagatgctttcttgagtgttcgctcatagtccgatagctttatggcctccttggcacgtgcagacatacccctgaagaagttcctgacactcgggtctataggaatcttcttttctggacttcgaggcttcaattgtctcctaacttccgatgccacataagcgtcaagctcctcttgcgtgcaatcgtaccccgggtccttgttcttggcggcgtcaactttcgccttcttcgttgcccttgtgggggcaggcgatggagcttggggggcccttgacttggaaggtgccagacgaggagcttgaggaggagtcggtgcaggagcctgaggaggagtcggtgcaggagcctgaggaggagacggtgctggagcatgaggaggagacggtgcaggagcctgaggaggagatggcggagctggaggagatggtgcatgagatgccgcttgtcgcccagggaggatgatataccgcttgcgccatagtataatggcgtggcttgtgtctcgtagatgcgtctcaccgtctcctccagggtaatccaactcgaggtcctcgtacgcaccttcgaccaactcaacttcgaccttggagtatcctgctggaatcggcctgcagtggtaagtacctgaagggtccattgggatggccatgcccgacgccaccttcacgtggtgagaggttatttattagtaatcaacatatctaagcagcaacttgcggaatggacaaatctaaaatctgtaaactacgagtttacctttattgataagttgttgaagggaatatgcagctcacatggtgtccgctgagtgatgtcatcaacggggcaagtggtttcgtcctgggtttgcatggcgtccatgctctgtgatcctacctgccccgttgaggcgcagctgctacgacttcctgaagggctcaccattgcaggaggaatggttggctggggatcatgggaccgatgtgtggccatgcgttcatcaaccttccttgccacctcctcttgcatgctgagctcgtagctcgataccctgtactcaagatctgcaatcttcgtctcggtatctctcttgctcctcatccgactcctgtacgtgtggatgtcctccttgaatccaatcttccaaggaatcacccctttccctcgtgttcgtcctggatgctctagagtctgcagggcgagtgacagctcgtccttctctctgtcgggtcggaacgtgccttgagaagaggcttccactgcatccgttagtcgacgcgcagcctcgcgtatctgatcgctgaagaccagggagccatcaactgggttaagcgtttcaccgtgagcgtagtaccagaacttcaatcgatccggccatttagcggtggccggttcgatacccctctcaagcaagcttgcctccatctcctcccacttcggcatcgcgacgctatagccgcctgaccccaagtggtgatggtacttcttcttggcagcattttctttgtttctttccatcatcgtctgcccttgttgacctgtcttatatgcaacgaactcgtcctagtgatcccttagctttgggaatgtgtcaaagttcggtgtctgccccttcaggatatatttctagtacagatctcccttgaagctttgaaactgttctgccattttgtctaaaagccaccttttcactttgtcctctgtacccgcaggaagggtgaatgtctcgagcattgtggaccacaccatttttttcttcgaatctgggacaaagctctcatgatctccgcgtgcccttgttcttcgccagtacaccgtactgacaggcacgttatcccgcacaacccaaccgctgtgacgtacatagttcttggcggctttggccggggcactaggacgtccaacttcttccactttcgttatgatgtgccgaccctcaagcttcttcgctccacctcgttggccgcgtgccctttttttgtccaacggagggtttgactaccactagcctcctcctcctggttcccctccacatccctttccacgtgcccctgctggttcacctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgtgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaacttaaataatattacatactaagactaaaatagtcatgtatatgctaagtgtttcgtgcgtatatgctaagtctaattaagactacaatagtcaattgctacttgtcgcaccaatgccgtagtcaataattacataccaagtctaattacaaataaagtaatattatattaaaactcaaataatattacatgctaagactaaaatagtcatgtatgctaagtgtttcgtgtgtatatgctaagtctaattaagactacagtagtcaattgctaggagtcgcaccaattccgtagtcaataatgtcatactaagtctaatttgcaataaaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagatatcaagnnntcagcgcatcattctgaccaccatc

SEQ ID NO: 10266 - DNA, 1002 bp, Oryza sativa
  unsure (1)..(1002): unsure at all n locations
gtctaattttttaaaagaaacattgtagcttccattttttagaaggagcaaagaaatctttaaataaaggaatggttgggcccaacagatgtaaatataaacaccataaataaaaatttatttggggaacaaaataaacattaatagaaatttaaatttgataatcctaaacaaaactctccgtattaattagattaaacaagggaaaagaatatagatttttagaataaaatgaagtaataaaaaattaaaagattcgaaatctaaagtatatattaacaaattaaaaatagtaaccttagacgatttaaataaaaaaactaacagaaatataaatgctcaatataaagaggagcgaaaatataaacataaataaaactatatttttgaaaaaaaataaaaagaaaggatacttttaaataaaacaccagaaggaataaagggagatatttagaaagaagattaaagttaagtaaatgaaagagtattttaaaaatgataatttaataaaaaagataccaacattaaattgatataatatatattaaaaggaaaattaaaagatatagtacccttttatattaacaagtttattacagcagaaattggaaaaaaaaacccatccaatggtttttgacccccacccgggactaaagatctaggggtatatatattcccgatgcgcgccctcgtcttatccaccaacacttagaagttttttctccgatcgatctctttctcggcttctctttcaccgccactgcttacggcatccccgcaccgacgccgccgtcgtatctcgccgtcgtctcgcgtacgtcgtcgtcgccacctctgccgccgccgcatctctggggtgagagccgccgccgcctccctctctctctcagacctcaatctctctctctctccccaaaccgccgtcggccgcctcgttgccgannnnnnnnnnnnnnnnnnnnnnnnnnnnnnnnngtgcataggatatgctatcactcatcg

SEQ ID NO: 10267 - DNA, 1215 bp, Oryza sativa
  unsure (1)..(1215): unsure at all n locations
tgatgtgcctttgatttgacatgacaactggcacccngcnnaacactcacgcacaaagcacattgatattcgttttcactttttgagggattatgttgagaagggagatgttgaattgcagtttttggacacaaagttgcaaattgctgatattttcactaaacctttggattctaatcgctttgcttttcttcgtggtgaattgggcataattcatcattttggcatgatttgagggggagtttgtacctcatggttttatcaagaaataatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagttccttggcgctttctgttcgaccttgcgttacgataccgtcgccttttccttgggagcgtggccttttatacttacgcttgagtattaatcgggtaggcgttcctcaagtgggttgtgcacaacccccttaaacccacctgtgctttttggaactatggttgggccacccggaaaaacaattttccctgggcaaccctgttacagattaaaaaaagggtgtgcgcgctccaaatttgaaagtggcccactcgctacctcaaaaatattgttttcctttttgaccctccttcaaaaaaaggtgcttttcgccaaaacaccctggcggggcttttttcgaaccttcccgcaacaagttcaaatt

SEQ ID NO: 10268 - DNA, 793 bp, Oryza sativa
  unsure (1)..(793): unsure at all n locations
cccctgttggttgcgaaatttcgccaagcgacgctttgtgcgactccagtactttgtgcttggtttccaagcggatgctcttgtcccccagacgttggaaatccggatagtccccggagactagcgggacggacagctcaggatccattcctgccaagaacttctcctgcttttcctcatcttcccgtacatcctccggggcgtaccgggccaggttgttgaactcatgcaaatactccatcacggagcggttgccttgcttcaactctcggaactcccttttcttaagggccatgactccggcgggcacatgggtcctccggaaggcggcggtgaagcgggcccaagtaataggttgcccctctagttgcgtagcctggaaatggtcccaccatagagatgcgggcccctgcagttggtgggcggcgaagatgactttctcctcatcgctgcactgcacggtgtctaactttttccccacggcatgcaaccaatccaacgcatccacggggttgttggagctaaagaaggtaggtggacggatgcgtaggaactcggcgagtttagagtgttgtgggggtggtggtctactgtgggagtcccggcgatggagaggtgggttatcacttagaaaatgttatcatcgaatttgctccatgtcttgaaaagttgctccatattgaacgctcgatgggacttggggttcgtgtatccgtgattatggcacccaaactggagacattnnnnnnnnnnnnnnnnnnnnnnnnnnnnnnnnnnngtcctaatctcacac

SEQ ID NO: 10269 - DNA, 1831 bp, Oryza sativa
  unsure (1)..(1831): unsure at all n locations
ggaagctcaagagtcgacaaatgggtagcangnatgaaatgaatgaggacggtaccacgatgancgtctgaagttgtcagcacgtcttcgnccgtcacgtggttcacacgacncngaatgacatccttaccacgttgttgagcgggaaggcgcttgcccttgctggcgcctcgactttgggcatttgtccgcaaagtgcccgggctcgaagcagttgaagcacaaacgctgcggaccttgaacgtccctgcggccttgaccagactgcgcggctggcgtaggaggacggggcgcatgggtcccttgctggctctgctgttgctgcggctgtgggacgcgcaccacgaattgaggtcggggcgcggagcgaggttgctgctactgttgttgctgctgcgaggaggatccccctggatagggattggtgtagcggatcctttggttagctccctgttgattgcgaaaattcgccaagcgacgcttgtgcgactccagttccttgtgcttggcttccaagcggatgctcttgtccaccagacgttggaaatccggatagtccccggagactagacggacggacagctcaggatccattcctgccaagaacttctcctgcttttcctcatcttcccgtacatcctccggggcgtaccgggccaggttgttgaactcatgcaaatactccatcacggagcggttgccttgcttcaactctcggaactcccttttcttaagggccatgactccggcgggcacatgggtcctccggaaggcggcggtgaagcgggcccaagtaataggttgccccactggctgcgtagcctggaaatggtcccaccatagagatgcgggcccctgcagttggtgggcggcgaagatgactttctcctcatcgctgcactgcacggtgtctaactttttccccacggcatgcaaccaatccaacgcatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctgggcgaggatttgggtgagaatggcgttggtgtctggtggtggtggtggaggcggtggaggaggtggaggtgggctgccatggttgttgtggttgctgccttcaggttggttgccatcactggtggcagcatttctcctggtcgtcaccatctgaaaaccccacacagaaccaccaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgccccacaagaccccaacaagaagacaaacgagaaagaacacacgcgcaagcctactaactgctcgtctaccgctgcgacgggccaggacggaaggtgagcaacagcgcatcctccgtgctactgacgccggaggcttccccctcctgaggaaccacgggcgcgggctcggcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10270 - DNA, 3186 bp, Oryza sativa
  unsure (1)..(3186): unsure at all n locations
caccccagggacttacgaacaagctcggggctggaaggtactctttccggccggtgatctttttggctccggcaaacacgcaagcgctttgggcgacaaaccctctccctgggcgatcttgagctgatgcagttgcgcctccactacgtctaggtcgttcttcagctcaagattctcctgacgcagctccaagatcttcatgttgttctcgaccatcccagggcgcaccatctgatggaagtcgatacgagccgcgtcgtacgcctacaccatgcgcgccaggtgcatgatggtagcgtcatcctccgagctagcatcccggaaggtggcgtagtcgcgggctcctccgcggcgagggtggtagcggtagggcgagtgctgcaactcgtccaggtagcgctggtgaagagtgccgatggcgaggagagcggcgttctggcaagcggcggagaaagaatctccacccgcggtgactgccaacgaagtcctctcgggtgagccagtgaggatcactgcagtaacctcccaagcagcgtggggctctgcatcatcaccctcctgctccgggagcggcctgccctggtagtccactccatgcggataccccagggcaacgcacatgccccgcagctccaagacgaagctagtcaggtccagaccacgacggctgacgctgccggccatctacaaacaaaagcaaaaagaaaagcaacattttaaaggtcagattttgacgataaatgaagcagcaggacggagagagactagaggattttcacaaataagaaatgatttttattttgaaaatattgctaaggcttgggatctacagctcatcctagggtcaagggggctctgataccaacttgtcacgaccggaaataacccaacgggcgttccttacgtgcgtgcattattccttgtcccaggaggcaaggtacaccaaaagttgatacaattcagagttcaacaagcggaagcgtaaatagttaatttattacatgggcagcgaaggcccagcacatacaaagacaaacgagaaacagcggaagactagggcgacgaccacaggcgcttgacggcaggcacgagctagacaccaaaaccttcatcttccagagactcctcttctgggtttgggaaaaaattgagcaagactgagtacaaccaccgtactcaacaagacacacccgcaagtgcataataaatgtaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagacaacccaggccaaccatttcacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacgggcggaacccccgggacaggcaggcaggattgagccccctagcagcaggacaccagccctgtgccatgacatctcgactaccgggccgcagctcgtgtagcctttatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccacgaatagagtacccactagttggggttttatttattctagggtgaacaaggtaataataacaatagcaataataacgtcttaacaaaggtaaataggcatggctaaataaaacagtgataacgcgggaatttaaataaagcggtaatgcattaatttaaatcaaaataattttataaactgggattcaatatgctcaaggatgatgtgacttgcccaaacgccggcttcaacttccacgaagagcggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattacgagttcaaatggccaagttatggccatttgaagtttatatgctctttaaatggatatttacgaatttcttcatttaaattttaatttaaaattggatttattgcgtcagtcgaggggagggggcgcgcggaccggggcccacgcggcagcctcacggtccacggtggaccgggcgcacgcggctgacgccggccggcgccgtgggtcccacgtgtcagccgcaccgagggctcgggcggctgacggccgggccccacctagcagccgcggggcgcgcccgaaggcggcctcgccggcacggccgacgggaggcggcgcgcccgcgccccgatggtcgccggcggcgacctccggcgcgacggagcggcggccgagagaggggagggaagggggaagtgaaacaacggtcctcggctcaccccgggtcgacggcgacgacggaaacggcgacccaagtccagagaggcggcggcgcggctcgggtcgacgaggacgacggtgctccggcggtcggcgggcgatacggaggagtggacgagnnnnnnnnnnnnnnnnnnnnnnnnnnnnnnnnnnnnnnnnngatntagatttcaaccgc

SEQ ID NO: 10271 - DNA, 931 bp, Oryza sativa
  unsure (1)..(931): unsure at all n locations
aatgcttggtactgatgttgttgttttatcnctcttctctcaattgtaagantatatttttgtctttttttcttctatttntttnnnnnnnnnnnnggcgtgttgttgatcgactccctcacganagcgcgaanncnagctcggnacccgaccacaccacggggcaccatctgatggaagtcgatcgagccgtgtcgacgccttcttctgcgcgccaggtgcatgatggtagtgtcatcctccgagctggcatcccggaaggtggcgtaatcgcgggctccttcgcgacaagggtggtagcggtagggcgagtgctgtagctcgtccgggtagcgctggtgaagagtgcccatggcgaagagagcggcgctctggcaagcggcggagaaagaatctccacccgcggtgactgccaacgaagtcctctcgggtgagccagtgaggatcactacagtaacctcccaagcagcgtggggctctgcatcgtcaccctcctgctccgggagcgttctgccctggtagtccactccatgcgaataccccaagacaacgcacatgccccgcagctccaagacgaaaccagtcaggtccagaccacgacggctgacgctgccggccatctacaaacaaaaacaaaaagaaaagcaacatttaaaagtcagattttggcgataaatgaagcagcaggacagagagagactagagagttttcacaaatagcaaaggatttttatttttgataatattgctaaggcttgggatctacggctcgtcctagggtcaagggggctctgataccaacttgtcacgaccggaattaacccaacgggcgttcctttcgtgcgtgtattattccttgtcccaggaggcaaggtannnnnnnnnnnnnnnnnnnnnnnnnnnnnnnnnnngataggctataccacgcgcg

SEQ ID NO: 10272 - DNA, 1177 bp, Oryza sativa
  unsure (1)..(1177): unsure at all n locations
cgcgtgagtgtcgtatcnnnnnnnnnnnnnnnnnnnnnnnnnnnnnnnnnnnctacgaatccgaaactatttatagctatctttagtccgggtgaaataaccggggtgtaactttaaccggtactataaatacagtagagtcatcaccaatttgttttctttttttttcatttgttttttgtttgcatattaatttcgcgtcaaaatcacaaatcaaataaacattcacattcacagatcaacgctaaattcacaaatcaaataaacattcacagatctttgatatcacaaattcacatactcaacaataaaattaatcgtccacaaattcacaaaaaataatcataaacaacaccatgcatttacacaacaaaaaatcaacacaacacagatccgccgccgacccctccgagccgtagtcggccaccccttcgnccgtncgnccacccgncacctgccgttatcttccactccacctgccgccacccttcacggccttcatggcgtgctgccatgcaccaccgccggccaccacctgccaccaagagagaagcccgtgaagagaagaagaaatcgagaggagaggggagatgagtctggcgaagggataagacgtgcgcggtggacgagaagatagtgtctcgagagtgaaggtgtgcggctatattttttttcaaatgtggtcctagttggtataaacaaccgggactaaatatatatctttaaaccggactaaagatagtggggccggatgactttttaaactgggactaaaaatgatctttagtcctggttataaagatcaaaaagttcccttgggttttttaactgggactaaaaagaatctttaatcccggttcctatttgaaccggggctattgttccactagtgattacgtgtctataaaatgcatgctatagcggtatagcccaagtctcagagctatgtattcttacacgcgtacaacctcatgttgaaatggtggttgaattaccgactaatttcttcctgtatatgttgatagttgcgtcgattagttttaaattacgactgaaaatttaaagagatacacatccataattgaagaattgaagataaaaattacggtacggtcannnnnnnnnnnnnnnnnnnnnnnnnnnnnnnnnnnnataggataaatcacaaaacccatca

SEQ ID NO: 10273 - DNA, 5838 bp, Oryza sativa
  unsure (1)..(5838): unsure at all n locations
nattgcagtaaaatatagtgtttgaatatacatagataaggttggggtatagtacatatggtgcatcctatttcatcagcatatatgagcattatgcagtacatcagtgattaacatgaaaaaggtccagtttttgtccctcagtactttacaccctaacttcaagtaatttctaaaagatgtcattcaacaaataaaaaaccatgcacatcacatcctggtgatagttttgaaggaggtttatatggatcctacatggtgtgtgcccgtgtgctagtgaggtaatgtggcttcataatttagaaaaggaaattagttggaccattttccagaggacgagtggataccatgcgtcaaaataaaatgatggtgcagaaaccacataatcctatgcacaaaacccaaataaaaaaaaagaaacataaacagctttggatgcaatttgctccagttttaacatttaagggaaaaactaaaagttattgaaaaacatggtgaaaacaactaaattaggctccagtaatagttgaaggaccaaaagtggacattttacaatgaatattttgtgcaggcgattttaggacatgatagagaactggacgaatgatatacgggaaatggatgatgctgaagttaactgatatatatacctggcccagttttacatctcccctctttggattaaaaaggacatgaatattcccaactactaacttttgtgctctattaagctgaaacgaaaacaggtaaggaaaaagacaataattagtgcacccaatgtattagcattaaaacagtagttacttaattgtaatgcaaggacatctgaaaacaaataccagattaaacagatggtgctaatttggaaattattttggacacaatatttggtctggaaactaattttaatgcataatatgagctaatactaaaatactatgttaaacttagacaagtgtaggtccttctaataaagataaggctcgtagatagtgtccggaattggggatgggaagaaaccgacagagaagtatctaagtcatcccttctctctagtttcctttagttttacccagcaacagggctcaggacaatattaaataggaaagcaccatttctggaacacatgcagtgattatacactaggtgctgccaggatgtaagtgatatactctccttattttatcctttgaacaaactgctttattgtaaaccaaagtacctcaaaaacaaatatttgagcaacattattacgtaggttgtattcactaaaatcaatactgtcttcctcaagcagatgtaacctacatttggaaataaagaaagaatatgaaaatgcgacttggtttaaaccaatgaaggtaacaaaggataaaatccattcaccatacccttttgacttccaaaaggtagcacatccatctttagcatcaccagttcggccctaaggatgtcaccagacttgcttcagcatgatgtacatgaaggttgaaaggtggcattctgacaaaaatgttataccttaaatctactttgataacccctgttctccatttctgtagcaatgtctcggaatctatccacctcctaatttcggaatcacaaaatgttataggagtacggtcgcacaagtggtataaacatcatgcagattgagttctgacctgtagacacactaggtcaggatcccagtgtctaatttcacgaataataagcctcctccgcgaatcccacctcattgcatcccaagggacatccaaataaaggtcaggatggtaatgtgcattgttatccgccaagatgttgtatgacatgattgtgcacgcatctgacaaaagctttattactcttagtattacactaacaaagccagaatggcatcatcccagagtaatacagctccatcaacccaaacagatgcaagtcaaacaaaaaggacgaacaaaaatcacaactttaggggtgaaattggcactggttggggcgaagcttcatacttgcactagctgggtcaactgatttctcactatttactctagcaaaactagcaaagagaaaaaaaaaagaagcaaaagtgcaatcttcactcagacattggcacaaacagatggtgagcaaaggcaacaaaatttcaccaacgatacatccagcataatacctccgtcggaggtcgaggcttcctccgcaaggacccacctccgggagggcaccccgtactgctgcgcgcggtgccgctgataaacgcgaccaggcgagcccgcggcagggctctgccagcggcggcggtggtcgcgcggcgcgccgtttccggaggacgagcaacgcaccagcgagcccgaggccgggggagagcgcgcgcgcttcctgtgggggtgcatggccggcgtcggcggcgtgagccgcgatcgcggggcggcggacgccatcgccgccggcgagatgtggcggtggggagacagggaaggaggacttcgggttttcccttcctttttttttctctctctctgatgaactctgttattcgggtttctcccatctagggtgtatcgaaaaatctggaccgtgcatccgctgatggacgatacaaatgcactgcgagatgtgtcgcaaatttgcaattcgtttgaaaagataaagtaatttttttttgtttttttggtgttgaaatcaagaaatttgttctgtcatgtactcctccatttgatattttcattttttttccttttttctttacaaattaaacataatttactaatattattgagaaaaaattggttatatagcatcgaaagttcacgtttttggttttatatgtatttatatcaagggaggtataaactgtataaataacccaatcacatttaggaaagagaaaaataaagagaaaaggccaacatgcaatatgacatgactagcattggtcattaggcttgtattcagtgaactatttgagctactgtcttcctaggaacatcagggtttatgtttcgagggaagaatatcaggatttggtgcatccataaagtaaaaccacatatattgtaatttgttttaaaagaattttaggttttaagagtttggggggggtttataaaatacaactaaaaagattatgatttgtttaaaggaactctaggcctgttcactttgatgccattttcaaccttaccaaattttgccaaattttggtaaagttaccaaaaaaaagtagctacatttagtttgctaccaaattttggcaattatataagaaatcctgccaaaattttggcaagttactaaaattttggcaactttgccaaaatttggtaaggttttttttggcatcaaagtgaacaggccctatgttttaaaagaaaaaaaatgttccgacaaactctatatataaacttataccatcgatttacctacatatttatctataatattattaaaaaaaaattaaaatacaacggtatcaataataggaaccggtgttctcttaaaaaaaatttcaagtgtatgcaactacaaacaccatcatttagtttatttaaggaataagtcaaacagcatatttacaaataaaaaataatttgtgaataaaacttttttatatacgtatacttagcgatctaaaaacaaaaactgaaaaataaactacgatgaaaaaaactcaaaatcaactccaaatttaagattgaaaaaataaattttaacttataagtataaacataagcgaaaagatgaggatgtacacttttattcaataacttaaagaacgcggacataagccaccattaaagaatacatttacagtttcacacacttgacaaaggcctacggtatatccatgaaattagggaaaaaagaactcctgtagcaaatcacacgtaagttgcttcccagttaccatcgcccgtaacttcatttcagatgcacttacacggttacaccccaacaatacgcatactgcataacatcttccgattcccagcagaacatcaagattagaactattgcaaaccaaaagcaacttgaggatatcagtcgcggttattcatatttacaatgttctgatcagtccacgaccaaacagtttgcatattggaaaagaaaagaaaacatacacgatgacaagcatacagtaactaacaagccaggaaaagcacgcatctccattacatgtttgaagaaactaacgacatctgaaagaagctgggattgaaccaagaacaacaaactacggagttttatgcgacgatagaaagttaaacggcagtggctgaagcaacggttttgaccatgctttccccaagggctggaccaaagccgttatccaagacaggattggcagaggcaggagatttttgtagagtatcttcatatgcagcatcatgaacaccaagagcagcacgaccagatggatcaaggtttttggaccaggctgcgtcccattcaacagctttagcagtgctgcacgcgacgctaggacctccaggtactgtcaacctagcagcattctgcataaaaccgaaagttaattagctagggcatagctcagcatagtatgagaacagcaaaagttgatagtatcttccatgccttgggaaagaatttctcgaatattgtcctataatagtacgcttcttttgtaactggagtgttttctgggtaaacaaagctagcgttcatcatcatggaatctgatacctgaaaatgaacagaaaaatatgtgaattccagcttaggtcagaagaaatcaaacaaactgtaggctaaaaaatgaaaaccgctaagttgtcaatagttttaaaacagagaagacagtatacatgttcatttgcatgatccttcaatccatcaatccaactgtacccaacaccatcactgaattgctccttttgcctgtatagaatgtgctgtgcaagacgaataaattataagtttaagcacatatggaagtttatgtacattataggtcaaatacgactcaaaaagtttaactttttgcaaccttaggtaaatagggcttctcctcatcatcaaatgcattccggagaacccatttctcaatacggccaagatcacgttttatctaaaatttacaggataataagtgttagaaagtgacagtactggttacaatataagaaaaataactgcaataaaagttgatgtccggtgtacataccattttccattcaggatcaatgtccatagctacattgatgaagtttttgtcaaggaacggaacacgggcctcaacaccccatgcagaagttgatttgttcgctctcaagcaatcatataaatgaagggcttttatctaaaggtcaagaaaaataattcttgtaagtagaccagctactgtaatgtgcataaacaccaaccaaatactagttaagtagttaaactaaaagtgcaatagtatactactgaaaatgcttcaagaatacatttagctgccttgggcagaagaagattaatcatgaaaatattctccttaattaccttccgacatgtttcctcatggaattccttcttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttcctncagtgcatcaatgccttcctggtttcattttttttttacaatatngaatcagagcttcaaaagaatttttttctcactttgccaaaaaaacagagaacagatcagaacctgcactgtgaagtggagttcgtgatgaacaan

SEQ ID NO: 10274 - DNA, 4472 bp, Oryza sativa
  unsure (1)..(4472): unsure at all n locations
tttttgcattaattaagtacatcagggaagccaatgatttgagagtattccagttaattcctagcaattcttcttattcttgcaaacaacaagctagaatataaggtgttggggaaaaagggggaaaaaaaagggggggcctttttaaaccttaatccaaatggtaggccaaagcgattcaagatcttctccacataatgggactgcaagagtgtaatctcattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctcacccccaccatggcgataatacacacatttatctgcctcattgactgcaaagcttgcagatgtcaatgttttgtcaaatttcttatgccatttcttatgagcttgtttcagaccatacaaagacttcaacaatttacacactttgccttcttgaccttcaactacaaacccatcacgttgatccatatagatctcctcatccagctctccattaagaaaagctgtcttaatgtccatttgatgaacgagaagaccatgtgaggctgctagggaaagtagcacacgaattgtggtcaatctagcaacaagtgagtaagtgtcaaagaaatcttcgccttctttctgagtataacccttagcaataagccgagccttgtacttttcaatagtaccatcaagcctgagcttcttcttgaacacccacttgcaccccacaggtttacacccatagggtcgctctgtcacctcccaagtcccgttagtgataatggaatccatttcactacggatagcctccttccagtagtctgcatcaagagatgcgtatgcttctgaaattgacttaggagtgtcatccacgaggtacacagtgaaatcataaccaaaagacttagctgtcctttgtcttttgctacttcgaggagcttcactgtcatcctccttagtaacatgttcatgtgtatgttcagtttgttctggtggtgtgattgaactgggaattatttcagagggttggctagaactactatgtgtatccttcattgggaaaaagctctcaaagaaggtagcatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcaccctcatgtgcgcaagtaagaaagtgatggttttctcccaatccatatctcatatggtgttttgtccttatttctgttaggaactctgtttaacacatgattcgaggtcaacaatgcctccctccaccatgctttaggtaatcccgcggtgtccaacatggcattcaccaagtcggtcagtgtgcggttcttcctttcagcaatcctattagactcgggagaatagggaggcgtcctctcatgtataataccatgttcctcacagaataagtcaaactcgtttgagaaaaactctccaccacgatcagacctaagtatttttatctttctgtcaagttgattttcaacttctgccttataaattttaaaatagtctagagcctcgtctttcgttttcaacaagtacacatagcaaaatctagtagcatcatcaatcaacgtcatgaaatatcgttttccacccttcgtcaacaccccattcatttcacagagatctgagtgtaggagttctagaggtgccaagtttctctcctcagtagccttgtgaggcttgcgaggttgctttgattgcacacaactatggcacttagaacctttgacaatggaaaacttaggaattaaacacatgctggaaaaccgagacatcaatccaaaattaatatgacataaacgtgagtgccatacattagcctcatcatccacactgccacaaatatggttcacagacttattgcagaaagcagaaagggaaaagcggaacaggcctccgcactcataacctttaccaataaaatatccatgtttagacacgactactttattagactcaaaaaccaacttaaatccgtctctagtcagacgggagccactaacaagattcttgtcgatagaagggacatgctgcatgttcttcagctgcacgatctttcccgaagtaaacttcagatctaccgtgccaacatcatgaacagaagcatgtgacccattccccattaggacggtagaaccccgtgcgacctgataagaagacaataatgagatgtcagcacaaacatgtacattggcccctgtatcaacccaccaattagtagactggttaactgaaaaaacagtaggtaaattaccatacccgcttccatctccagtgttgccaatggtcacattagcaaacttagaggtctgccctccaggtgccttcatccccttgcgttgtggacacttcctggccagatggccaggttgaccacacacaaagcaagtcctctcatcctgattaggattgctgttgttcttcttcttcttgaagttggtggtctgctgagctttgtatttccccttgctcttgttctgggcctggtgcacaacattggcaatggactgcccaccatcgcccttagacgccgcatctttttcccgagctttctcctcaacatcaagagacgctatcaacccctcaacggagtattcctgtctcttgtgtttgagtgcagtaccgaaacctctccaagatggaggtagtttcgcaataatgcacccgaccacaaatttgtcgggtaagacacacttaaggagttcgagttccttagccatggtttgtatctcatgagcttgttcgactacagaacggttgtcagccatcttgtagtcatgaaactgctccatgatatacagatcattgctagcattagtagcaccgaatttagtattcaatgcatcccacaactccttagcgtcggtcatatgcatatacacctcgaccagatgatcgccaagcacgctaagaatgcatcccacaaagagagtagtggcctcatcgaattctttctgctagtcagcattaagaacgcccataggcttgccagtactcacccagaagcatttcatagctgtcagccacagagtgaccctgatctgccatctcttaaagtgcacaccattaaatttatccggcctcagtgcatcggcaaaaacagccatagtaaaatcatagcgcctatattaagatttttggattgttgagaatatagtcatataatgatttaatatattccataaataaatcatgacattacagatgtatactagcattaacgcatcattagatctatacatgtaaactaagcagtaaaacatgaacagatcaaatatgcgcaacatgtcgaacacgtaccgaggtggcggaaagactgattgctcggcaggaactactcgcggttgcgagcgtcgatgaaggcgtgcagcacgcgagcggagaggaaggcgagccatcgcggacgaacagggagcagtcgcgtgaagcgcttcccaaaaaccttatcgccgccttctccaggtgcaggacgtcgaaaggcagaggttccggagacctgctctcccgatcgccggtgcacactgacgagcgggatggagtagtccacgagcgacgacgcaacacagaggaggaggcaaaccctagattgatttcatgtgttttgcgtgaaggcggtggctcggtttatatagagataggtcgcttgatcagggtgcccgcacgatctccactccgcgtaaccgaaccggataagtcgcgcgtaacttatccggactccacgccgttttcaggcaccggatttttcggaatgttttcaaaacaaaacaaatccaaattttcttgcaactaaacaaaactgcaaaaggaggctgcatctgcgcaagggtgagaagccaattttgcggaccattcgacgggtacgttgtgcacgcgagccgcttgccagtcaaggtaaggcgagtgagcacgcgcgtgtattccccctcttctctccaccacacatgtttcaagtggataggagggcatcctcccttttaaggaggtccccctctcctaaaataagcaaggtggtactaaacaccacatgcatgccatcccatgaggtgggctttgtgattttccaaagaattaattttagaatgggccttagcccatgtattaattccaacaaagtacccgtattctcatgtcaacttttgggagagtgcaaaagatgaagcaaatttgatgttatttttttcccaagtcagtaatgannnnnnnnnnnnnnnnnnnnnnnnnnnnnnnnnnnnnnnnnatatatcaatnntgaaatcaaccac

SEQ ID NO: 10275 - DNA, 684 bp, Oryza sativa
  unsure (1)..(684): unsure at all n locations
atatttttggcattttcttgaacttttgatataattctttcatgtttctatgttgaagctcattattcattttctctttaatgttcttttcatcctaaaaagctcattgctacaaggtgatgctaatacttctttttttttcatggagtagaaaagacacattttctctttgtaaagtggggatcaaaccatttctgagtttaaggatatataggaacttgtgtatagttactataagaaactttttggtaaggaagagtgcaggaatgtacatttggggggaaatgtttggagtgcttctcttagattgaatgatgcttaaaaggaaaacatgatcatacctttctctcttgagtaactagacaaaaatatgaaggtgatgaaagctaatactgcccctggaccatcaaacaatatagccctatctgtctgcagaatgtttttttcaaaatcttgacaaagacaatcaatggaagggtttcagaattggtagataaaatattaagggaggaatattcttgaggggtgtgtcatcctgcatgagttgcaaagaaagggtgacatggggattatctttaagattgattttgagaaggcatatgatagagttaattggaacttcctgtatggggatcctctagtatagtcgtgctggngggctgcaagcatgttatactataagct

SEQ ID NO: 10276 - DNA, 18030 bp, Oryza sativa
  unsure (1)..(18030): unsure at all n locations
cgtgaattcggctccccgtcgtcgccactcacactggaagaaaggtcgggtgccttttgcttgctcagccatgaggctgatcaagaaaaacttgacgcacccgaaaaagtgcgagagctcagaaaacactcgctgagccccctacctggcgcgccagatgacggagctcgtggcccctcaccggaagaccgcacaggcccccctttgccggttcggccgggggctcagggtgagatctcaagctctccctgtagatgacggaaagatcgccacctctcaagagaacatgaaacacaagcgatgtatacaggttcgggccgctaagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaannnnnnnnnnnnnnnnnnnnnnnnnnnnnnnnnnnnnncaccgtctggtttggtaattgtggtcctatctcatgttttcatttcctttgagaagtccaacgaactttcactctctctctttagttccacaaaggtccagtgttagatttcctgtaaattactcagatacactacccctagtatttgaataaattttataaaactacatattttgattaacttattgcaaaaattacagataaatcacaaaactacagatttaatgacaaaattatcacaagctatatatttaatattgaagttatcacaaaactacatattctagaacttaaatcctagcactatcgttatattggagctataaaattatagtgttgtgattaaattgcccaaacctttagttttatgataatcaaaattgctacttattctttatttttgtgacactccatcttaaatatatagttttgtgagaaattttacgctaaatatatagttttgtgatcaacatcttaaatatagttttatgatagtttgatcgaagtatacgtagttttatgaaatctacttctggtatttttatggtttagaatcctatacaacatcctatttatacatttttttatgttcttgcgttatcaaaatcacatgtttgaaaggagcccagagagttaaacctgctagagaagtgacttttagataatggatgaaatccgacattcactacaaccgaagctacaaccaattattatataattattggtttatattccaaaaaggtagctaccataagatgaaatggaatataaataaccactccgccaccaaaaagaagggatacaacttactgagacatcaatcctattacaaaatcttcattcaaagttgacaaaaatatgcataaccgtaatctctaaatttcgatatgcaatatgaatgtattctttctcctcattacaccttcataaatttgtgcaaaataaaaactaatatggtgctcttaagagtatctgcatacaaacacatccttgtaagtacacagtgtacactaaaatgtgaggcagaaaagttcctccaactaaaactactatcatgtttcagacggggatcatgttcaccatcgcgtgcgatagctgataaagctggtgggtgatgccattaccaccggtgacattatttcagtatattctcacttctcagggaggagaagaggcaaaggctatttgctcaaagtttccatagcaacccttgctaaccagaatggacgacgtctccaggcgatcccgtagtaaaatgcatatactcctttttttttaaaaaaaaaacaggttctcaccggaggagctcctccgccggcgcacccagattttacgccttctccgggggaaaaccactttctctctccatctctcgctctcgctctccaaccccaacaaccttttcccacccggcatctatccattcctccgctgcgaagtatctcctcggatcccctacgccgcacaaccccacgcaccaccgcttcaactacccatacacatgtatcccaacccccaaccaccagacgccacacgcgtgcacgccgcaccggatccgcccaccgaacgctgctcgtctccctccccaccccgtccgcctacccgtaccacccactgccaggtgggtccatatcccagtgggtcccactcgtaagtgagaggggttaggatcgggccccgtgatgtccgggagatattgggggactaagagatttttttttttcgtttcctctctcgcccctataaactttaccactactcgccccgtgcgctctcctcgtcgtcgtcgtcgccgccgcgagcgaaccgggaggagaaagtccaaaccctcgcgaaggcagagtcggggatagggatatcgccgaggtgggagaaggcgacgtcgccgacatgaagctgttcgtgaagaccctgaagggcaccaacttcgagatcgaggcgagccccgaggcgtcggtacgatcccttcccccttcccccctctccttctctctcccccaatccgcgcgatttcgagggaattctccgggaatccgctcgattcggggggcgtttgggtgcgattttgggatagggtttggttcggggggatcgggcgccttgcgcgggtgtggttttgatctgaatctagggtttagagtagagtagtagacgacgcgatgcggagcttcggatcggttttttttttgggcgctcggagtttgttattagggttgtaatctgagtcgtgtgctactaattcggcttgttgtgaactgatcggtttaagttacatgtgtagatgtttttttggtagaaattcgaactcggcatctgtaggagatggttttggaaattagaacctggctgttgtcaatgtggttgatgctgcaatgtttaatgtgtgtatgcttggatatgggactatttgtgccttatacttacagctagctctgttttgcaggtggctgaggtgaagagaatcattgagagtactcaggggcagaatgtgtacccggcggatcagcagatgctcatacaccaagggaaaattctcaaggatgatacaactttggaaggcaacaaagttgctgagaacagcttccttgttataatgctgtctaaggtatgtgatgatcttgtttaatggcatttgattgtttagcagtaactacccttctaaattattatttacagctagacaataagggtatttgcagaccagagtattcttgataatttgcagtaaaatcatgccatattttgaatactgtggctttgtttcccttaagctgggccttgtagctttttataatcgtgctattatgtgtacattattagtgaatatatgtattttttttggttaatgctgcagtttcatactagatatttctttaaattgtaatgttataactgaatgaattgctaaatgtatgggatgcaaacttttgtgtgattggggtattcttcccatccgatagccaaaatcagagcccaaactttgtgttgtgtcatcaaacccgaacaaatcattgatatgcaaaatacgggtgcaagctttgcatgatatttattgctgttaaatacaccctctaattacaggaagtaattacctttttttttttagttttaacagccgtttgtgttatgtccaggaggctaaaattaacatgtttaggtgaagaacattccatgatttgcctgagttctaaatgatatctcgactgctctttgagcctttgacctctgatgatcttatgttaacattttaaattctgctgaaattaacggtggaagtgtagtttgaagctcttttaattattcatttttctgtgaatattaatcacttgttgaatatgtataaaatttcaggccaaagcatcatcaagtggagcttcaactgcttcaaaggcacctgtgagccaggtaattttattggcatatataattctgtcaataatctctgcgtgtctctgttcatatgaaaaagttttatctaattagttagggattcaacctgcactcctctcttttttttttggtatccagtatttgggataaatatattctgttctgttatgcaccttcatctcttgtttgaaaatttgttattttcctggtaatttttccatttgttaattcgtaaattgttgcacatctccaattcatgtgattaatgactagaaccaacaagagcttagagagctgtaaagaaagtaatcttattttctgattatggaaaggtataatttgtcattttgtttttgttttagctttagctgattttaggttcaaaagcaattgaatatgttcatcatgtaattttgttatttctgcataacttttgagtgtctttgtttcgttcatgacctgaaaattccttactgtttatttgcactagtctcaaccagcaactccagttgcctcagttgcaagaacaccacctccacaagcacctgttgttacacctgaaccgtgagttatatctattcctctaatttgtataatgtcaaatattgttttccttatttattatcatgtcattcgtagggcacctccaagtgcacagcctccagttgcttctgccactccagctgctgctgccactccagctgctgctgtgaccgcatcgtaagctcccttttggatccattatttcaattttttattaggtccctgtgtttgtttggaacacaataaatttgataggaattttgcacgagacaattcgattctggccttgaatgaacttatattttgtacttcacttgtgcaaagatgtatatggaacaggattctgttaactgctgcattctattttcttccacatcatctgttgtcatgtctagattagtttctataaacaatgatccagttttaggaatagttccattaatgttcctgtaactccatggtgtagaaatttatcactcgatgagtttcaatgtggcatcctgaaatgtttctccagcatgttgtaaactaatagacaattaaagaatgctaaaaaaattaggcataccataagctagtgtgtggtacagtcatacactatacacaatgtttctggactgtggctttgacttctgtaggcatttaatgtagggccattttggtttggtgccaattctttccctaccaattctttggtagttttgaatagtacatgttagcattttggattggagccaaattttgccaaatcaatagagtggagccaaatctgtactataaaaaatttggtagtgccaaaatgtgcccaaggtttggtactaccaatattttggtagggtttcaaaccaaacaagcccgtatttgtctttactacatatttgtaacttgcactgcaactataatagataacactatactaaacagtagaatagttttacaagtgtatttatggaattttaaagattcagcaattcacattgtataggtatcatgtttagaacatcacatgactgattgtcctggtcaaaaaaatagaacacaactgatttgtttataaccagaacgttttggtactgtccatattattttttgttggtaagatttatgaattaaagttaagactacgtagttgtgtatatttggcataaacacatatggtgctcagcttgctcgattcatctgtaatcttgaaacttacaaagctcctggatttggttttgtttcacgtccactgtgatgattcctcttttaatgtcatattaatgtttcccttttattgttatgataaacagaagtgatgcggatgtctacagtcaggctgcatcaaatcttgtttcaggtagcaacctagaacagacaatccaacaaattcttgacatgggtggtggcacctgggaacgtgacatggttgtccgtgctttgcgtgctgcatataacaaccctgagagagctattgactatctgtattctgtaagttccacgtttgataatttcttttcacaaatgcacatttctatgctgatggggaattggaaaactcatttaaagaacttatgtttttaaagagaattcagcaagggcaacgcccagcagttttaaaatttatatagaacaagagagttcaatccaattttcttacattgtttgtaaccaaattataatccaatgttaattttactgtgcataaaattcaactattgatgttgtactctggttcatctgttagggaattcctgagaatgtggagcccccacaacctgtggctcgagcacctgctgctgttcaacagggaaatccacaggttccatctcaggctcaggctgcacctccaccgcctgtgcagccagctggtggtgcctcaggacctaatgcgaatcctctaaacctattcccccaggtatgtgtaaatgtaaattgctacctttatatttggaggttagttttataagaaaccaaaatgtttccaacttctggactgcttgtaagtctaaggatcgaggcagaccagttaacatcttattaggaagctgtcatcatcagtttgtcaagaatattcttgaaaacattagcactgatgttcttgggtaagacaatttcaggacatccggcatcgtattatatgcttttgaattgttagttccatacatccatggtattttgcactggcacatatacatacaagcagttcagcacctgttttgacttttgacaatgcatagtccaatgtatccatattctgggttcaaattctggttagctggttacgcgtattcctcatgggtgttggtagagctgatattaccagtaactgtcacccatatttgtagttttcctatatgttgcttggatgttttgagttaaagtctgtgtggaacaaaagcaaagttgcttttgctttattaaaccagtggtttcacagaaactgctgtatttcctggaattttgtttctatttgcttgctattgtgtttgttttgaaaacatgatttttaaaatatgtttagggcattccaagtgctgggtcaaatcctggtgctgctgctggtgccggtgccggtgctggtgcccttgatgcattgcgacaacttccacaggtattattatatgttggtgtaacttttatacttgttaaaataatgcattgccctaacagctatttacttgtttctgctcagttccaagcgctgcttgcattggtccaggctaatccccaaatcttgcaggtgctaatataaatcaactcataagcttcttgttgcttttctttttctttgtagacattaaaatgccagtgcatatgctattttatgtgacttgagcaattctgttgattcacagccaatgcttcaagagcttgggaagcagaatccgcaaatcttgcggttgattcaggaaaatcaggctgaatttctccgtctggtgaatgaatctcctgatagcggcgctgctggggggtaagaaccaagagaactacaaaacatgtattatattctaattgatacacatacaatatttacattacattttatacgctctggtaaatcagaaacatactaggtcaactagcagccgctatgccacaggcacttacagttactccagaggaacgggaggccattcagcgggtatgtttgctttatatgctattttggattttctaatgaaagacaattcgctgcttctgaaattttcacacctcagtttccaaatgttgacacttatgtccaatttgtgatttacatcaagaaacttacccaaaatacccattagtcctttttgaaagttctaaatttgaacttttgttttataaccattgaatggatattttaaattttataaccagttagggctgttcttttaacatgagcctgttctattattagttcttttgttgagacaatggcatccttaaataacagctttttcattgatttaatcatcagcatggttttcgagtttccttgtaaactttcatgtatactttcttgacagctggaggcaatggggttcaaccgtgagctcgttttggaggtcttcttcgcatgcaacaaggatgaagagctggctgccaactatcttttggatcatggccatgagtttgaggatcaacaataggtgttgttagtttggtctcatcgtggctgggagaccccaaaaaaaaaatgaaatcgaggcagaagcagtgcagttcagtatcgttattatttctgactgctgagagatacctggccgtgtgtgcaatgccgctgactatgttttaatttcctgtgtcttgggaatgcttttaaagtacatattaatttcatattcacatattatactgtgtataaaagttgcatgttggccttgtgtgcaagttctgttgcattaggaaaaatgcgcagctaattagttttacgagggctcgtctgtgttacgtgttccgtatgctagaatcgttctcacgttgatggggtcactttggctgttgtgatgcgtgggattgagatttgagattcgttaattcagcgcggttattatatcattattacgtaagccggagtaccaagcaagcacaacatgcgtcgccaattctttaaggttgctaatgtgacccagtccacggttctactgggttcaatgcagaatgactcatcccttcgtcaactagtttccaagtttgatttatccctccactacaaaaacagatctgaaggctccctctactagttttttcctcccaaaatggttttaacagagattttgttctaggtggcactatccgagtgcgcatccgaatccatatgaaaatatgagaaaatatgaataaattaacttttaaactgaaaagaaaatgcttgaagggaagaagttatctgttttttaatgaacgaagttagttgggaaagaaaggaaaatatgaaaatatggggcagaataaggaaaaagttatatccatctatataaaagatagttaccatgactcaactccgctccgctccaccaatattgagtgtggcactatttcatcccctactcaccgctcagccgccttgaccggtcatcggcgttgcgtttctcatgggccatactcactatactcactagtgttcccttcatcgcccccgttagccagcattgtagttatcgtgtcggcgctagatgcctgatggctgttgcttactctgatccctctgcctgttgctgccacctccactccttactatcacacgtcgacactaacggcaccaagacaaattctgccattgacatcacccttctaggccacctcacctgggtcctcctcaaccatttcctcaccgccacaagctacctctcaactctcgtcctcactcctttcctccgcactgtcctccttaaaatgaattgattttaatagttaacggagtctccataactggttttatggttgagccatatgaattagacttggaccatagtcatgagattcaaaacagactttttctaaatatatatataggctgatggcagtatggcttgagccgccaagtgtaggagtggaagagtgggtgtaggtgagacccctgaaacaagaacatgcaaaaatttcttctgtgagtttgtgagcctccatcgagtttagatactttggactgctctaaaaaaacgctccgccacagaagcctcgaaatgcagatttatagttgtagagaaggagcttctcagacgtaaagttagagggacgtgagtcccggacaagtgaaactcattctcatagaatacacgtaagagacatttctcttacatatattagaggaggtcacagcagttgtagacatatatatacttgatgatgccctcgtgcatatccctatccagataccgttggctcatcacgtcggattaattgtctaaagttttgctacgacttctgcgcgacaaacgagtgaggtgaaggacgcaatcttttgttgctacactgcaaacatctaagccccacaaccacgaaatcgggaacttcttctcgattactcttcagcgtcacctaacattaattcttcctcccaagatttctgctcatcgtcagtcgtgaccatgctgatttcatcgtctaccttcgcttactcttcatgcagatcttacacagatttccctgtgcgtatatatatatttctcctgttcctagcgcaaaaaagatccttcaaattttttttgagacaatccttcaatttaatctctgctggaattcagattgaactaaccattttggcatctttttgtcatcgtttgctagacaggatatgtctcagcatatcaaattattgggtcgtgtcatgcatgcatgtctctactggtagatcaggacaatagacaagggtggcagctttgagcaaatgtcccggtgcagacatggcacaagagatttggaagtaacttgaaatgacagaattgtctctatgcagagaacagagaggatgtgaagcagtgcaagtaacacactagatgctttctcactgagactagcaaagctgaggagctgcaggacaaggtgaagaatccccagaaacaaataactaataagtgacagttttggacatatcgacatggtcatcaggacacttgtttgattatgaattttctagtataaagatttggaaaaatagcaaagttataatattttaaactatttttaagatagatctaaccgtaccatttttaacagttgaatttgaaatactcaaaataatatctatggtcttgattacacgtattttaaaatgtcacttgtgattggagggagtagttgatcatttgaccaccatatgacaccggatttgtcatactcaaatgctttttttctagctcagggctaacatgcaatccacgatgttcagtcactgtgttagatagtacaacttacttagatcgagcacctctgtttctgcctaatcctatcttgcagtcatgagcttgctgataataaacaaggtgtggttgcttctacgtaggaatactacccatgactagtccatgcttttgatattgatttgatagggttaacggacgcatctgcctctgacaggataagttaggacgactgaagtttcatggctgtggcaataggcaattgtcgttgcatgactgtagatgctttcccatgcagagatcagctcaagaccgtgactgatacgggcatggtgccacttgcatttcgatactacagatatcactccaagtcaccaagatggcccatgttttatttactcttttcacaaatggaaagcagtagaaacaacaaagtaagaaagctatgtggactcctttgaaatgcaggatttaaacacagcaatagctaggaaaaacataacaccatataagattttttttcataggaattcaatcgttcaaaagtcccctaaaattcttttttttttcaaaggaggcttatgcatgagcctgtggaatgatggattacttggcaggctgcctcgcttgtcagttgtcaccgatcagcttgagtgtcatatataggaactgagtgtcatatgctgcaacttccatttccatgatcgaaaagggtgtggcatgcaacttcaattatctgaacccaaaagacgagactcagacattcagactcttggatgtcttcgatcgattcttcatatgcatctttcaatatgtgaaagcaaaaatgaaagaggcgcaagctaacactaccacacaggcacacataggtattcgctcttcctcttcccgatcgaacagtaggatcgatgcattcacgagtcacgacggatttgccttcaccgcctgcctacctgcatgcctatcagctgtctcttgccctttgtctcttccctgcattttacttccccagcacaatccgtgagtgcgagagaatgaacaaaaccgaggcactgccaaaggttagctcacgtccatttcacggtcccaccgacctagcaagctacctctaggccacatgagaggaacacactctatacgtagggtactacataactcctaataggcggggataactcatatatgctggtttcttcttgtatgtctcagctcttaagcggagccttaaatataaaactggtaacggctcatcggtgattatctttttaaaaagttggacactaataatatcggtaccgttttttttaactaaagcaacaccaataggatggatcaagagagcagagctgaacattcactaagtcatcggttattttaagcgccttgaaaccctctctcccagctcacacactccctctttcctccgccatggtacctccttcttggctgtgccattgcttcctcctcaccgccaccgacgtgtctccttcctagctgtgtcgctaacatctcttcctcctctgctagcaatgctacaccacgtcctccttattgacattgcaccgctatgtagtcgccgtctcttcctcctcccctaagcttgggttgttggagctgaccatagcgtcactatctcttacacgccgttgaggagaagggagggaaatgtggaggtagggtggatatccagccaccacgagcttggggtggccagaactgtgcgtaggggcccgtttgacatggaaggcggatggacttatccaggatggcgagtgcaggttgctccaatgatggagagcggggcacttctacgtcaccatcaccctgatctagcctccacaaggttggctgcaacggagacagggagggtgatctattctttcactatggtagagacgataacctgttacatgtttttttctttgttcatcttcttctattctcttctaatgcatgcaaatgatatgtgtaatagattttgattgcagtgattcaattgtttgtttgtgtcaaaatttgtgactcgatttcgtaaaatgtgatgttgaagaacaaattttgattgatggaaaataatttgagattatttttatcctttttctttaatccaagcattggctcgaatcaaaccgggccagctctttttttaaaaaaaaaatcgtgtgacttatcggtacccattcttaatgagtcttcattattaatgcagtttctatggtggcagggaaattcgtcatctttgtgagagggattctctagtatgtggtctccttttgcatgtttgaaccatattataaatcggattattgctaggaatgaactaattgattatagggataaataaaatattttgaagacataaattaacaaataactttaaacaattgttctgtactcatctttcctaatttaattatactctctcatattccgtgcgtatgattaagtattatctagacaacttgaaaaatggaattaatatgattttttttacatcaacccttttttagaaatttttttaaaaaacaccatttagcaatttagaaagtgtgcgcgtgaaaaacgagggaatagaagttgggagctggacactagaacacaaccgaagccatgtatgatttctttttaaaaaaacatgtttttgatacgtgaagcaaataatttatgataatgatgtgataaagaagcagaaaagaacagggagttagaagaggaaaatatgtggtgtaagccacatatatagtaaaaacttgggtactgtttgagatttatcacgtcaccaagagtataaattttacttgcaaattttttactgtacgtaaaaattttaatctaatgatttggataaatctcatacgtctatttttttaatccaatggtagtttctaggtaaatctataagttttttttttacttttgctgacgtgaataatttttagacgttcatttttgatctgatggtagtatccagattttcacaatacatgtgattttcactatatattttacatatttcccgagttagaagaaaggaagctgtgtcctacttactcctacaggaagatggttggttcaatcacgcatcaacttgttgtcgactgttgctttcgctagacatagcagggggctcaatgatttgtagtgcgtcgggatcacgggacctggccggcgatcgatttccctggtggcgtacgtacgtcgcggtctctgctcataaaagtggtcgtttttatacctgtaaggcagatctgagcaagacataaagataatatatggaggtgctttggaactgctggatatcaaagtactttaagagaccttgaaaatatgtgctctgctttcataaatgtgattatatttttatatagaacatcatagataaattatggtattagaacacatacgtgcagcaaatttagatttacatatctagaaaaaaatcgaactaaaaaggtatatggacatatcaaagttacatttgttttttagatatgtgtattttttttacccggcctatacatccagctgagtaaattggattacatttgttgttttatttctctatcggtaaattggctatgtacatctctggttgatatagaggctggacttaatcaatctattatctaaacttctgtagattgaatttctcactaatatctctagagcaatataaaattcaataatatatattatgttttctttaaaaattcataaccaattaacaatttagataatttccgtacacacctgttcacgtacgtgcggaatccaagcacaataatggaaacaatgctctgcagtagagaataagcaatatagaaagaaaacgctggtggtataatggtggagtcatgggtataatatatataggtgctcataaatattaagttaaatttgatccatgcaactacaaattcgtcctattaaaaaaattaaaattgctatccaattagttgaaaccataccattataattctttttttttagggataatggcaggagctctgcctagcctattcataaaaggagaagaagaaggtcacgtacaggagcacctccaagaggtgtctattgtttgaaaacaggaggaaattaaaacactttgagacagtgcaaggccattaacatcaaaagtcggcgttctatcatctatccattttgcgcctcatcaaaaactttgcccatgttgatgatggaatcaaccacatgtgacaccgtaccataatcgtcattaaaaattcttgcattcctttgaagccaaatacccatatcgtgtagatgaataggccatcaaagttccttctctgttctttgatcatttctctccggcatgcttcccaccaacccattatgtctccattgaaagaagaagacgcaagcatgttgaagcctagtttcatccaaatttttgtccatacctgtttcgcgaaggggcagtccatgaagagatgtaccgttgtttctgattttgtcccacagagggagcatgtcgggctgttgtcccaacctagaagttgtagcttgtcagacgtcaagattttcttttgaaccatgagccatccaaagaatttgcatttgttttctgtttttgctcgccaaatgaagttagatctattgtcctgtatgcttccagtgaattggattctgtagatccaattgactgagtagattccatttgcaatccatttctatgttaggtcgtcttccctctcctcatcaatttgtacctgttgtatcaaatgccataggagaatgaattctcgaacttcggttgtcgagctcatcctccgtaatggccttaaccacctatgattttttagttcttgggccactgttttgtttttcctcgtcaccagcttataaagggaaagagttatctctttggggaattggccatcaagccatctgtcgtgccagaattttgccttacccccattgcctaaagtaatgatcattgaaaccctgaagagttgtttgtctgtttcatcgcatggtaggatggagccctgccaaggtttcccttctgccgtccagtcatatcagagccacctaagatgcaaggaatggctgaagtactccagatgagtgaggcaatgtgaggcggtggctggactcattgaggccaaaattttcactcagggcctatgaggtggctgcagtgtgaggcagcatgcaggatacgacacaggcaaatgacccgaggtgataggagggcatggagcaacgacgcgggtggtacatgaagatgctagcggccgctttgccaatggcatgttggagttctgcggcgcatgggacaccatttccttcttaggaaagggcctccttcctgatggccagctagtggtggggcactggtgcgatggccgcgtgctgatggtgttcatatgggattcagatcgtctgccttcacgggatgaaggcacgggcgtgcagttgaccatcatccactgtccatgccatctaacgttttgcgtggtgtatgcgttgaagagagctagcccagccaaaccatcatcttccttgcctttctgtcaccgacgtctagcccagccaacaatctttccttgccttgtcaccggcgtcatctcccacagggaccggtagatcgagcaaatcatgtcactaccgttgtcactagtcacaatgttgtgtctgccgtgacccgcggtgcgtcgacgaggtggaggaaaaccttggcttgccatctgcgggaggctatgtaggcttgccgctgcgaagtcggaggccgccgatggatggattaaccacaccacatggccggccggcgtggagcttgacgaccgctagctaggtttagttggttgttgatttcccctgttgctggttctggaaggagatgaactgtaacatatataatacgatcaaaacactagattagcagcagattagttagctggtttgatcaaggctgctgatatatgttgaattgatagcctagcttgactccacgtctccacctcactgtcaaaataggtaaatgaaacaactgaacaaatcatgtcgcttgacgacctcgcaggcagtcaggtgactatcttattggcgcccaggcagcgacttcagcgagcgtgggcctcaacgcggccttcagcggtagcgacgcgagaggaggtcgatgtgtgcgacgggttttttccctgacgaaagtggtggtagggaatgggattggggaagccgtggctctcggcgctgtcggtggctggtggcggcgcatacacaggcgatggcgaacaccattgtagccaggtgcgtatgctgccactaggtggttccattaagcgtcatgccatgcgagccgtgagccatcggatgacttggacggtggatgaggactgactgcacgcctgtgctgtgaaggcagacgatcctaatccgttcatatggtggtggatgatggtgacaatgtggatgcagtgacaagagaggggagcaagatttccacgcgaaaggctaaccctattcaaggccggtcgtggcgacgcttaagagcacccgtaatagtaaagtaaggtgctatctataaaacatgtacatctcagcaatagactagattaatagtaaaccaacttaatagtatgtctacatgggtatctatagctctttaatacattgcctcgtttttctctatagactatctccaggttagtagatagctttgctctctatcttcatttaatctcttccaagtaggaaaatatgctgacatggatctcttatagagagcctatagataaccattgtgggtgccctaaaagcaccattaaccccctaggggcgtagttgtggtatctctcctcatgtctttggtggagttcttcagttgaaaaccacatcttgatttttcaagatgggcatggcaaagtcctttgcatctcaagcattttggatgagtgggttgaggcctattttgtgatatcccgacccagagcttaataggattaatagaatactcataccacaagtaccagtttttattttgatactgatcttcaaaaaactcttaggttaagcgtg

SEQ ID NO: 10277 - DNA, 2685 bp, Oryza sativa
  unsure (1)..(2685): unsure at all n locations
cgtgtcanttaanatcgaactctgatnnnnnnnnnnnnnnnnnnnnnnnnnnnnnnnnnnnnaaattcttcccgaatgaggacaaagtgtgcaaaaaagacttgtgttggtctgtgaggacagtcgatgacctataaaagctgccagatgtaagaggtcccgacctggcagaggcgggacgtatggggttgaccgacaaggacgtcgatctcttaaggggggtgaggatgtgacatcctggcccagggcttaataggattaatagaatactcatacaacaagttgcaacttcttttctggatgccgatgatcggaaaattcttcccgagtgcgtacgagtgagaacaaagtgtgcagaaaaagacttgtatccctctgtgagggcacagttgggatatggtgcttctatttgttttctcaacaacggggtattctattgtaggcgtgtggcatggcttaatgtctatttttttctcaatcatggtctctcataactatactcttgtaattattttctcaacaacgaggtattctattgtaggcatgtggcatggcttactgtctatttttttttcttaatcatggtctctcataactatactcttgtaatcttttactatattaatatgaaatatcgcactattatgtaggctgatcgcacacatgcactactacaaaaggcacatagatgttggcactttagataccggaaatactaaaactgatacctatagatcttttcccacctctgcgggctaaaaacacaaaaaaccaacaccattaagcaactataggcatcggttctgaagaaaaaccggcacttatactataggtgtcgattttcttaaaaaaaagagcacctataattatagtttcaaaactggacctatgtgccgagccgactgagctgagtcagtcaatcctattttttccctccgtggctccgtccccccaccttatccactccctccttttcgtccgtcctttctcactctctcttttgctctcgttttcttgcttcctctcttgttccacctcgatgacgacggttacttgcgcgtgcggatccagcggcttcggccgctcgcgcgcacggatctggtgatatcggctcacgcatggggatctggttggggtagctccctcttcccaggcatggtggcatcaacaattgctccctcctccccaacgtgatgcctgctgctccccggcgacggcggcggcggctactccaccctccctagcatggcggcagtggcgacggctactccacccttcctagtggttggccccacctccaccaccgaacctctttccctcattcttctcggcggtgaaagcaacgacgacctcgtcatctctgagctttcttggcagcgggcccccctcacttttggcggcagcggcagtgttcttgatttcttcctgacttgtggattttcttaatttgctctacagttgtggatgttcttgatttcttcacctatggaattgtggaattgttgtttctgagattcagttgttggctgaaagcattggctcgatgcatttgatgccgtttacctttgaatctccacatcagtgccgtcattggagtgggtctagatttccgaccagcaccaatagacttttatgcagtacggatgcatcaactaataaaacagaggaagaaaggcaacgggtaagctagtcttcgccatcagtgcttttattactaggttgcatgcgtgtgtacgtggatcgtattgtaggcatcaactctacgggccacggctccaatgacacattgacgctgacccttcattccaatgaaatctgcagagcgcacatgatcgattctgctcttttcatgcctcccggcccgatctcggtcgatcatctgtcaatattgcttgatttctgaatttccattatgcaaacaagaatgtattttataacctgttgctatctagttacatgcacagttgtacctgtacaatccaactctctctcggccgtacgtgtctccttctgttatttttcctgtacattgctccgtatgaaagtaaatttaaatctcaatttaatgacataatttttagcaaataaaattcatttcatattatactaggttttggtcaaatgttttaaatgttgaatcttacaatgtgtacgcgtcttatattatgggatggagggagtaagaattagctaaatatttaaaaatgaattaatatgatgttttaaagcaaatttatataaaaatatttttaaaaacataccatttattagtttaggaaacttgtgcatggaaaagatgaaataaaagatgaaaaggtgtagttgaaaacacacccttgttgctacaaaccttatactatatgagaaattataagctaaagattagttttaagagtaaagtgcattggtggtccttaaacttatagggttatgtcatataggtctctaaactcttaaactctcaaaatgcatatctgggttccagaacttgtcaaagtgtatcatctaggtcccaaatcgacacatcccatctagtctcctccgtggtgttgatgtggcatgccacatggacntgncntgtccttttcttttttttctttttttctttcttgttttcttggcnttggtcttctatttcctaattntggttgggtgncaaagtacgatgtgcaacacaaggcgcct

SEQ ID NO: 10278 - DNA, 2989 bp, Oryza sativa
  unsure (1)..(2989): unsure at all n locations
aaggagtgaaaaatgggggtaggtggacccctaaaccaagaacagccaagaatttcttctgtgagtttgtaagcttccatcgagtttagatactttgggactgctctaaaaaaaacgctccgccacagaagcctcgaaatgcaaatttaaaaggtgaagaagaagaagcttctccagacgtaaagttaaaggggacgtgagtcccgggcaaagtgaaactcattctcatagaatacacgaagagacctttctcttacatatattagagaaggtcacagcagttgtacacatatatacacttgataatgccctcgtgcatatccctatccaaataccgttggctcatcccgtcggattaattgttaaaagttttgaacagactttggcgcgccaaacaagtaaggtaaggacgccattctttggttggaccccggcaaccatgtaagancaggaccnggaaagngggannnnnnnnnncatcaacgccacataggatcctgaaggggttgtgacgatttgggacctagatgacacattatgacaagttctgggacttacatatgcattttaagagtttagggaactagatgacacacatctacaagtttaaggaccgcctgtacacttcactctagttttaaagaccgtaccaattttgatcgtactttatattatggaatagagggagtaattaattatgcgcttatcagttgggaaatggttccaacccttccaaactaacaaagccaagctcaaaaatttcttgattgggatttataatattttttaccatttgaattaaccggtagaggcgtgtcattctgacgcggacggccacttcagtttgatcttcttttcggaaatgtgaaagagagctggctagctagataggaagaacgaaacttgaaagctcaagctataaatatgtgtatatccaagctatagctaccaccatacacaccactgaccagtcgctacacatcaaagcaccagcaatggagacggtggaggcagccatggcggaggaggaggaggcgaagaagagcaagatgaggaagaagggtgggttcagaacgatgcccttcatcttcggtgagtaggaaatctcgatctgtttgaaacgctgtgagtttttgtttcaaattcgcatgagatttggcgtgtttttgcacgcacgcacgcacgcagcgaacgaggtggcggagaagctggccgtgctggggttcacgacgaacatgctcatgtacctgacgaggcagctgcacatgccgctcgccaaggccgccaccaccctcaccaacttcggcggcgtctccgccatgaccccgctcatcggcgccttcctcgccgactccctcgtcggccgcttctggaccatcgccgccgcctccctcatctaccaagtcgtacgtatacacatccacgcacgcacgcacgcaccacgcacgccgccgcggcgcgctgagctgaccggagcgttcgtgttcgcgtggcagggcatgctcctcctgacggtgtcggcggcgatgccggtgttccggccgccgccgtgcagcggcgccggcggcgcgggcgcgtgcgacgaggcggcgccgtggcagctggcggtgctgtacgcggcgctgctgctgaacgcgctgggcgccggcgggtacaggccgtgcgtggtggcgttcggcgccgaccagttcgacgagtcgaaggcggcggagcgggcgcgcacctggggcttcttcaactggtactacttctgcaacggcgcgtcgcagctggtcgccgtcacggcggtggtgtacgtgcaggacaacgtcggctggggctggggcctcggtgtgcccaccttctgcatggccgtctccgtcgtcgccttcgtcgccggctacccgctctaccggaggctccacccgtcggggagccccttcacgcggctcgcgcaggtggtcgtcgccgccgtcagaaagcggcgggtgccgacggacgccgacgacgccgcggcgctgtacgagaacgacgacatggacgcgcccatctcgctctacggcaagctcgtccacaccgaacaactcaggtaccagctgactgcgaccggttctgatcgagtgtggtttcgattaatttcagctgaattcggaccgaatttggttgttttcggtcttgccgtccccggcaccatcgaaattttgagtgtgtatatatatatatatatatatatatatatatatatatttcaatttttgaaaattggatgatttcctttttttgtggtgaaaattcaatctttgctccatttatagcatttttatcttctttttttgagaaaaaggaactctttacaatgcaaaaggtgaacaactatagtttcgacatgtgatcggttattacctggttaactggttttctcttacctatcaattattttgcactactatatcgaagcatccaaagactcacatatttacctttcttttactttcaaaaaaaggtgaaacaattaaataatgaaataaattaatataaaaaatgttatacttttatgaatttccaccaatatgaaaaaaaaactaatatatagatgaagcatgagaacacattagcataaaccaataaaaatataaaacagagcagattaattgatttagtaaagttacattaaagttgcgattttgtatagtaggaagcctacgtggtagacaaaacaaattttcaggcaactaatgcatagaaaaatattaagttttaatttacatttctcttcttgcaaaatatttaaacacgtttagtccataaggaaattaaaatcattgacaagtaacaccacctagcaactcttatttagagaactactactaactaccacattccaaaaccagaagagacatgatgagtctcttctggcatgggtcactgattcgtggacccgctgattatggggctatatagcaatcactcaaaaataatagaggaagtggtgtttctgaactctgaagaa

SEQ ID NO: 10279 - DNA, 1740 bp, Oryza sativa
  unsure (1)..(1740): unsure at all n locations
ccaggggtcctttaaaaaaaaaaatcaagccacatttttattttattttattctgggtcaaaatggactttttaagcaattgcatcaatctgtattagaaagtattaagagcattccccaggtatcacacagtgccaaaaacttcttgtgatagaagttgcaaggggttgccatgatgacccctattgtttgagtttccctaatataatggcaactagtttcagcaaaatatgaaatggtcaaacaatcagttttgatcttaactagaaactagtacctttaacatagcatacgaactacaaatattcaatggatgtttagcaaccatgacatttgaagacccagttgcatttcttacttcttcgccgctccattggtacttcagtgaactgcgaggaaggagatgagtattgagtagagaaaaagactatttgacaggtcaaccgttgtatcacgagaaaggttctgacctacaaagatcatataaagcaaactcagagctatcaagtccagacaactgccttctatcatgcaaagaaatgtcaagctggtgacacaaaaacacaatatatgcaatgtcaatttaattataattggatgtgatttcagctttgaaaaggcctaagaaatattttaaggcattattccaccttcattgttgacaagaacttgtagatggcactctgctcccaaaaaagaaagagaagtgtcagcgctttaacaaaaggtacccaagttcttcaaatcagacaaatctacttcataacttaagatggactaaatgtgacactatcaatctagagcatgatgagtagaaagtattgacatgtttacatttcagttctggtaaccaaaaactttaagtaattagtttaccctagatatttaagaaatctaaacatgccaagaaacaactaatacatacatcaggtgtgctgttgaaatcaccagcaagcacgataggaattccaccccatttttcagcaagagcatttgccttctccagtagcatgcggatctgaacggacagataattggaaacgaaaactgcttagcaaacaattagtcgagtaaaaagtataatatgttgaatagacatagataaagttgaggtatagtttcaatggtgcatcttaattgcagtaaaaatatagtgcgttgaatatacatagataaggttgaggtatagtacatatggtgcatcctatttacatcagcatatatgagcattatgcagtacatcagtgattaacatgaaaaaggtccagtttttgtccctcagtactttacaccctaaccttcagtaatttctaaaagatgtcattcaacaaataaaaaaccatgcacatcacatcctggtgatagttttgaaggaggtttatatggatcctacatggtgtgtgcccgtgtgctagtgaggtaatgtggcttcataatttagaaaaggaaattagttggaccattttccagaggacgagtggataccatgcgtcaaaataaaatgatggtgcagaaaccacataatcctatgcacaaaacccaaataaaaaaaaagaaacataaacagctttggatgcaatttgctccagttttaacatttaagggaaaaactgaaagttattaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtatccg

SEQ ID NO: 10280 - DNA, 2094 bp, Oryza sativa
  unsure (1)..(2094): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagctttggtttctctgaattctggcagtacagctatctgggtgtactttttcggttaggaggcatactgtacactatacagtaccatgtttccattttaccagaaacagttatacttccaggtcataatcataagccatcactgttcaataggggtaaaatgttttgttatctcctggtaaattttcaatcaacaatgtcaaataagccagtaatatttctggaatgattccatccagtacgcaatgtacaagccatcataccacagcataacagttaacaatagttagtcaacaagttcttgctttgctctagtgatgcaagaacaaatacatccattaaatgctagtaagtttcttttcttattttgttcagcactagctagtatccattaaatgctaacttagtattgcctgcgagtattgagggttcagctcctccgcacttgcagagtgaggcattggcagaacgcctcaccaactaatggtttctgcaaaattccttgtgtgcagactgaaggatacggcgctgtataaatacaagagaactgctgtctcacgatcatgacgagcatgtgtcatttttatgcacttcgcttcccatacttcaacatttgtattaaatactttccaccaaataaatcattaacccacttcatctgaactgtcactatctgaggagaaatatatgtgctgtcctctagttgcttcttcctcagattccttgtcttcgtcagattcatcttcttgatcagaatcggtcgaagctgctgattccgtgaaaacaaattcagcgacaatgggcaaatggtcactgccaatttcctgattttgtttttggcataaaatcattgttagcagttaaagatgagaagtatataaaagcaacaatatcaaattattcatgactcaaattgttgcagatgatcatttaagttactgtgatgatcaaatgagaataccctggttggaagacccctagttctcctcaaaaaacccacaggcagagtatctaaaactctggagcattcaagccctgcagtgtaccttaaagaaagaatatcagccacatttttattttattttattctgcgtcatactgtacttttgagcaattgcatcatactgtattagaaagtatttagaagcataccacaggtaatcaacagtgccaagaaacttcttgtgataggaagttgcaaggggttcgccatgatgacccctattgtttgagtttccctaatataattggcaactagtttcagcaaaatatgaaatggtcaaacaatcagttttgatcttaactagaaactagtacctttaacatagcatacgaactacaaatattcaatggatgtttagcaaccatgacatttgaagacccagttgcatttcttacttcttcgccgctccattggtacttcagtgaactgcgaggaaggagatgagtattgagtagagaaaaagactatttgacaggtcaaccgttgtatcacgagaaaggttctgacctacaaagatcatataaagcaaactcagagctatcaagtccagacaactgccttctatcatgcaaagaaatgtcaagctggtgacacaaaaacacaatatatgcaatgtcaatttaattataattggatgtgatttcagctttgaaaaggcctaagaaatattttaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10281 - DNA, 1068 bp, Oryza sativa
  unsure (1)..(1068): unsure at all n locations
cgtattcccgccttaattaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcccaaggagttttcaagaaaaaacttatatagcacaatacccttaattaatgtgaattagttgggtgcccgcgcaattgcacgtctccctctccaagcgctcccgcatcatcgagctatcccgccggtagcatgccgccctcgtccccttcccctctctctctctttctctctctctgtctctcgctgtatatctggtccgcgcacgttcgtgtgttcgttctgaatcgagggatggagattttggccgtggatctggaagggttggactcgtcgccgccgtgagatggttgtgctctaggtggcgtcctgtttattcgactatcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10282 - DNA, 5599 bp, Oryza sativa
  unsure (1)..(5599): unsure at all n locations
cttaagttaagttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagttggtgctcttttgcatctaggtctggagtagtgtgtgtgaatgtttgcatgtacttgtgcttcaagggaaaaacagcctgtgtttgagctgtgtttttcaatttttgttctttttttataagactctgtttgtttgttgggctttctttcaaagccggttcaatataattgatctgttaaaaaaaagcttgttgctgttattgtgactttgaagggaccaccattccgcatccatttgaaagttactgtggagatgccatggatttcgagaagatggctttggggagacgtactattgacaatgagcgaatcatcagtcatgggaagctaatagcttgtcgacggggtacatttggagaggactacatatatttttgatcctgctagggactctaagattatccatgcttttaacaagactgctttggcagcgaagcttaactggggggatgaaattagagaatcaaaggttccaaaatgaaaaggaaaaggaaattagaagaatcagacgaagtgaagagtaagaacatacggcaaatggaagcagagtaagaacatacggcaaatggaagcatattgatgccttggtaagcatgtacttaaagtgttacttgcttgtatatgtttcgtgtactgggttttgaggtgtgacctggctgaatttaaatgttggtgcaaatctgaccctagaaccctttggaactagaaatttcatacgaatcacatagaaattgcttgttactgtttttacttcctatatgtgatatctagaacatagctggcaacagaatgatattgcttctattgttaacgaaattaagtcatgatacttctccttatgttggtgcaagtttatactactccttgtccaatcgagagcgactggcatccactcactatctaacccatcatatatctctatacataactaatcatctcactctaattagaaataaatacattgctacctttaagtggatgaaacaatcctaaaaattcattaatatatcctaaattatgtgaagacatctatagtatacaagacaatttgttatttaaagttttaaaactcacaaataagatatgctaaatattccaaaaaaataacatatggtatctagagataggaaccaactctattattactacactattttctcataaattcaacactacacggtttcaaacatttttagtttaaaatttatatgttccaagggtagttagcaaaaagatcataaccaatgcccaaacaaattactaacgaaacatgtttaaaatgaagtaaaaaatatttagaaaaatatcaccaacttataaacatttgtaatagaaaatttaagcaatattaaatatacccacgcatgtatgtgggctaccttagtttaatttaattgatatttgtgaggattacatatgggatcatctaagtcaatagaagtgtgccaagatgttaaataatctaaacacactttgtgaagatgttattttctgctactttttaaattccttttttttaattatatgtacgatttgcccatcaaagtataggtttcgcacggccttaaagtgaaggctactcggcctcacggtcatagaatgagaaaggaagaaacatgccgcgcatgtaaccaacatcaaagaaggagacgtaaacatgtaattctttcaccccaaaatgaatgcacacaaaaggaaaaaaaaaaccacatctatcgattgcgtaagcacaacagatgggcaatacaacacacataaaaggaactttccgttgccaagcacctctagcaagtaatgggccaattggagccaagaacgcaagatctcaactggtcttccatgaggaccgccctgatagaaatgtctagttttaatgaccccattcacataatcagggattcgcaaggcgataaatgaaatgttggttgacaaggcaccaggcccagatggcttcactgggaaatacttcaagtcatgttgggacatcatcaaggacaacatcgtggcggccttcaacgccttgcatgacgctaggagcacgcacgtaaacctgctaaactcagcaaacgtgatcctcattctaaaaaaggatggggctgagggaatctaggactataaaccaataagcctggttcatggctttgccaaaatcttctccagagttctggccatcaggctacggccgctcatgcactagctgatctcaacaaaccaaagctcttacatccccgatcgaagcatttacgacaacttaatgtacgtcaggaatatggtgaggaaacaccacatgagtagaagaccaatcctgctctttaaactagacatctccaaagctttcgacttgatgagatggggctatatacctcctcaccttcaaaatagagggttccaaaaaaataagaggcagaactagataacgggcctcctatccacctccacctcaaagatcatcccaaatgggatcccgggagaagcgatcagccatggcaagaggctacgttagggcgacccactatccactggtgattagcaagatgcgaggtagagccgtccgcttctgcacatccatgtacaccgacgagacggtcgtcttcataaatccagacaaagaggacgtaagggtcttctctgagctactccgctgtttcggtcaagtaacgggcttatgcacaaacctgctaaagtcgcaggtagcaccgatcagatgcaatgacctggtccttgacggcatccgagattggaaataggcctgtaataaaacttctccttttgacattgtacgcggattagttcttactacgctaacactacaacacgttacaggcccaagagcccaatctaaaatattctcctactactactgcttcatcaccaaagcaactgattttacaatgccgatcgcagttaacgctctctcaggattcagcaatcaaaaaacaggttcacctccatccatcgtcagaactcagaactcaggcaaatgatattgatcctctttagtcagtctagtccctcggccgcgccagccacagcgagctcagcgcccggagccgcgagaagtagtcgctgatgacgagcagcgcccgcgccgcttgcctcgtggtcaggatccggtgcatctgctgcagcgtctgatgcctcagcagatcagcctacacacaatcaatcatcgcatcacgctgtggtaatgagcaattcagttcgcctcgccgtcgatgtttttccgaagcttcaattacctgacggaggaagttctccagcgtggtgagcttggccatggcgatggccatctgtcccatgtagttggtgacgttgtcggcgccaccgctnccgcttaccacggtgnnngnccgccgacaccaacgtgtcccccagcgtctgctgcagcgcctccatcccctgcgacagcgcgtcctcggcctgctgcgacgactgctgcaggttgcagatgcccatcagctgctgatccgtcagcggctcaagatggctggcaagaacctgcacaaacaacatcatcaacaatggcggtcaatggtagcttcaaattctttgcttgttgctgaattgggtgggtgatcactcgatcgtgtcaaaaccttgaggagctccgacgagcggaagccgccgagccacatgaagaagcgctcggcggggctcatccacatgccggagaggacgtggaacacgtcggacttggtggcgaagctcttgaggcggaacacctggtcgtagtgcatcatcacggcgtcgacgagctcgcacagctcgtcgtcgctcatctgcgcgttcagcgccacccgcaggtcgttgatgtgccgctggtgctcgtccagccaccgcgcgtactcaaggtcgaacgccaacgtacctgcagaagcaaacacaacacaacacagaatcagaattgcgatgtttgcgcagatgccatgacagatcagagaaatcaagcaagtggaaaacaccaccatttcctccgatcgagtgcccgtgatcgccggagcctccagttgcaatgaagattccctgtaaaggatagtcgtcaattgcatttgcgtatttgttactgagctgttcagacttcaaacattagattctgcaaggcgatttgataagtatgctgaacaatgcagggctcacctgctgtcttgccctttggagctcctgctcaaggtgcatcagcttggacctgctgctctccaactgctgaatgtatgcctacgacaaacagcaattcgcaatgtctttagtcatcatcaataaccacaaaacaaagatgcaagtaacagcagagcatctactcccagaacattgcagcaacggcagcagcagtcaacattgattccgaagcaattaatgctctagtatatttaacagatattgtaattgtcccattaatcgaatgaatgatcgataatgtataggttcagacgatcaccttcttcctcatccggctcttccgcgccgcctcgcgattctgcgcaagcctccgctgcatctgcacacaaattcggggacaaatcatattcagaatgaacacaaccaaattgatcactcatgagatcagattccgtttcccctctgacacaaaatgactgcaccttctgatcccctcttctttccttggacacggcggaggaatccgcgcctcgctgctcgccggcgtcgtcgccgccatcgccgccgccctgggagtagcacgagaaaccgcattacacgagtggagccagccaagaaagacggcggcgagaggaggtagctggtggcagtggcaccactagagcgtggaggtggtgcttgtcggcgctgtcgtcgaggtcggtggaggtgtcgtcggtgaacgggctgctgacgatgacgccggagtcgccccagttctccacctgcgaggcggccgccgccgccgccgccatcctcggcaggcagaaccggtccgccgccgtcgccgccgccatcccctggtgcgccgccatgcccaccaccgctacgccatgctgctgctggtcgcattgcatcagccgaagaatcaatcaatcagcaagaagaaagaaccaaactcaccncggcggcggcggcggcggcgacggcgagcggcggaaggtgtcctccggcggtgaggttgctcgacgacttggagctcggattcggaccttttcaaaaaannnnnnnnnnnnnnnnnnnnnnnnnnnnnnnnnnnnnnagtcatttataacacgc

SEQ ID NO: 10283 - DNA, 3073 bp, Oryza sativa
  unsure (1)..(3073): unsure at all n locations
agagattgatgagaagggaagatggcgccatctccgatgtggtatccagctgtgccgatgccacccagctgctgctcctccgccctgcagctgaacagtagcaccgccacgggcgtgacgccgccgcgcaagccaacaaaaaaggggttagcgcgatgccaagctagagcttacagccaagcatggcgtcgtggtccaacacaaagctcgtcgcaagacgacacgcactgctacaacactacagtacctagtagtaaagacgtgtgacggatggtggtgcatcggcggcgacggcggcggcagcagcgactgcaagcggcgaggacgacgacgacgacgacgacgacgaagatgaagaacaatggcgacagcgacagcagcgtacgcttgcagccgcgctttatagcaaggatatgaatattgtggattcatcagacgatgcaagaagagagggaaaagatatcatgatccggacgtgtcgatcggtgcatgtcagagatcgatcgatcagtgcagtcgcagaggcgtcaatcagggtcaaatgtcaatcaaccgatggtggtggtgtagtattcgagtgtgcttgcgtactcctacagagctacgcaagcgacgacgacgagagaggccgtgacaggggaaaaagcctggaggaaccttgaactgagcgttgtggattgtggagtaggggaccctgcagcctgtgcaggttttttgatggttcatcttcatcatccctctagtgatgtggtagccatattgttgtttggtccagggtcggaggttggtgttgcaacttcagttgctctttgactagagggtctatacagtaaagctgcgttcgtgtgtgtgatatagggtgagaaagcacctcgttttccgtgcgcacgctttccaaactactaaacgttttttataaaaattttctatagtaaagttactttaaaaagtcatattaatctatttttaaaatttaaaatatttaatactcaattaatcatacgctaatgactcacctcgttttacgtatattcccaatctccccaatccactcctcctcaaacatacctacacctaggtagtactacgtagaggcgtgaccgcgaacaggacaaaagtgcggggggggggggacacttcagatactctaccctcattaattatagagtaggagtagccggttgctcacgggtgctgtgtatggagagcagtgaaaggctcgtttaaaacgcgatgaaaaaaaatacttgagaaatagaaacacatgaagtagtaagattttggcataatagtgagcgtaaaaccaacagttgtaaatcacaggaaaaatatgtaaatggtcatttaattagtcagtagaaattaaatgtgggaaataaacttaaagataattatagctaacttttctttaaaatctctatattattgcctattttatagggattttatagaaaaaaatatgatttaatcctatagttgaaatattcttttaggaaatttttctagacaattaaaatcctccgacagccggcattagcaaccatcgttgccgacagcttaggtatggatatagtacgatctggagtaggaaataatgcccccccccccccccacacacacacaatttgtaagaaacatatagaaaacttggggcatttcaattctataagaagaaaaatactaggatggcttttgaaataaatgattgaattatatctttttattttgtaattcttattgaatggacaatatagatattttagagaaaagttagtacgagattcaacctcttgcaaaattttattgagtctatctcgctcaaccgatttcaacatttttctcccgtggtatattcaaacaatcattcttacgttttcttatatttataatcttctactacctccatctctaaatacaagaatgtagacacgggtattaagaaaataggtagaattaaataagaaaaagttataattatatagtttgaaattgaagataggtggaaaaattgaatgatggaaggttatgattctttgggaagagaagttatattttgagtcaaattctagaaggtaaaaagtttttatattttaggacggatggagtacttacgttgcacttatattcttattaaaatcttacattttatcatctaatagcaataaagtactattcatattttaacatctaataacaaaaaaatactaattataaaaaaatcaaataagatgaacggtcaaacgttgaatatgaatagtacaaaattgtacttattttgagacagaaagagtatcacttaatataattgtctaaaatcaataaaaaaaactaatatgtttcccaagcgagactttgatgaaaacctattgtcctatttgtcagggttatggataccacatacctaatagtagttgactaaatctcggtaggacccaccacataccatgtcttatacgaaaacaaccttcggatataggaggagttccgcataaggaaggatgaatagagttctacgtagaaacgaaaaggactactcggattgtatccatattggtttctctaattctacttggacaaggggatacctatgggtataaatacaaggccccctaggaggagaagggacacggaacaacagaagccacaacatacaagcgaacatacgccaagacaagacgccggatatcgactttagagataggcatggctactcccctacggtgcctatggctactgtcaggagagatatagtgttgtctctgatctcgccggatgcggattcgaggaggaaggctatcctgttgtcaactatgagtcagaccttcagaccgccatgtcgacaacagttagataggctaccccaaatattgtactggtgttattatgatgaataagagcaacgacaggnttgggccaacaggactgccgacgttcatggggatctctagagggnctcgagaggctgtcaaatatcaaccgcggggngnnnnnnngaggatgttgactacgaaaatacnnanntagaaaaagaaagtaaatnnaagacaacgcttctatacatacaagtaatttc

SEQ ID NO: 10284 - DNA, 17848 bp, Oryza sativa
  unsure (1)..(17848): unsure at all n locations
tggggtggaattganancctgatattcgagctcggtacccgatgtcgcgattccggtatttgcatagtatggggatcgttggtactaggatatacgctagactgagataaaagagatggggacaaggagttttatacagggtcgggcccctgaatggtcaagtaataaccctacatcctgttggccgaagccggtattgctcttattcaccataatcacaccagtacaatatttggggtagcctatataactgttgtcgacatggcggtctgaagatctaactcgtagtcaacaacaaagtagtcttcctcctcgaatccgtgcccggcgagatcagagataacgctttcgtctctcctgacagtatccggagacaccgtaggggactagccgtgcttatccctgaagtcgatatccgacgtcttgtcttggcgtatgttggcttgtatattgatcttctgtcttgatctatgttccgtgtcttctatggtggatgttgattgtgtcccctctcctcctaaggggccttttatttatacccatatgtgtccccttgtccaagtagaactagggaaaccaatatggatacaattcgagcagtctttgtcgtttccatgtagaactttggttgtctttccttatccggaactccctcgaggtcagtttccgtataagacatagtatgtggtgggccctaccgacatggtatgtggtttccataaccctgacaaggatgtagggttattacctgataattcaggggcccaaacctgtataaaaattctcgtctgtctcttttacctaagtctcgcgtatatcctagttccaacgatccccataccatacaaatacctcacgcgcgcgctcctttggtgtcggtatatcctaagtctcgcgtatatcctaagtcgtcgcgtcccgccacatcggcatttcgacaaacacctcacgcgcgcgcttctttggtgtcggtcgtctgcctcgcggcgggctgcaacgtcgtgacgcgctcctcctcctcctcctcctcctcccatggccggtgccagcggcgagcggccggcgagcaactgggactggtcggactgtgacgccgcattcaccgaggaggccgacggggcgatcgccgcgctgcaggacacaggcggagacgggctcgccaccaagcagctcctcgggaggtaccacaccatccttgcgcaatggtacttcgcgcgcgcggatcagcaaaaggcgacgaatcacctcaggagagcagcatggatggccccgtgctgcctgcacatcgcctttgcgctcgcctttgtgctcatcgagatgggctccttcgatgaggcagacatggtgtgtgcccacaacctcctcgtgccggatctcaccaaccctgcgcacaacttcatctccccgaaagagcaggttgatgccatcatcagctccaaagctccagagtatagattgggacgcggggcaatttaggcattttgaaaaaatactcgccactttcagccgggaaatgataaaataataagctcggtgtcctacggcaaatttcacaaaatttgtagtgtcctggagcagttaaacattttctcggtgtccctcagctaattacgcgttttttgagtgtcctgtagcaaattttgctataaaaatattaaaagaacactatacggtattaattaaaatttggaaaaaaaataaattctgaaattagaaaaagaaaaaagatttaattagaaatataatttataaataactaaaattggtgataaaaaataaatactattgaaagaaaagaccatgtaaaacacatgacgacataaattaagtaacagtcctataaaagaatagagaggtggtggttgatacgacatataaaaattgttaataatacaccaaatagaattataagtaattggcctataaaaatgtagagtggtggcggttgagaaaacatataaaagctgttcataaaacaccaaatagaatccaaatgacgattaaaaggagggacgacaggaaggccgtgaagcaaacgggcaatgcggttgccgggacttcttgaaagtagaaaaaataaaccccattgataatcatattcaattttaaaaatctcaatgacaataaaaaggagaagcagcgggcggggtgtataggagtatagttacatagccgtacagttggcgggacttctagaaaataaaaaatgaattccaacaatagttatgtttgatttttagaatcccaatgataataaagactaagaggcgaatgggtcgtataggagtatagtggcatcgtgtgacgatacttcaaaagttataaaaaaatgaaacccaacaagacaataaaccaatttttaaaggttcaaaacttctacaaagtgaaaaaaacgatgataatcatgttcgattttaaaatctcaatgataataagaagggaggcagcgagcgagtcatagaggagtacaatggcaaagctgtcgacggtttggtaggacttctagaaagtaaaaaaatgaacccgaacgataattatgttcgattttcaaaatcccaatgccaataaagagaaaagacaatggacgggtgtcggtgacatgggaccgggagtatcatgactcgaggcttgaggcagacacaatcgcccacgtggcctggcaccctcgggggacgtcgggcccgagggtgatgtgtgcgcccacctcttggtctccccgagggggggggtcggaccactccagcctcgcccccgagggccgaggcgccccgacccctcgcgttttctactccacgtgtatgggttaggtgagcacagcagggctcacctaaccgcatttattgcgcctcggctaagcgtgtcacgccgcacgaagtgcggtgcagtgcactcgattatccggtctgtgaccagtcacagaccggtcaaatcgcgggttaggtggcgacaggcggtcagacgcatgcttcgccccatcctgtcaagacgagagcttctaggcactcgttcccggctggagctagcgtgttacatcccagagatgacacgttagccccgatcgatatatgccaggcttcatcctaaccattacaagcaagatgttgtgtgaagaagggcaaacatgcacgttgctgagccgacgcttggtggacaagaatgaccgatttgtgaccggtctgacactgctcatgtcgtcagcacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggttggttgattctttccagattcagagcctagaacgagggagaggtcggctcacactttgtagctcctccatacacagatccaccaaaacacaggagtagggtattacgcttctcagcggcccgaacctgtatacatcgcttgtgtttcatgttctcttgagaggtggcgatctttccgtcatctacagcgagagcttgagatctcaccctgagcccccggccgaaccggcaaaggggggcctgtgcggtctcccggtgaggggccacgagctccgtcatctggcgcgccaggtagggggctcagcgagtgttttctgagctctcgcacttttccgggtgcgtcaagtttttcttgatcagcctcatggctgagcaagcaaaggcacccgacctctctcccagtgtgagtggcgacgacggggagccgaatccacgccgtcgagctcgtactccaccgccccctcctcgccaaagtcctaagcagggggaggcgctcgaaagggtcgaaagatccgcggcttcaccgatcgcgggcgatggaggagaacggcgagatggggagcgtcgcctcctcgtctacggcgacggcagcacgccccagggcgcgctccaagctgcgggcgcgctcttacgccacccgcctgtcgtccctgacccggaatctccagcccaacgatggctggacgacgtggccaaattggtcatgacggcgcggcagcgcctagatgctggtgggcggtcctccgccaccaagacctctggtgctgctaccactggctccgcgtcgtcaagacgaagggcacgacgagcagcagccgctgttcgccgttcagtagccactccctcatcgactccttcgacccgagaagatctgcgtagggagcagggcgcccgcgccagcctcgagcgccggcgtaatgaccgaagtgctgcccacgcaatggaaggcgcttcctcgtctagagtgtcacctcgacacggacgtgggaatcagccctccgtgcccccggttggtggtgttggctgtagagccttcgtggtgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccggtgaggaagcggacttgcacgctgtacagcgaagggacgatgagtcgcttcaatcgtacattcagcggttttgtcaagtccgcaataccataccatgcatccctgcacacgcagtaatctacgcgttcagggggggtgtgcggcacaaccgcatgctcgaaaagatcgcctccaaagagccccagactaccgcagagctttttcagctcgcggaccgagtggctcgcaaggaggaggcctggacttggaacccctccggttccggagtggcagcttcggccgcccccggatccgccgctcagtcagggcggcgtgacaggaggaggaagaagaggtcagtccgttccgactacgagggtcatgtcctcgccgtcgagggcgcttcacgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcagaaggcccccgccgaggacatcgatgatggcgataatgacctaggtttccaagagcctggggctaccatagccactgtcgatggaggagcgtgtgcgcacgtttctcgccggagcctcaaggccatgaagcgagagcttctggccgctgcccctactcatgaggcgacgcgccgggcgcggtggtcggaagttgccctcacttttgaccagtccgaccgcccgccgtgcgttgcccggggagggcaaattgcgatggtggtttctcccaccgtttgcaacgtgaaacctacgaccttctgcttaggaaacagcctaagcagaagtcctcgctcctcaccgggagaccgcacaggcccccctttgccggttcggccgggggctcagggtgaaatctcaagctctctcggtatgtggaaagatcgtccgccaggaagaaacgcgagacacgggcgatgtatacaggttcgggccgctgagaagcgtaataccctactcctgtgttttggtggatctgtgtatgaaggagctacaaagtgtgagccgacctctccctcgttcaaggctctgaatttgggaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccaagcgtcggctcagcaacgtgcatgtttgcccttcttcacacaacatcttgcttgtaatggttaggatgaagcctggcatatatcgatcggggctaacgtgtcatctctgggatgtaacacgctagctccagccgggaacgagtgcctagaagctctcgtcttgacaggatggggcgaagcatgcgtctgaccgcctgtcgccacctaacccgcgatttgaccggtctgtgactggtcacagaccggataatcgagtgcactgcaccgcacttcgtgcggcgtgacacgcttagccgaggcgcaataaatgcggttaggtgagccctgctgtgctcacctaacccatacacgtggagtagaaaacgcgaggggtcggggcgcctcggccctcgggggcgaggctggagtggtccgacccccccctcggggagaccaagaggtgggcgcacacatcaccctcgggcccgacgtcccccgagggtgccaggccacgtgggcgattgtgtctgcctcaagcctcgagtcatgatactcccggtcccatgtcaccgacagtagcccccggcgttatgccagggcgatcgcccttcttatgggaagcggccgggcgtgacgccactcctaaagcctggtgacaggtgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccgggcacagcgttggcaagggtataaaggcactgaggatgagatttgtctccttcctttcgccatcatttcccttgccttcgccgcttgcgtcctaactccttcttccctgcgcccttctttcgccacacgcgctcgctctgaggatctggctgcgctcactgcatgtttgcaatgaggacaccgttggggcgtgtcctcattgatggaggagcagccctcaatatcctttcccccgcagcctttgatgccatcaaggccccggggatgatgctccggccgtcccagccaatcatcggcgtgacgccggggcacacttggccgctaggtcatatcgacctcccggtcacctttggtggacccgccaatttccgcacggagcgggtgaacttcgatgtggcggacctcagtctgccctacaatgcggtcctggggaggcccgcgttggtgaagttcatggcggctgtccactacgcctacctccagatgaagatgccgggccccgacggccccatctctgtccatggcgacctcaaagtcgcgcttgcttgtatggagcagcgtgcggaccgcctcgccgtcgtgtccaagcccgagggcggcgacgagaggcttgacacatccgcccccgccgccccgaagcagcggatagtcacgtccgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcagggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaaactgggagagaaggcgctacccttatttaagctcctcaagcgctccgggccgtttacttggacggaggaagctgaacgcgccctcactcagttgaaagcatatctcagctctcctccggttctagtcgccccggagccaaacgagcccctgctactctacttagcggcgaccccccaagtagttagtgcagcgttggttgtggagcgcgatgagggcaatcctcattccgcgcacccccaccctgtgctaacttggcccgggagcgagcagggaggagaggccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagggttggccctttgcccgcttgtccgacgacgccaggagcccccgacccccaggacggccccgaggccactgcgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgaccaataatatggcagagtacgagggactccttgccggactcagagtggcagctggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgcttggatctccgagatccaagcatacctcacagataagactctacctgaggaccgcgaagggagtgaacgcgtccaacgcatttccaaacgctacgtgctggtagaagggatcctctatcggcgcgcggctaatggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtagcccgaggcttatccggtcgtcaagatcgataagcactctgcacttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcatggatcgaggagttaccagcggtgctctgggcgaaccgaaccacaccaagccgagcaaccggggaaacgcctttcttcctcgtctacggcgcggaagcggttctcccatccgagctcaccctgaggtctcctcgggctaccatgtactgcgaggttgatcaagatcagcttcgtagagatgacctcgactacttggaagaacgaaggcggcgtgcggccctccgagctgcacgctaccagcagagcctgcggcgttaccatcagcgccacgtccgggcccgatcactctgcgttgacgacctcgtcttacgccgcgttcaaacgcgtgctggattgagcaagctctcaccaatgtgggagggtccgtatcgagtgatcggtatcccccggccgggctccatacggctggccacgggcgacggcacagagttgcctaacccttggaacatcgagcaccttcgtcgcttctacccctgagggggggtcgggtgtcaggtttcgggctcgggtcaaccccgcaccccccctcgggtgtgcagggttgaccgggggctgccacacatgcacattctcatttctctcatttcagtatttcaataaaagcagtttcaatttcctaagggctgtatctgtgccgtttttttttcctttttgaagaattttgacttgaaataaggtcactcgtgctcaaccttgccctcgggggctcggttcggtcagctaaaatcgccaaacggggcccagaaccgagccgtgcccggggcgtggtgaactccgggggggaatcggcaaaaacccacaatcgggtcacccataaccctcggtcaccacgttcccggcctggccagtctcgacatgcggatctccccaggcactagtcccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaagaaaaagaagaaaattgaagattggcgggggcctgggggctcaatccgatgcgcccgggtcgccggcctcgtcttccacgtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggttggtggagtgcgtccttgtctggcctttccagaggcccgcttgctggccggcgcgatccagacgggagactgcatcccagagcatgccgggccctatctcgcccgccaagcggagggcctcggcttccccggcggatgagtctagcgcgcgctgcatgtccgcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcggcctcttcgagagctcgctcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccatcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccatgctgaaggcggaggaaagtggtatcagagccatctcgactgtagggtaagccaagtggataaaacctaaggacatattttataaataaaactatttgcgaaagttcctctttttctccttcccctaatgctatttgcaaaaggtttactcttttcttccttcttcaaatttcaattagtactagttggtcagatttgtgaagaaaaagatatcgtcagttgtttgccgaagctccggaagactgcaggattcgctagcgaagtgtaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgaattcaggagatcacatgttcccgcaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagcttgcagtgcaactacttctagaggattatgaagattttgagaaacttgtggacaaagccatgcaactcgaaagtgagcataatcggatgacgaactgcaagagaaggattgtcaacatcccagtatttccaggtggtaaccaaagacagcgcactgagccacttcagatcaccggatcttctgttgtgcatcaagagttcctgccccaagaagatgaacacaatgcagacaacaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgctgtacctgtgaggcctcatgttaattctaacccatagtagaaacaatgtaccgatgttaagcaccttccctttttgtttaagacagtgccttgtattcatgaaatatgggagaaatttgtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacatttgtttggactaagagtttcagatgtgtctttttcggatcgaaggcaatgacagtcagtatagcttttggcgaaacacttcaaggtttcactgaaaggtagcagaccaaaggaccacatcgtcaccagaagcatccacaactctcggagagaagagtacttggttggcaaagtttaaaaggtgattgatagaagataccagcaaaggtgtttattaccgggcaaggaagtaggtcgaaaggtgattgataagagaaatttgaaaagaacacatcagggttgaatgtgtaaaggaatactttgaatgctaaatgatgacaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttcttgctagcctcctcgaatctcggggacgagattcctgtaaggggggtggatttgtcacgtcctgataaattcattccaaaataaaattcattttctaaaaggaataatagaattaattaaaattcgaaaagaaattggcaaacactaaagtacgtataagaaaaattcgaatgtggcccggagaatttttgttaaattctccttggtctaaaaggagccctcaaattttacttgaattttcagagcaccggaaataattattaagcaacaaaaacaattatcaaagtttactaaaaaggaaaacctaaaaaaataaatcctcttcctcctttgggccaagcccagcccaaagtcttcctctcctccctctctttctctccctctccttctctccctcctcttgggccccttcccctcggcccagtccctccctttctctctcttcccccgcgtcccatcggctactccccgcgcgcgcgccgctgacaggcgggcccgcccgccgccctcgctgacgggtggggcccacctgttattcccaaccccgcgccgcgcccgccgnncgccgtgccctagcgccgccgccgccgccgaatccgccgcattccgccttcctcgcgcgccataaagaggggcgaatcactccccgtgattccctctcccgtttccccctcttttccctctctctctccctcggattcgttcggaatcactcccgcaatctccgccggcgcatatatggagcccgaaaactccgaggagggtttccttcctatccggccgctttccctctctccggacgctataaaatcaacccccgagctccgctcctccgtttccgccgttcgcggctggctctcccggtaggattcgtgctcgcgccgctttcctctctctccgccgtcgccgacgagttccggttcgccgccgccgtcgctccggacttcctccccactcggcgtcacctccatcgggttcgccgtgttcccgtcgacctcgtccgcgccttcgcttcgcccgccgaccgccggagctccgtcgtcctcgccgtcccgaaccgcgccgccgccttcttccgcttcggccgccgttcccgtcgtcgccgtcgaccggggtgagccgaagaccgttccgttcgcttcccccttccctcctctctctcgggtgccgctccgccgccccggtggtcgccggcggtgaccatcggggcgcgggcgcgttcccctcccgtcggccgtgccggcgagaccgctttcgggcgcgccctcgcggctgccaagtgggcccggccgtcagccgcccgcgcccgcgggtgcggctgacgcgtgggacccacggcgccgaccgccgcaagacgcgtgctcccggtccaccgtggaccgagaggctgacgcgtgggccccactcccgtggacccggtccgcgcgccctctccctcggctgacgcaataaatgcgtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctcctgttatgtgcagtttattagagtaaaagccttttcttttcagtggggaatccagggctgctaacgccac

SEQ ID NO: 10285 - DNA, 4271 bp, Oryza sativa
  unsure (1)..(4271): unsure at all n locations
aggtttggctgacaancnagctggnacccttaaattattgcattatcgctttatttaaattcccgcgttatcactgttttatttagccatgcctatttacctttgttatgaccatattattattgttattgttattattataccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactgtggaattgttggattattgtggaattggcttcacaccgccccctctattcaaaatcccctaaaatggttttaggctgggctcggggtgcatggttttgatggtagcacctcggccatataaggaccggtcttcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcgtaggccttgggttaaggcaggttcgtgtgggttcacggccttgattaataatattgtttagttctaggatcgtgtttacaaaatagcttgagcaactaaatgtctttaaatgctgtttactgcaaccctaacccctctatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgtcgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaggaatcctgcgcctcgatcatcacagtggtggcgatgagggcagccccccgctcctcctccacctttcgtgcgatctccgccagtgccgtcttgcgggcctcaagatctgagacgtgccggcggtgtgccttgcggcccgcttctaccatggcctccaccgagcgcgggccctcctcgacacgcgcccatgcggcgtcgagctccgcacgctccgcctgcagggcctccacttgggcgctgaacccatctagcaccgcggtgtttgcggcggccaaggcctgcagaaggggctcggcgctcagcggggcgacagaagacgaggggaagagctgccttgaagaagacgccgcgcggctcggcccgccaatggacgcgccggcctcatcgcgggccacccccggacctgtttggtcctgggcgtcgcctgaaggggtgggcccaagcgaggcgtccgcggcctcgtcgtgaactgcctcggaagccgccatcgcctcagcccggcgaacccgggcggcctcctcccgagcggcttcttcggcctggcgaacccgggcggcctcctcccgagcggcttcctcggcttggcgggcccgggcggcctcctcccgagcggtatcctctgcatggcgagcccgagcggcttcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctccgattttccttttcccccgggcgtcggtaggacggttgcttcccgagcccccgacgcggggcccataagcacgaccccctcccggggtagattgatccccccggcgggtcccacctgcgccgtcatggcccttaggagcctgctcctctgaggccccgaccgccgtcataatggtcagaatgtaggcgcggtcgggatcgctgcaaagggggaggataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcggaagtcggagatgcgcttcgtcggcgaggggggtgtagaaccagtcgctcttccagtcatcccactttttacggaggacgcaggggatgtagcggttcaacaccggcccccgcggcaggaaatagcagccgccgaccaccgacggtggcgataccgactgcacggtaaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccggtggcagattccggcatgaagcggcgcggcaacccggcctgcttctcgctcacaatgcgagaaggcggcagcacgctaccatcaagcagtgcggagccccgtgccatggcgccggacgaagagaagatgaagagcgagcgcgtgtggcgaaagaagggcgcagggaagaaggagttaggacgcaagcggcgaaggcaagggaaatgatggcgaaaggaaggagacaaatctcatcctcagtgcctttatacccttgccaacgctgtgcctggctcctcgtttctcgcgcccattatttcgccccctcgtttctcgcgcccacgcttccactaatcccattcgcccgcttgcggcgcgtgagatggatatgcggttgcggcagtcgagatagatcgtatcgtgcgcgcgttaattacgctcgccgaccgaaacgacattaccgtattttcaggcgaggcaaatcggctcgcccagattcgtgcgccgttcaggtgatgtggcagtcttgaagagaccgcccattatttacagccaaattaccattaccggtgtgcatggtttgagacggctgggtttttgcccaacattgagaccggtcccacctgggaacaaggtttaggagtggggttacgcccggccggtttccataagagggcgaacggcctggcataacgcgcggggctatggtggtgacatgggactgggaagtttan

SEQ ID NO: 10286 - DNA, 822 bp, Oryza sativa
  unsure (1)..(822): unsure at all n locations
aaaatctctccatatcacctggaatgtgtcaactccaagatcaaatgtggttccacagaaactataataaggaaagaaatctttgatttatttcattacaagacattttgatgattaaaatattgtaccgttataagatgcaaagagctcaagggacatatttggaaagtcccatgacaaaatatttcagaaacatgctatttaccaaaagtagaatagcgaggcaaatcacatattaaaacttaaaagttaatgaaatactaaaaaaaaaatctgcggagggtgcataagggtcaatggaacagtcaaggtacataccgtcacaacaacagatttgtcctcattgtacaacggctggtctccggatgtgggatcaacaatagccaaccgctggtgtgcaagatagcaatcctgatagcagtgtataccactccaatcagggcctctatgacgtaacctatgaaaattggaaaacttgggttagtcagtgcataagcagttcaaaaaattctatcagaagatttattaaatctatgaaaactatgaattacataccgtcacaacaacctatgaaaaatgcagcatgccttgagtctacaacaagttggtactaattctatcagaagatttattaaatctacgttgaaaattatttgctctaatataaggacatacacaagaaactgtaaccattcagttcctaaagatcaagtggttgcagagtgcagactacagtgataaaaacatgccacattatactannnnnnnnnnnnnnnnnnnnnnnnnnnnnnnnnnnnnnnnngttngataaacaatcacacg

SEQ ID NO: 10287 - DNA, 968 bp, Oryza sativa
  unsure (1)..(968): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccttacaacgggtccatcccctgtacctgctcgggtgcgcgtccgcccgccgtatcatcgcctccgtcgtgtccataagcatcatcctcacgccgccgccgctcgccgcccttttcgccgcctcgaactcctccacctacgaagctcagaacacacgtttactagaaagaacaagataattgatcactagatcaatggagaaaaatcaagaaattaacctgcagcgtgtggaagtcgagctcgaagccctgcagcgttttctcgccacgccggtacggccgcgtccggacgcagttgccgttcttgttccactccccgccctcgtactgcgacggcgacacggtccgcagcacgggggtgactccgccaccgtcgctgctcaccacggcgcggagcgcggcgcgggtgcccatgcggagcgcgtaccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10288 - DNA, 9178 bp, Oryza sativa
  unsure (1)..(9178): unsure at all n locations
ccgcgcattgtatagcnnnnnnnnnnnnnnnnnnnnnnnnnnnnnnnnnnnnnnnnncatttagctgccttgggcagaagaagattaatcatgaaaatattctccttaattaccttccgacatgtttcctcatggaattccttcttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttcctccagtgcatcaatgccttcctgttttcattttttttttacaatattgaatcagagcttcaaaagattttttttctcactatgcaaaaaaaacagagaacagatacagaacctgcactgtgaagtggagttcgtgatgaacagtaccaaggtagtctgcaacttccttagcagctctaagatcaggagaaccctacaaaaaaggggaacattgaagaactagatcatcatgtgcccaatatctaagcatatcactccttttttttaaaaaaaaatccattttctttcaaaatactcagaacaccaggagaacaggtaaaaattggaaagataccctacaggctaacacaaatcttcgcaataataggactcaatgcttaagaaacttactttcaaaccaatgcaaaatgtatgcagtttgtttccccactgtgcggcaacttttgcctctgccaagtgccgcgaaacaacagatgcaaccaaagaagagtccagtccaccagacaagagaacaccaaatggcacatctgtcattagcctcttaataatagcctgcagaatttgcatcttatgtaagatataatcatttgcttatgctaccataaacatgcatagaccattcagaaatgttatgccatctatttgaatattaatacagaggtcaacatggtgaaccatcattggtcaatctgagagcagtataatatatcatgctaaaataatctattgtatgaaaaaccatctgaggtttgaacaagcttttcctaatcagcggcataaacacaacatatcaaaagtttagaagagattttgtgcagcgtaagagatatgggaatgggacgtgccttctcaaagctctgtcggagaagaagaggattgtacggggtggagggaatgctttcagaaaaccatggtgggttgtaccatctccttaggccacctaggttggatattagaagacaagtcagtaatcatagacaaaacaaaatgatatttgcaatattataatagttttgatcatttctgccttcctctttttttcgtcttctgggcctaaaaacagtgtttctaacatcaactgttagacgatactgtcagtatgtcacaaatgcgaaatagcacacctgttttgctggagtacaagtgcccaggggggaaggatatgaatcgctcgcaatcatcacttaatgccttcatctctgacgaaaaccaaaccgaacctgaaaacacaatacacctacaaataaacaccaagtataccctaataaaaatcacaaaggcaataatgctaaactaacatcgcactagccaagattcgaagacaaggagaaattatatttccagacatatggaaggaaacggtgcctcttgccctctgcaagtatattatattgtcattctgtattatgagcttgggcaacaaagaccttgaacaaggaccctgatattacatcgaaaaagaatcctacttcatgaccagtgacgaaaaccttaaatttcttagaaggaacatatatcaaaaccagaatttttatcctgcaaactaaacgtggagatttggtaaccaaacataccaaagaaaaaaagtgcatcttcaaacatattatattgcccttgttttgtgtttttatgggcttgggcaacaaaagtcttgaagggtcccaatatcagatattcggatccaaaaggaataatgttccatcatggtgagtagcaaaaaccttaatgttctttgaagcaacaggcatcaaaccaggatctctatagttctatttgcaagctaaaagggcagatttgataaccttgtcaagaaaataggtaactattaagtgaactactccctccgtcccacaatataagggattttcagtttttgcttgcaacgtttgaccactcgtcttattcaaattttttttgcaaatattaaaaacaaaaagttgtgcttaaaatactgtagataataaagtaagtcacaaataaaataattaataatttcaaaattttttgaataagacgaatggtcaaatattacaagcaaaactcaaaatcccttatattatgggacggagggagtatcttatatttatctgacagtccaagagattaggacatgccaaacaatttaatttctttcttacacgcataaagtaggcttaaagcctatgaccgtcaacaacataagtaagagagagctggcgattgcttgttgaatagcaagtatcaagatttccatcaactgactatcacatttaacttttcaaaatgtaaatgcttgcacatatacagaatatcaatcaacaacattcccaacagatatattgaaaattgcaagaaatactgaatgccacaaattattcattttctcagactcactcgaagtgatgcaatccacacggacagacggttacagttccaaattatcctgtgctaaaactatgcatatgccaggttgtttgcaaattttgtttggtcctttccattttaatttaatttgcaacacaataggcaattgatggtaaatgatccggcactgttttttctcctcattgatcaaacagagaaaaatggttccagcaagaatcaatgtgaaccctagccttgaagcactgactagccactgaaacagtggtataaccaaacaaaccaatggaaaattgtgaccaccacaattttttgtagaaaaataaggaatcaaacctcctggtttccagcacaaggatcaataactagatgaagtggtgaacagattcactgcaggagtgcacataccatcaagaccccagcccatgtataaaggacaaatgccaatagcatcacgggctgcaatgaagcttttatcacgtgtgtcaagaagaacaaaagcgaacatcccatccaacatatccacaaattcctccccatattcctcatactgtgaaaaagatcaatatgaaagtgtcaatacgaaggaatagtaagtgtataccaggcgatgcttagatgaaatttgagcaataacaaggtgcaacaaagagaacatgtaacttaccagatgagcaataacttcacaatcgctagcagtttggaatttatgagatttcaggttagctttcaattcttcatggttatagatctctccattcacctggatgtgtcaactacaagatcagatgtggttccacagaaactataataaggaaagaaatctttgatttatttcattacaagacattttgatgattaaaatattgtaccgttataagatgcaaagagctcaagggacatatttggaaagtcccatgacaaaatatttcagaaacatgctatttaccaaaagtagaatagcgaggcaaatcacatattaaaacttaaaagttaatgaaatactaaaaaaaaaatctgcggagggtgcataagggtcaatggaacagtcaaggtacataccgtcacaacaacagatttgtcctcattgtacaacggctggtctccggatgtgggatcaacaatagccaaccgctggtgtgcaagatagcaatcctgatagcagtgtataccactccaatcagggcctctatgacgtaacctatgaaaattggaaaacttgggttagtcagtgcataagcagttcaaaaaattctatcagaagatttattaaatctatgaaaactatgaattacataccgtcacaacaacctatgaaaaatgcagcatgccttgagtctacaacaagttggtactaattctatcagaagatttattaaatctacgttgaaaattatttgctctaatataaggacatacacaagaaactgtaaccattcagttcctaaagatcaagtggttgcagagtgcagactacagtgataaaaacatgccacattatactacagtagaatagaaagatgcattttctacatattggcaatccatagcataactctgagttagcaggcccacacttcccacaacaatagaattccaggcaaaacaaagctgaccgtattttacagattattaagcccattatatcgccattgtcgtaattttaaatcagaaccccgtacttgtcacagcaagcacaaggggcacatcacggaggcatgtgttacatgttacagttgacgtatataatactacattttaatcaaattggaatcaacatcatttaacggcattaccatgcaagagcacacgccagaggcatctcgtgcaaataaaacttgttgatacgttatcatttccgaatgaaaactctgaggaattagactcaccaaaacggtagctacactacatagaactccatgtctccatttccataatccatctatattcttatctctttacaagcttacacgacataaacactcctaaccagtaaagtcaccatccatcgaacaacccgtcattaatgatgcaccacagctcgctcccatattgataaccaaaaacaaaaacaacgttggatttacccccccccccccccaaacattccgacgaacttttcgaccacgttgaatcatcaaaattccgacgaactattttaacggagctatttgatagtcgaataaacaggacgccacctagagcacaaccatctcacggcggcgacgagtccaacccttccagatccacggccaaaatctccatccctcgattcagaacgaacacacgaacgtgcgcggaccagatatacagcgagagacagagagagagaaagagagagagaggggaaggggacgagggcggcatgctaccggcgggatagctcgatgatgcgggagcgcttggcgagggagacgtctgcgacgccgagcacggcgaggatgccacacatggtgccctccccccggcggcgaggtctcgtcggcggcggctgcggctaccacctctccctgtggctactagctagaccaagcggcgccgcctcgtgatgccaagaggagaatggaatccgcaccgcactgcctcgcgtcacggatgggtttaggagggaggagaggggatctaattagggctttgcgagccgctaatcgcgtcccggccgtcggattcgcgtgttagccgagtgactgcgtcatcggtggcgcacgcggcacgagggcggctgtctaatccggctcgcgccgaaagggtgggggtggttgtctagtgcgggtgacatgtggggtagagtgcgacgtgggtcccgattgcagtgggagagggtagagtggagacgcgtgggtattgtggagggtttggggggggggggtcagaatcttggaccgcgaccgcgcggggattctggccgtccacgtgaggcggattccgggagttgtgggccatgccgagccagtgggctctgggctgtgggctgcaatggctttttttttttttcttctgccaacctttttgttggtctgattctctttagtacgcttctgggtacgtgcggcatttccctcgtggatgtaaggataacgttagcgatatcgtccagctgatatgatatgtggctcgtgtatggctcagaagagttagcactgatggaatgaagtttgtttccatttcctcaactccaaacttcaagctcgtttttagttagcacgtttttcaaactattaaatagtgtgtttttgacagaaaaagctttcataatagttaatacttaattaatcatgtgctaataagatttctcgttttacgtgtaataaaaatctatctccaaactgctgcaccgaataaggcctaagggactatttggttgagtgtcaaacttaagcattttttttggtaattaagggtttgtttggttgaggactaattatgtcacacattttttgactaaggttactaaattgagtcttgccacatttttgtggcaaataaaatgacaaactaagtttagacaaagttagacaagaaaatatagtgtacaacatgtggcccaggtgactaagggcctgtttggcacagctccagctcctggagctggagctcagccaaacagtttcagctccaccaaaactgggagtggagttgggtggagctctctcaaaatgtactagagttgtggagctaggtttaggcagctccacaactccactccagactcaactcatggagctaaattcaggagttgaagctgtaccaaacaggtcctaagggttaggcaaagtagatttgtggcatgaaccaaacactacctactaaaattgtggcttacctaagttaaagcgtagcaaatttagttgccaaccttatagacactaagtttgatctactaagactaaagttttgtgtttgatttaagccacaaataggttatgccatattttaccatagtctacttgtcgcatagctagacacaaataagctgacctacttatcatagagctacttttttaccatggactatcacaattgtgacaaaaaattcttggcaacacaaagtgtgtcatgctacactttacaagtatgagagctatccaaacagcccttaaacaatgtgcacatgttgtttttttttttgaaactcataaagttttattgcatattaaacagagtacattggaagggaacaacattccctgaaacatcgccttgcaaaaaattgacaacaaacgttaaggaccattttcctgaaagaaggtaaagattgaatgatgaaagcaaacctccagatcatctaatacatcagtagtgaatacaatcgttggagatccgcggcattgccgcgacgattgcacccaagggcctcttcaaacgtgcttcccgcttgacctgccagcgatccctccggctgcctccacggatttggcactaattgaggtttggagttgagtcgtagatatgttggtggcttcaccggactcaaccaatgattgccatgaaagtcatcgtcaaatctgaggaacactaacaacatccctgccgaccaaagtctaacagatagtcggtgctcaacccgaacgataatctcgacatggatactgctgcaaaggaatgaaatggaagatgcacccaaaacccagctgaccttaagctttagagaagctagatggtggcgatgataaagtcttacgaacttaagatgtatcccatgggtgaggattgagaaggagacctcgttgccagcatgcacagaattgccgggaccagctttgccttgttgtgtagcttgttggttgcctgtatgatgcaggggattcatggcgtgctccttgctggcccatgacttgtgctactgcttggataactgatttaggcacagcagcaaattgatggagatgctgtcggtcgagacaatgttcttgatgctcgcatgggaggaatcagcaagcacgaactgcttcaacaactcagctaactctgcacctccaaacccaccaaatacgacgacgatctgggtgtgtgtgagcccaccctcaccggacacgacgcggctgagcacatcgctgaggaagggcacatcgccaaggatcagatggacaaaggggccgcgaaaatcggttgaagccatccagatccaccgcaaactatggctagcgacctcaaagagtcaaagcttgaagactttcggccaccggcactgtagctgaattttccacaatcaggcgtcgctagggccgacgaaatcgaggtctggcaccgcgaagactgacctccctggctgatccacccacaagatttcagatctgaagaagggaacactggactcttcatagaggaccaaagacgaagaataggaaggacacagaatgagactaactcgactacgagactaacccgactaaactactatacgaaggagacgcgattgagcctgacccctctccctcccgtcaccggcggcgagccaccggaatcaaggaggaagaggggccagagaagaggcttttttttctctgtctcgggcaagctaggaggttccagagagcactggagtactactggagttgagattgtaccacggagattgtgcacatgttgtgacgggtcattctagtcatcactagcggtggcgcgatggtttggcttcttttgattgaacttcgttggaatgtgctacttgccttagagcaagttttatagtaaatgtgactactagctctaattttaaccctatcatctactcattaattaaaagataatatgtacaataattttcttccaacacataaaatcccaataattttccaacacatagatcgaaaaacaaatattttcttgatttttattttcttagaatagaggggtttgagggggtgtgaatcataccttagataaactgttgaagtaataacgaaatagttcataattaaattaattgccaattcttgtgcagctacatatatagaatgaaaattgttgcaataacaaattagttctccaagttgccattagtggaacaaaggcggaaataaatcgtgtctagtcctcaactgattaaatagcttcctttatttgatgatataattcaatctcaagaagaatttttcttcttgcttatagcattgacatagatagtatgaaattgatttccttgcagaaaaaataaaacaaatgtagatcagtatgagaaacatagagtggcgacaacgtttggcgtgtcattgcttaggagaactttccttgtgcaaaatgcttgttgacagacttctcttttggctcgaggccttctgcttccgcactgaagctcttcttacctaagttgatgaagataaggctttgggagttttgggtacaatatggaggtcatattggcttttatgtaaaaaaagttccaaaattaaatgcagtctgatgacaaaatcacattcttcaaatattgatttttaaaatgagggtccccgaacagaggaccaaaagaaaccatttcacttgggttccttaagctaaacctg

SEQ ID NO: 10289 - DNA, 744 bp, Oryza sativa
  unsure (1)..(744): unsure at all n locations
cgttttagaacacctcttgcnngccgcccgcagaccgtctatagaggatccccgctacaggacactcaaaaaacgcgtaattagctgagggacaccgagaaaatgtttaactgctccaggacactacaaattgggtgaaatttgccgtaagacaccgagcttattattttatcatttcccggctgaaagtggcgagtattttttcaaaatgcctaaattgccccgcgtcccaatctatactctggagctttggagctgatgatggcatcaacctgctctttcggggagatgaagttgccgggacttcttgaaagtagaaaaaataaaccccattgataatcatattcaattttaaaaatctcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10290 - DNA, 837 bp, Oryza sativa
  unsure (1)..(837): unsure at all n locations
attgtatcggaatgatatgtgctcgtgttcctttcttaccttccctttcccatgtttgatgagattaattcccctncnttctctnctnncccccccagtgagtagatcacatatacctcccgcccgccgncnactttagaggatccccccgctccatcacgcccacccttgcctggatgcgtcgactagaggaaagctacactacaagcccagccgttgcccacgctggcttgtggtaagtacgataagttcttccagggcatcccgcgaaccggtccttaactgccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10291 - DNA, 1503 bp, Oryza sativa
  unsure (1)..(1503): unsure at all n locations
catgcgttgttgatcactaattcattccngccgcccgcaggttttcttttgaggatcccctcggctgaaacaagctcataagaaatggcataagaaatttgacaaaacattgacatctgcaagctttgcagtcaatgaggcagataaatgtgtgtattatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgagattacactcttgcagtcccattatgtggagaagatcttgaatcgctttggctacattgatagtaagccttctccaacaccttatgattctagcttgttgcttcgcaagaataagagaattgctaggaattaactggaatactctcaaatcattggctcgctgatgtacctggctagtgcaactaggcctgatatctcctttgctgtgagcaagttgagccggtttacctctaatccaggagatgatcactggcgtgcgcttcagcgagtaatgcgctatctgaaatgtactatggaattggggctttactattctgggtatcctgcagtattggagggatatagtgattctaattggatctctgatgtggataagatcaaagccactagtggatatgtcttcacactaggtggtggtgctgtttcgtggaggtcttgcaaatagactattttgacgaggtcaaccatggaagcagaactgacggcactggatactgctactgttgaggcagaatggctgcgtgatctattaatggatatgcctattgttgaaaactggtgccggctatccttatgaacagtgacaatcaaacggtaattgtcaaagtgaatagttctaagaataatatgaaatcgtctagacatgtgaaaagacaattgaagtctgttaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcctgtgaattagaacctgggaagaacaaaccattagtaaactagaggagagtaccaatctataccctctctaagtgaagatgcatgtactctcgtgagctacaaggcaggttggctatgccttaatgagttctgttggctttatattagccgaaaggaattgggccctttggtttcccccttttggggccccccaaaaaaagaaagcattcttgaaagaactcacctttgnnnnnnnnnnnnnnnnnnnnnnnnnnnnnnnnnnnnnnnnnnnnnnnnnnnnnnnnnnnnnnnnnnnnnnnnnaannnnattttnna

SEQ ID NO: 10292 - DNA, 7074 bp, Oryza sativa
  unsure (1)..(7074): unsure at all n locations
gnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaagtctgttaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcctgtgaattagaacctgggaagaacaaaccattagtaaactagaggagagtaccaatctataccctctctaagtgaagatgcatgtactctcgtgagctacaaggcaggttggctatgccttaatgagttctgttggctttatatagcgaagatgctgtcctgcagagcattcttgaaagaactcacctttgtaagcttgactgttggtcgcagtctatgaagattttgggtgaatcttctaggaagcttactaaagacctaggagtatgacttatatgctctacccgaggggtaaactacagacggtctagtaccagataagactctgagtgaaacttgcttgcacaagactgtcaattcaaggcgtagtccattgttcaagttgtgagtaagtgtagcttggagatctaggtggatgttcaaccttgatcggtctccatcgaaccgctggtatataaacaatacattggaaaagacaaatctcagtgggattctgagatttggttggggattgttggaattaatagatgggctaaggcccattcgaagattaattctttggaaaatcacaaaagcccacctcataggatggcatgcatgtggagtttagtaccaccttgcttattctaggagagggggacctccttaaaatggaggatgccctcctagccacttgaggcatgtgtggtggagagaagagggggaacacacgcgcgcgctcgctcgcctcgcctagcctggcaggcggcgcgcgtgcacgacgtacgcgtcgaatggtccgcaaaattggctcctcacctttgcgcagatgcagcctccttttgcagttttgttttgctgcaggaaaattcagatttgttttgttttggagtccggaaaatccggttcggtgcgtgaaaacggcgtggagtccggataagttacgcgcgacttatccggttcggttacgtggagtggagatcgtgcgggtgcactgagcaagcaaccgtcgccttatccggttcggttacgcgggtttatctctatataaaccgagccgccgccttcacgcaaaacacacgaaatcaatctagggattgcctcctcctctgtgttgtgccgtcgctcgtggactactccatcccgctcgccagcgtgcaccggcgatcgggagagcaggtatcccgaacctctgccttcgacgtcctgcaccgggagaaggcggcaataaggtttttgggaagcgcttcgcgcgctgctccttgttcatccgcgatggctcgccttcctctctgctcgcgtgctgcgcgccttcatcgacgctcgcaaccgcgagtagttcctgccgagcaaccggtctttccgccacctcggtacgtgttcgacatgttgcgcatatttgatttgttcatgttttactgcttagtttacatatgtagatctaatgatgcgttaatgctagtatacatctgtaatgtcatgatttatttatggaatatattaaatcattatatgcctatattctcaacatacttcaagtccctgaagcttttgctgcccacacactcatggtgcaaatgaaacgtagttcatattgtccctatagtcacaagtgtcaaaaatatgagatttgctccgtccaataaaaaagtacctcgacgtaccagtacctcacggtaccaaatcatttctgaccattggatctaacaatactcgtcatgcccaactatatccaacgatcgaaaacgatttggtatcatgagctaccgatacctccaggtactttttgctggaccaaagagcctcgcatgtgcccatcctaaaaatcacaaaaaggaataatgggcaactaaacaactgattttacaaccggggcatgcacattaaactgtaagatgtggagggcataaattacacgaaagctaaagttgtaggaccagaactaaccttattttgatcatagtttcacaatgtatgttccacctttttgcgaacaatgttctgttgagagaaaaagtttgatttgtagctttaggccattttcaaggcgtcctgtgttagctcatcagttggctgcaatgaattataagggtaactccttgtatatgataacaactctgagaggtgaagggtaactccttgaatatgataacaactctggcaggtgaagaatatggttggaagagagagtatgtgccaacagttcttgaagaatgtggctggaagagagagtatgtgccaacagttcttgaagaatgtggctggaagagagagtatgtgccaacagttccatgacaacagaccgcaccataggtagcaattccatggcaaaatgcagataagcctcaggtttcggatgagacgatgcatatgttgtagctatgtaagcagtaacatcccaacttgatgtcttatatcattttgtcccgctgtctagattgcttgagtaagatctagattacttttgagcaaataaaccatggcatcatgttcagagaggccagaaacacgggcaaccaacacattgatgagaccatccaaagattgagactcgatacatataaaaatttgagagcttgatccggtgcaggaaacattggattgagtggcccgtaacaatagccggccttgagaaggccgtggtgataacggccgcggaaatcttccatagggatccgagaaattgccctgaggtacacaccatggattctgtccagaaaaatgccccggagtgacagtgtcaatgtaggctgaaccttcatttcgaatttatggcatctcatagcagcaagatccataggattgttcaaattcttcagatccagcggcttctgcatcaatctggttaacctggtcacatcttgaatcgagaggaggcgacgacgggccggaattctctgcagacaaagagtgggcgaggtgagacactggcgcggacaatccaatgaggaaagcatcagcatcaacatcaggcagcctcgtggacaacgcggcgcatctaagagcagccttggcagcatgtgagcggaattggaatctgtccttgtgacgatgatggtggcggtcaacctcgatgaggcggacggcgagaaggagatccgccatggataggcggaggtagcggagcgcatcctaggtggggagatagtggtagtacgatgtcaaggtgatcaggccttccagcgagcgctccgcgacggtgtgcgcctctggaggggaggggacgtcgccgccggtgacgatcttagagaggaccatctccccacttgctcttgccacccgcgaccgtgaggccatggtggtctcccgcttcggaatcatggcaccgtcggagtcggggagttcgctggggacgacgcggagggtgttggcgatgatgttgttgacagggtcggcgaagccgaagtagacgcctgcgttgaggaggcgtgtgttaacgaccaaatttggtaagatatgaaccaggttcggcattggaatcgaagcagattcggcaaagagttagattcgaagaacagagtatgcatcggctgcgaaggcatcggctggagtctgcatcgtttgagatggatcggatagagaacaacggatacagccggtagagtcaatacaaccgattccgatggggatggctccgaggctgtttctagaatcaatcaacgtgcttcacaaggattgccacgatggagataaatctctcagaaagacaattatatatattaattaggatatttcgtgtaattctctttagagatatgtttgggcaaaagtctgccgcaaagacttatggtatcttagagtttgttagagataagagttgtgtccggcaaggacatattttgtatctcaggtataaatatgacctgaacggctgaacccaatgtaataaaaaacaacagttcaataatactttcggtgcatcgccacccttttactttcgttctatttcgacgagttcctacttttgggttgaactgcatcggtttcgatcttcaactagatgaaacttgtcatggcggtttgcgttctccggattagtgtgtccatctttatgacactctaatcctgtttatgtaattcgtcgagttatcatatacactctgtaatctctgttagttgcgctatatgacttgtcatcggctggttcttactattaggaagtaaacgatagagttatgttttgttattaatctagattatataatgtatctaccatctcttagaggttttcatcctcttgcctagatcttatacttgtctttatgcttaatgctacatcggttgaattcgatctattaagtaatatctataattaattatgatatctggcttgttttatgattatcaagagagatagcatcggggtttcagccgatcttacctgatttagctactttacatctcatatgcttgattgataggctagatctaccctttagagtgagatcttattgcattaaagtatattagactttttgtttgatatattttgcctgttttaatatcttagtataaagtggtatcggagtattagccgatacatgctagatctacctgatcggctatgctataaacgtatatataatcattactttagtgtatacttcgactttagtgatttatactatctcggcatggcgaccgatctatcccaatcacgtagtttaaatatacatcgaagaaagcattatatatcgttaatatctacagccgatcgagtagatttagctttatcttatttattcataactgtcgatcgattccaacatgacatcggctcaaagataaatgatatgtcatcggcaactagccgatcggctatcgtttatagatttaaccgcggtttttcttatctttctttcttattgattgcatgatcaaatcaactggcacgctcacgaacctaaaagcaagattttggacctgcactgaagttaagcagatcttacaggctagtgtgtgtttttagcatcaatagcgtgcggcgagcactagcacacggtccagcgacagcgcgtcgagcgcctcctcgtagtacccgtacatcagtcctagaatcacgcgtctgttgcgagccatgccctcccgcgagcaatcggaacggtttggcccgacgccggagtcgctgccgtctccatcgcggtcgctcccgcctcgcaccgctgtcggccggccatgatctggggttagggtgagcgtggatcacaggaggaggagggaaacagatcctctgacattgggtggaaagtcacggtgttgcagttggtttcatccctgctgaccactgcatccaacggcacacatccatcttccctccttcgaactgcatattgtgcggcccagttcgatttctgtggccatcggctaggccatcaggtcacaatgaccctgttgcctgctactacatgcaaggactcagtctcgcagaggacaaggctgtcaagtctacaacaagaacaagagaaccaaaactactgaagcataaaactgctatcatttagaataattcaaaataagacctaagtttcaactagcatcattcatgcattgcaaatcaacagctgagtttggagaacactacaaggcgtggctattgtgactaaaacagtagaattgaaaaaaaaacaaaagtattgcactgggtacaagcagcgtgtgtagccaagattatgcggtccagtaacttcttaacatgccaactcattgcagcttttggcctaatccctgaattaccagccgcttcaatttcaaaggcttgaatttctgaaatttttctttgtgatgccatcaagtggatggtttctggcaaatgaaggatgtgattatgctcaagaactagatccgacacttgataatttcctacctctcgatttattatgagacccatgcgtactttacagtcagttctagtttcagctctaggatacctagtgagatgatctcttttgtcctctgttcgtcgaccctcatttgaacatacatatctgcaggatgtgatcttgtcatcagacttgcttttatttttgtatcttttttttacatcaaagcccatatgacctccatattgtacccaaaactcccaagccttatcctcatcaacctaggtaagaagagcttcagtgcggaagcagaaggcctcgagccaacagaggagtctgtcaacaagcatttctgcacaaggaaagttctcctaagcaatgacacgccaaacgttgtcgccactctatgtttctcatactgatctacatttgttttattttttctgcaaggaaatcaatttcatactatctatgtcaatgctataagcaagaagaaaaattcttcttgagattgaattatatcatcaaataaaggaagctatttaatcagttgaggactagacacgatttatttccgcctttgttccactaatggcaacttggagaactaatttgttattgcaacaattttcattctatatatgtagctgcacaagaattggcaattaatttaattatgaactatttcgttatacttcaacagtttatctaaggtatgattnnnnnnnnnnnnnnnnnnnnnnnnnnnnnnnnnnnnnnnnngtatatcaatnacaccag

SEQ ID NO: 10293 - DNA, 4466 bp, Oryza sativa
  unsure (1)..(4466): unsure at all n locations
ccggttgttgattgatccaacnnnnnnnnnnnnnnnnnnnnnnnnnnnnnnnnnnnnnnnnntaatattagctactgataaatatgtactaacacaaaaaaatatcaaactgggtatattctaatttcatttattttgggtggttaacatggatattctgtaaccaaatgtcaactagttcgcttaggactcacaaattttactaaaaatgttgtaccgaaacagcatcctattctcgagttccatttatgttccaagattaacaggcatcacgggttgtaaattgcattgcggtcaatctatggacacgactgatcatgcgctggtacactagcatatgcaaataaaaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttcttttatcaagcctttgcagcagtcctttcacactagaattccatgtagtcattatgctagaagtatccgcataaaggtttgatggttataatctgacaaaatacaaactatctggtggcatccaagcagttattcaaccaaatatccttaaacatttgcaggtcatgaactcaataggtcaatcttcccttgcagacagatgcctaatgcctctgtagacatgtaagtatgcaacccccaggccccatcacatccaccagtaatcgctttgatcgattgtgaaacacagaggtgctgaatactcttcaaatgaatcaattcaataagcatatcttgcaaccaaggagatgaatagagtcacaaacaaaactctgcacaaacttatcagcggttatcatcattaaacagcaccttgtaaaacttcctcctctcctccctcttctcagcactatccaaccgcgctgcttcctcatcgtcctcctcctcttcctcctttatctcaatctctcctctcctcctcttcttctccaaattatccgaacgccgccgctgattatactcatgcagcccctcctgcatcagctccccgagcctatccttcgccgctaccaccggatccttctccctaagctccgacccctcgtaaccctcccggagcaccaccgtgtgtatcttgtacctgtttgagacgtagaagaggcacggatgccgatgcagcatcctcgccgtgtcctccggcaacccgaactccctcctgaaatgctccagcttcagaaccgacatctttttccacaatgtgagcgagaggagctcgtgcaccaccgccaccgctcgcttctcggcgtcggcgtccgtgcctatcgccgcccatctctccgagtacggcgagatgtacggcgtggaattgaattcctccatcttggcatgagacttggcccaggagggcggcagcgagcaggtgaaccgcggggcggaggagtcggcggcggaggcggccgccgcctcgacggaggagacggcgagggaagggacccaccggagaagctccagctcggcggcgttgcggcggtgcgggtaagggttgacgaggcggaagaggtcggtgcgggctgggaggagacggaggaggtagtcgtcggggagtccgagcgggccccgcagcgcggcgagcttggacacctggaggcggcggccgcgggcgagcatgagcacccgcgcgaggcggtcggccatcgccggctcggacgccgcgacggccgcctcctcggcgtcgaccagcaccgccatccgcttggtgaacccgaagcaggcctcctccccgccatcgccatcgccgccggcgccgccgtggaagaggtcgaagcaggaagggtacttgcggagccagttggcggctcggccgaggaggtcgagcgtcttgaagcgggactgaagaaggcggacggggccggtgcgggacggnaaacgagaaggaggcgcttgatctggttgttcacgatccagcggcggttgcggcggagcgcggcctccagcgccgggtccttcggggaggaccaccgtgccatgcggcggcgctccggcgacggcggcggcggcgggagggaaggggtgtgagagtgtggtgaaccgcgtcggagtgttggacggctgagattggcttgcgataatgggctgtaggattgtaaaaatgggccttgcatatttctttaatgggcctgtttgttggcaattggaataggttcactttagattcctcttcttgacgtcgagtttaaatcacgccctgaaccgcaataccagaaatcatgactcccaacttgcatcccgggttaaattaggtcctctagcagcatagatttgatttggtagatgaaagttataaatttgtactagtactaataattatctcaaccgtttaatttggtagatggaagttataaaaaatttagatgcattcatagcatgacatgtcagtgttagtactaagaatttacgtaaccatcgtttctcttattcgcgaaataagcaaaacggtatattcgcaaatgaaaagtaatttgtgaataaaacttttatatatgtgttcttaacgatctaaaagcaaatgctgaaaattaaacttcaatgaaaaaaaccttaaattcaactccaaatttatggttgaaaatttaaattttggctgataagtataaatataagtgaaaagttgagacccttagttagaaaaagttactccatgtttatatatatttttcctatttttttaggttatagttgacttgtagtattaagggggtgttcgggagagtttagtcccttttgatagggattaaagttttggtgggagagagatagtccctctctcccaaacagcccctaaacttgctcttatggaaagaggtagtacgtactgtacgaaccaagtgcaagtttgaagtttcccaacacgatggcaacatcaggcacggcgatgcgaggtggcgctaacgtccaccgtgccgaccggtttggagcctcctccccgcttgcaacgcaggggacgaggagttaggctctgttcgttctgggggacagaggagattgtgtcccgtcttccaagcgcacatttttcaaactattaaacggtgtattttttttaaaataaaattctatatgaaagttgatttaaaaaatcatattaatccatttttaaaatttaaaatagttaatactcaattaatcatgagctaatggcttacctcgttttgtgtatactcccaatctccttaatccccttctgctcaaacacacccttaggccaccagctacatgcaagaactgcaagctgcagttattaggggtatgtttagtttcaaagttttttttaaaactttcaactttccatcacatcaaatcttttatatatatagtaatttttcagtcacatcgtctctaattttaattaaattttaaactttggttgaaactaaacacactctagatgatgatgcgatgaattctgaaccgggggcctactaccgtctaccactagtctggtccttcccctcgagtaataaacgatccaggcgctgctgctatgctgctgcctgctgctcaatggccagggccagcctgatcctgcagatgatgagtgtggtagagagacagagagaaagccagctaggctatgcatggcagaaagtagtataggagtatgtgcctctaggcacaagtacgtactgtactcctacaggtacagtagagtaactggacggatagatggacgggatcgtcactgtcctcaccctcgtagattgcaccccaaggcacaaaactagggctttgcgtcaaaatggccagagacccgtgccgcggtggtccacgaaagaatctgagagcgcatgtacgtatgagtatcatcttaaggatatgaatgtgttcaaagattatacgttatgttttttaaaagtgtgtttaggcccattattagaattagattttttttataggacggagggagtaattggtaactaagctaggcttaagttactaatactctccctaaataactcaaaccctagcttcccaaggagttttcaaggaaaaaacaaaatagcacaatacccttaattaatgtgaattagttgggtgcccgcgcaattgcacggctagcaccctataaaattatctattttttacatatgattttatgggtaccgagctcgatncaacaaanncacatca

SEQ ID NO: 10294 - DNA, 4714 bp, Oryza sativa
  unsure (1)..(4714): unsure at all n locations
gtggttgatgaacnnnnnnnnnnnnnnnnnnnnnnnnnnnnnnnnnnnnnnnnnntagatatataccctacccagaatgttaggaggaacaacgaacggtgctattttcaattggattgctgctagcactttagctttgtaattttcgagcgccagccacatcatgtgctgttatgccttgagaattgtcgtccaattgtccatgctgccagtgccaggcaccacaacgtcaacggtgaagggatgacttagcactatcggtagctttctcgaccaatgctacaaatacataaagcgggagggaaggggacttctaatttgttttatcttctccgtttacgatttctcttcaaacttctgtatgtaatgtactcgatctgattaattacttttcttgatatgactctacatacggactgtatctataaatcttttttctactttctataaataagattatattatgtattaatctccaccatcaaaatagagatcttctacaatctaacgattaatatctttttctttttcttcgattaatatgggaatttctaacgctcacagcgaacgtggtgtcttctttcaaagctgttttaataatataatagatagatgttgtattgaatgatgggtaggtgaggggtattgaagtaataaaatttctcgttttgcagattggtggaacttcgtaggcaagaagtttgaagttggagttggtttattttaagacaaatttgaactttagaagttgatttattttgggattttaggatttaaattttatcccaaaagcatgttattttagagtaatttttatcacatcaatcacctcgaattcaaagttttctttattctactctcaactatcatctcactcccaaccccatatcatttatcataatcatttttgttaaaatttagattttactatcttcgtcccaaaataagtacagctgtgggtatccatgtcaaacgtttgaccgtccgtcttattttaaaaattaaaaaattaattgcacataaagtactattcacattttatcatctaataacaataaaaatactaatcataaaaaatttcaaataagtaggatggtaaatcgtttgatatgaacagtataaaactaactaaacaacctcaaatgataattattgtaggacggaggtggtacatattgaaacggagggagtaaattttatactcctgcgtagtaatagtactagtagttgtaatcttttactcactttgtccaaaaaaaacttaagctaggtgaagatgggatccatcattctatccaaatttcttgtaatataatagattgcatttccacctagattggtttattttatggaggagaagtgtacactatgactgtttgtttatgataagatgcataatttaccttaattattgttagcacgattttcaaactattaaataatgtgtcttgcaccaaaactttttgtaaatgatgctctaaaatataaataaattcatttttaagtttgtaataattagtatttaatttattattcacccatagcttatctcgtattatgtgcatcaaaaaatcttttatcttaacctataacaaacgaggccgtcattccatctagaccccatttgttataggtggagtgacagccttgctttattcggcaatagtttaatctcgtattgtgtgagttaaagaaaatatttatcttgacctacaacaacgaggttgtgtttaggctgtgtttagttccacgctaaaattaaaagtttgaagaaattggaacaatggtacggaaaagttgaaagtttgtgtggaggaaagttcgatgtgacagaaaagttggaaatttgaagaaaaaagttggaatctaaacagggtcttagaactgctggttcacatctcctatttctcgttttttgtgcacacgatttttaaactgttaaacagtgtgtttttttgccaaaattttctatacgaaagttattttaaaaaaatctgtgcatgctaggtaggcatggtttagttcctaactttttcttcaaacttccaacttttccatcacattaaaactttcctatacaccaaacttttagcttttccatcatatcattcaattttaatcaaactttcaattttaacgtgaactatataacacaccctcctattgttgcgaacacagccagttggagtggcgggctcgctctactcctagatccaccagattcgcatcaaaatactctgatgcctagtataccagtagatactcccaggtatacttacactgtttctcggtactcccatttactggggtagtactcgtagcacgaagtaccagtacactctactcctattcgtacctcttactcgtaaagctgtagcctgtaggagtatttatttttctccgtccacgcaacgcattgcattgcaggctacagtacgagaagcaaaaaaaaaaaaaagctttcagagccaaagtcgtgacaacataatctcaaaaggaaaaaaaaacaaaagaaacaacggggaaaggaaatgaatcgccatcaatgcaacgcaacgcaacacaacgcaatgcacccccccccccccgcccttttcccgggccagtttcgccgtgcccaaatcatgacctcgcgcacgcacacgaacccgcaaacacaaacacacgcgcgcacgcatcgtttcgcactcgcaagcgcaacgcgcaagcggtgatccatccatcatcccaatacatccagcgcgtcgtcaccgcgggaagccagcgtgcggcaacggcaagcggatcggagctcccccgtccatccatggcaaccacctgccgcggccgggctgctgcgcgcctgcgcctgcgcctgcgtgcagcgatgctcctgtcgtcctggggctctgctgctatcgtcatttccgcagtaattgcggggctgtccagtgtccatcgcttcccgcgaaaagtgggaagcaaatgcggtggcagctctgccatctctgggcgctagctgctgctctgccttgcctgcctagcttccgtttctcctcgcacgcatcagcagcagcagcagcagcagcagcaggtcgcatgcgccacacatttcccgtaacttgatacagccactaggggtacgctggtcgcagtcgcagagcaactagctggcccgcgcgggcagcagagtgcagaagaagaggtgggggtggaggggttcacggcttgatagcgaaaagaaaacaatgcccactttcctctttcaaactccacgcactctctcggtttctcgtgacacaaactatggatgatcggataacgtaactttcccttgccttggtggccgacatatcggcccgatagtggtgaggcttacagtacatatttcacggtgaatagtcacgtcagacgatccttttccgataatagagcatcaacggagttgtttgaaatgcttgatccagagattaatttttagtctttatcacatcggatgtttggacactaatttaaagtattaaatatagactaataatagaactaattgtataaatgatagctaattcgtgagacaaattttttaagcctaattaatctataattagcacatatttactgtagcatcacataggctaattagagattaattaggctcaatagattcgtctcacgaattagtccagggttatggaatgggttttatcattagtacgtttaatacttctaattagtatcaagcatccgattggacattgactaaaaattggttataaagaaaaaaaatcagtcatgtccgtttggcgcacacactctctctaaattcaatgcatggttattttatctccaactacctgggtggcccgcgcgattgcacggttagcacataaaaaaatcatatattttttagtatgattttacttaaaatttattaaatagctaactcgttgtcttcaaactttgaaataccaaatgttatcatccccgtgtttctaattatatagtttttaaaagtcacagtcgctaccccttacttctgacatctcctttatttatttgctcgatctaccactatttatattcattcttcttggaacctttaaaaattggatcttatagtttttagagtttattgccttgttgggtttctttttataatttctagaagtcccatcaaatgttgctattatactcctttatggcccgttgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttataaatggacggagatttgcacggtcgtcctccgaacatcctcctgacgggacggcacatacctacctccacttttgcctgaggcgggcacgtcctgggaaggtggctgtgtgcttacaacatgagcagtgttagaccggtcacaaatcggtattttttg

SEQ ID NO: 10295 - DNA, 6669 bp, Oryza sativa
attcacttgtctttaaaaaccaaaagggcttacctcccaaaaagagcctgtgaccacagcattcctctaattcctgatgctaagccagtgaatctgaggcctttatagatacaacccctgcattgaaggatgagattgaagcccaagtggccgaaatgctacagtcaggggtaatacagcacagtcagagtgccttctcttcgccagccttgctagtacgaaagaaggatggaacttggaggttagtgattgactaccgacaactaactgccattacagtcaagagcacatacccaatgccagtcattgatgaactattggatgagttatcaggagcaaaatggttctccaagcttgacttgagagctggttatcaccaaatcaggatgaaggcaggtgaagagtataaaacagcattccaaacccacactggacactatgagtataaggtaatgtcctttggtctcactggggctcctgctacatttcaaggagcaatgaatgccacattgcaatctgtgctcaggaagtttgctctagtgttctttgatgatatattaatctatagtcctgatcttgagtcccatttggatcacatcaaacaagtactatccctgttgcaaagacaccaatggcaagttaaattgtccaaatgctcatttgctcaacagcaattaacctacttgggtcatataattagtggagcaggagtatcaactgatcccagtaaggttcaggaggtggtggattgggccattcctactactcctaaaaagctcagagggttccttggattggctggctattacagaaagtttgttaaggggtttggcattatcagtaaaccacttactcaactattaaggaagggggttccctacaaatggtctgccgagactgacaaggcattccagacacttaaacaagcactggtaacagctccagtgttagcccttcctgatttcaatcagccgtttacagtagaaacagatgcaagtgattcaggcattggagctgtactgtcacaagggggacacccaattgcttttattagcaaggctttgggtcctcgtaccaaagactttcaacttatgagaaggaatgcttagcaatattgatggcagtagaacactggagatcttatttgcagattggggagttcactattcttactgaccacaacagccttatgcatctttcagatcaaaggttacatactccatggcaacacaaagcttttaccaaactgcttggattgtcatataagatatgttacagaaaagggagtactaatgcagctgctgatgcactttccaggaaattccaagatgaatctgagttaaacttggtttccagttgtactccaacctggttgttggatgttgctaagggttatgagactgatcaattttcattagatttgctcactgctctagctcttaaaccagatgcaaagcctgggtacaccttgcagtcaggaattataaagtacaagggacgaatctggattggtcagaacagcactatgcaaaatgcgttacttgcagcattccatgccagtcctattggagggcactcaggattcccggttacttatagcaaattgaagaaactttttgcatggcctggaatgaagcaacagactaaacaatttgttcaaacctgccaaatctgtctgcaagctaaaccagacagggcaaaataccctgggttactgcagcccttacctgtgccagaagggtcgtggcaagtggtgacactagattttattgaagggttgccaagatcttcatcttacaattgtatactggtggtggtggataaattttcaaaatatggccatttcttgcccttatcccaccctttcacagcaatagatgtggcaaaaacttttatgctgaacatttataaactacatggtcttccccagactataatctcagacagagataagatctttacaagccaattgtgggagcagctgtttactagatcaggaacacaactgcatctgagcactgcttatcaccctcagtcggatggccagactgagagggttaatcagtgcctggagatttatctcagatgttttacacatgcaactccttctaagtgggcagtgtggcttcatttagctgaattctggtataatactgcattccactcagcactgaatacatctccctttgaagttctatatggccacccacccaggtattttggaattcattcagaggattgtgctattcctgaactacaagtttggctcaaggagcgtagactgatgcattcattgattcagcagcaccttaaccgagcccagcaacacatgaaaaatatggctgacaagaaacgcagtttcagatcttttgaattgggtgactgggtttatattaagttacagccctatgttcagtcttctgtcgcagctagggctaatcataagcttgcattcagatattttggccctttccaagttattcagaagtttggctctgtggcatacaagctccaacttcccactactagttctatccaccctgtgttccatgtgtcccagcttaaggcagccaagggtttccaaggagcattgcactccactctgccttcttctgatgatgctttccagtatcctatcatgctcctggataaccggctgattaagaaaggtaacaccaccgtttcccaggttttaatacagtggtctgatactgcagttgaagatgccacctgggaggaccttgaggatctccgggcgcgttttcctgaagctttggcttgggggcaagccactttccaaggggaagggattgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatctggtggcgaatggcggcggcggctcaaccctgttgggttggagcaagattatcctagtaaaagattgcctaaacacatctctgttcttcctgagttgttcgagttcttccacttttccttttcattttccttagttgtgttgagtccatctggtgacgctgacagtgagcaacatgtgtgatagcatgtcgttccaggcgtcaatggcgccgggaacacaccagtgcacgcagtcattgaagatggtgaagtactctttcatccattccttacgacgcgtccatcccctgtacctgctcgggtgcgcgtccgcccgccgtatcatcgcctccgtcgtgtccatcagcatcatcctcaccccgccggcgctcgccgcccttttgccgcctcgaactcctccacctacgaagctcagaacacacgtttactagaaagaacaagataattgatcactagatcaatggagaaaaatcaagaaattaacctgcagcgtgtggaagtcgagctcgaagccctgcagcgtcttctcgccacgccggtacggccgcgtccggacgcagttgccgtccttgttccactccccgccctcgtactgcgacggcgacacggtccgcagcacggcggtgacgccgccgccgtcgctgctcaccacggcgcggagcgcggcgcgggtggccatgcggagcgcgtaccgcagcgtgaggtcggtgacgttggggaggaggcagtggtggcacccgacgagccggccggcctcgtacagcatcgacgggcggtagaaccagctcgacgccgacacgacggcgtagtcgaacgccgggacgtgcggcgcccacacggcggcgggctcgtcgaggtagaggttccacaggcccgtgtgcgccggcccgtcggcgtcgacgagctcgctccggaccaggaacggcgcccagaagttgaggacggtgaagttgtagccgccgccgtagtggtacaccgtgtgctcgctgctcggccagctcgtcgttggcttggcaacctgcaggccggccaataaaacgtcacaccctttgctgctggcccatttctgaccgtccgatcaagcgatcaatgattcagatcgaagctagtactgtagcaaatccggcacgttttttactttttaccctggtcaggagacagatgagggagttcatgtggttcttggcaagggaatccccaatgaaggccaaggtcttgcccctcatggcagagaggaagcgcaacgggtcgagacgggggagatcacaaccgtcgggacgccaccgccactgcacgaagccaaggtccagcttgccgtacttcatacagtcatagtgctcgtgaatgaacaagcaggtgtcgttggtgtagtagggtgcatcagggtctggcacccattcgcctctaaatatgtcgcaggcctcgccgtcagccttccggccaccggaggaggtggagaaggaagagtaggacagccaggcggacagtgttcacggcataaccaccgggaaagggaagtatgtgtcggagacggcgatgacagcgacgagtaggaggatagagatggcgggaatcaagcacctgccgttgtagtactgcgtcttgacaagaaaattgcagagattattaagaagcgccatcgatcggcactaggagaaaactaagaatctatatttatgtgagaattgggtgtgaaacaccggtggagttaattcaggtgtatatataagaaggtgttcataatctcaatgtatcggaattttggttttttgggggtccactgctactggcctagtaatataatctccgcagcacacacagtctgtacgtagtatggcgtcgcacctcatggcaccgcgagtctctgttggcatccatgttacttcctcgcagcaaagctcacagatgattaaattgttggtaagttatgggatccgagggtctcgagcatgagcaaattctctcggcgcgcacatggacacatcacacatggttggtgtcctctacagaaagacccattttgtcttctatcgaaagacccattttcactttatgtctgtattgggtagaatctcccacttgttagggcgaagctaccatgaagctaagagctagcagaacgaagaaactgactatgttggtcatctaggcatatgacttcaacactcataaaaaagtgctcacatgtactccatccgtcccataatataagagattttggtgggatgtgacacattttagtactacgaatctggacagagagcttgttcagattcttaatactaggatatgtccacaaaaatcccttatattataggacagagtgagtaattatgtaaattattatcctttcccctcccacccgaaaccctcactgcctcttccccttgccatgccacctgagctactgacatcccgtagctgctaggacagcggaggcgaggcttgtgcatcagtaccaggtgaaggagtggtgcggcgacgtaggcaggtggcaacactggtttcggctggtgggcggcgcattggtggaggcgcaaagaatgtgcttttaggacatgtatagctccagcatttgctttctgcaatgattggcactttttcttcaatggctatctattagtcttcatttatcaatgttttccaagttctgcaacaaggaaaataaagaattttatgtttgcaaagattagcactctcttttcaatggctttgtggcaatcctcatttcccacagttgccatgccattcaacaaggaaaataaaggcgcattcatgaccttcactactcatttggttctcaaactgtaaaatttcctttacatatctattactccatgtatttcaagctttgcttgagcatatgtccattatgaacgctaaatatcacaaagggatatgattaatattagctactgataaatatgtactaacacaaaaaaatatcaaactgggtatattctaatttcatttattttgggtggttaacatggatattctgtaaccaaatgtcaactagttcgcttaggactcacaaattttactaaaaatgttgtaccgaaacagcatcctattctcgagttccatttatgttccaagattaacaggcatcacgggttgtaaattgcattgcggtcaatctatggacacgactgatcatgcgctggtacactagcatatgcaaataaaaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttctt

SEQ ID NO: 10296 - DNA, 7106 bp, Oryza sativa
  unsure (1)..(7106): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaacttgccattggtgtctttgcaacagggatagtacttgtttgatgtgatccaaatgggactcaagatcaggactatagattaatatatcatcaaagaacactagagcaaacttcctgagcacagattgcaatgtggcattcattgctccttgaaatgtagcaggagccccagtgagaccaaaggacattaccttatactcatagtgtccagtgtgggtttggaatgctgttttatactcttcacctgccttcatcctgatttggtgataaccagctctcaagtcaagcttggagaaccattttgctcctgataactcatccaatagttcatcaatgactggcattgggtatgtgctcttgactgtaatggcatttagttgtcggtagtcaatcactaacctccaagttccatccttctttcgtactagcaaggctggcgaagagaaggcactctgactgtgctgtattacccctgactgtagcatttcggccacttgggcttcaatctcatccttcaatgcagggttgtatctataaggcctcagattcactggcttagcatcaggaattagaggaatgctgtggtcacaggctcttttgggaggtaagccctttggttcttcaaagacagatgaaaattcctgaatgatttgctgtactgatgccggaattggatcagtggtagtctgtaaaactgaagctaattgcactaagcaaagtattgagccacatttagccattccttccaactggtcagaggtaataggacaacaggttgttgtatgtggagtaatgccaaataatctcacaattttaccagatagttcaacatccatccatttgttaacccagtctacttgcatggggctgaatctttctaaccaatccatacccaaaatcacatcataacttcccaattgcaatagtttgaaagtgtttttaaaattgtgtccttgcatccaccagctgcaatcaacgatttcatgtgtacaactcatggttcccccatctgcaaccttaacagtgaccggcttaggcaaaggagagattcctggcaacttctttcccacacctagatcaataaaagaatgtgaacttcctgaatctattagcataagcagttcagctccctgcacccatccccttaacctgactgatctattggattcagttccccataaggcttgctgagaaatagccattagcatactagggtccccttcatctgtccctgttgtgtcactgactggttcaggctcatgctagtgtaatgcttcaatcaattcctgcacaatatgtaattgaacagaagttgcacatttatgatctctgccccacctttccccacaaacaaaacagagtcccttggatctacgataagctttcaatgaagccaatctgtcatccttggccttggatgcatcgattgcccttttatcttctgtcataaccacagtaggagtcctaggactatgattcactggactgaattgattagttctaggaacctgcctgatgctagaagaagattcagttcttttgctgctcacagtcttgataccctccaatatttcctcttgtaacaaagctatagaacaagctgagtctaaatcttggggcctttgcaacattactgctcccctgatctcatcccttaacccttcaatgaacttttggacaaagtatacaggagttaaggcactgtcataagccataagttggtgcattatgctgtcaaatttttccacatattctgagactgaactggattgttgtgcatgaaaccactgacggattagagcttcctgtctatcacgggtaaatctagcacacaccaattcacagagagtctgccaggtaatccccacaatttgttgcctaattgactgcaaccagaacgatgcattgcccccaaaattgagcgtagctaccttaacccagtgtataggatgaataccatatatgtcaaaatactgctcacaattgctcttccacatctggggattctctccctcaaatctagggcaggacatagggggcagatttgtgctcaaatcaacatactcagtggaagaattcggggaagttacagcatggtcaccatcagaattagcaggggaaaagagattcgggtcgcgcttaccagcaagccactgtgtaccatcgctggtctgagcagtcttggatagagtgtgctctatgtgctccaccttgacgctgagatctcccaccgcgcttcccaactcttcaaccttcttctctaccaccggcaatctagtctcgatcgtcttcctcagctccgcgaaatctccacgaacacgttcttctgcttccaccctcttcttctcattctccgctatggtcttcaagagcagatccagtttgttgtcttgagccatggttcctcaagcttccttcaacactaggatattctgctcagatctctctcacccacgctccgaactcgattaaccaggagaaggcaagttgccttttcgcgggattcaattccgaagaatagatcccaatccttccctggaattttacaaccaagccaagagaattttggggcgaaagggctctgataccagaaattgtcagcgtcaccagatggactcaacacaactaaggaaaatgaaaaggaaaagtggaagaactcgaacaactcaggaagaacagagatgtgtttaggcaatcttttactaggataatcttgctccaacccaacagggttgagccgccgccgccattcgccaccagattgccaaaagtcccttacaatttagaaacctcagttcttatactctctctcgctaccaactcccttccttcccctctcacaagacagatgccagctcatgccagcgatacaggttacatggcccattccggcccaacatatttacgattaggcctaatgactctggccggcctcaagtcttcttctcctccttcctgctcaccatccggcacaggcttcatcttcagcttggcgcttgcactcggctcctcctcgcctgacgccttgacactcacatcgcaaagctaattaggttattgatcaaacgaatgtatcagccaaaaaaatagagaaaaacattcactcctgaattcacgctagaatttcaaaatcaccgtccatgatccatgtgaatttctagcacgttgcacaagctgaattcaaaacaatttggtcctgtttgctgcatatgcaagggttattctgatttcatctgtatgactgtatggggcttcttttagatagtgaaaagaattccggcatttgctttaaagatgctatagccacttattacataattcacagcttataaaaaccaagaaatgactagacaataactaatgataccaacacaagacatttattcaagtctgtttgtaaatcttcattcgaagttggcaaatatctacatgatcgttgtctctaggttccggcacacagtatgtactgtcctcattacacctttatatttgtgctcagaactgaagccagtatgttacctgaatagtatctgcatataagatttcattggggatttgtcaaagaccatatcatttatgcatacaagatacacacagtggtgctcgggagggttatgatgggttagagctgagggagaaggatcccgaggtagtggcgaaggataggctcggggagctgatgcagatggggctgcatgagtataatcagcggcggcatgcagagaatttggaggagaaaaggagaaaggaggagaggtgagattgagataaaggaggaggacgacgatgaggaagcagcgcggttggatagtgctaagaatagggaagagggaagagagaagttttacaaggtgttgtttagtgatgaattagggatggaaatttcggttcacaattttggaaatttgaaccgaaatttcgggaatttcgtcccccatccggcaagcaattattttaagtgaaattttcagttttttttttcaaatatttgtgaatttgatcataatttcttcaaatttagtaaatatgtgctaaaatttcgtttgaaatatccgaaatttcggaatttcattgcccaccaaaattaccttactttttgaaagggaaaaccctagtgatgataaccgctgataagtttgtgtggagttttgtttgtgatccatttcatcttattgaatttattcatttgaagagtattcaacacttttgcacttcataatcaatcaaattgattactgatggatgtgatgggagttgcattgctacaaaggcattaggcatctgtctgcatgggaagatggtcctattgagttcatgacctgcaaatgttcaaggatatttgattcaataactgcttggatgccaccagatagtttggtattggcagattataaccatcaaacctttatgcggatacttctagcataatgactacatgaaattctagtgtgaaaggattgctgcaaagacttgacaaaagaaattagtgatgtaatgcatatgatcaaaataaattctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatcttccgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatttagtagtagctagtactaatcgcatcccctgacgataatggacgcatgctaaagcaaagctcgaaattcatggagtaatgaaatgtatatgaaatttaacagtctgagaaccaaatatctagcaaaggtcatgaatgtgccttttttttcccttgttgaatggcatggcaactttgggaattttgggaaatgatgatagaaagccactgaaaagaaagtgccaatcttcactaacataaaattctttattttccttttttgtagaacttgggaaacattggtaaatgaatattaatagaaagcaattgaagaaaaagtgctcatagttgcacaaagcaaatgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtagttacaaaagaaatgaaatcatacatgaagaattggaaacccatgtataagaggtgcaagaacaactgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgttttcacattggaaaagtctggaacaaaaccttcacaaagatgttgtctcgtgatatataccctttgatgaaaggggcaaaattggtcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttagggtagaaatttaaaccaaatttaaccctttttccccaaaccccccccaaatttttttttttttttgggcttgactaaacacccaaaccttttgggaaccaaacaggactaaaagtaaaaggatttttttttttcactcagttttttcacatgaatccacctgaggtttacctac

SEQ ID NO: 10297 - DNA, 9898 bp, Oryza sativa
  unsure (1)..(9898): unsure at all n locations
cgtgtgcattgttgaataacnnnnnnnnnnnnnnnnnnnnnnnnnnnnnnnnnnnnnnnnnnnnnngttacaaaagaaatgaaatcatacatgaagaattggaaacccatgtataagaggtgcaagaacaactgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgttttcacattggaaaagtctggaacaaaaccttcacaaagatgttgtctcgtgatatataccctttgatgaaaggggcaaaattgttcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttaggtagaattaacaatactccaccatttttgggctgcagctaaacacccaaaccttcttgggaaccaaacaggactaaagtaaaaggatttttttttttcactcagttttttcacatgaatccacctgaggtttactcatgacatgacatctcatcacacaagctagtactctctctgtttcaccgtttcagattataagtcgttttgactttgatcaaaatcaaactattttaaatttaattaagtttgtagaaaaaaaactgtaatatttttaacccaaaataaatatattaagaaaatatacttaattattgatctaataaaactaatttggttttataaatattactatatttgtctacaaacttagttaaatttaaagtagtttgattttgattaaagtcaaaacgacttataatctaaaacggacgtagtagcagctgctactctactcataaccaaaagcaaaccacacaccacacaccacatcaccactggtcaaaaccctgtttggaaaacgcaggaacagaacagagcaaaggattcccgcggaaaaccacgatatcaaccatttcaacctgggacgtgcaggggacacacacacacagagctgatcagatcatcagagagccagtacagtacaagaagcagagagccttgacggcgagcttcatgccggcgtcgcagtggcccggcatgccgcagatgaagtagttgttccctcgccggagcgtcacctggtcgtacccggtccgcagcaccgccgtgtccttgttcctcggcaccttgcaccgccggtaccccttgccgccgaccaccgccacgtcgtggtactccttgttgtacttgaacactgcatagccatgagtcagtcatgtaccctatttcgttgagtttaaaattgagaaataactaattggttgtcagtttctaagaacttgtaaaggttgtgaaacctaacttctagttactaattccttttccgaattctgtattggataaaaaagagatttgcttcggtccaataaaaagtatatcgaggtaccgatacctcacggtattaaatcgtttctgatcgttgcatctagctgggtaggatgggtattgttagatccaacgatcggaaatgatttggttccgtgagatatcggtacctcgagatactttttattggaccggagcaagtcacggataaaaaactactctatatatttaggagagtttttaattctgaaagaagatgcaactatcagaagcttctcgaaacatacgtacaatcacacaccaatggatctatgcatgaagctttgacattaacttgtgcacttaccgagcacgtcgccggcgtagaaggtcttgccggcgagccaccagtcgaggttgcggccccacccggcggcgtcgcccacgtagtacgtcttgccgccggcctcggcggcggggacggcctccatcagcagcgccgccgccacaaggcacaggagcaccacgccgccgccgccgcttgcactgcctcttccccggcgagccgccgccaccgccattttctcgctcgctcaaatcaaacgagattacaaaggagatcaccagtttagcttttagcacagttttgcacggtgtgtgtgtgtcttctgactcgtgtggtggcgtatatatagcccgcgaaatcgacgcagtgcagcacgtgctggcacgtcgagagcacgcatagcggcagcagagatgaagcttcttccgtggaagcaggactcttcgatcccggaatacaagaatattaatcctgggaaaccaaaatttcaaacaaaaagaaacacagaaaatatttttaaaaaataaaaagagaaaacatttccgtgaatcaaaataaattttgaattgaaattgagcccagtgtgaaagtatggaaaactgaagatccgtttgaaacacagaattttacagggaacggctgaaatgttgtaaactgctcccttcgtctcagaataaagcaacctacaatcagatgggacatatcctagtatcgtcctataataccaaaaacgtgaactttcgatgctatataaccaattttgccaataataaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgttgctcctgcctgccatttcgtcgctgctggtgacatgtgggtggcacgtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatcccgatcgtaaaatggtatcttatggtaatttttttttacacgggatgaagatgaattgaggggaaaaaaggagatgaactaaaagtattgagaaaatcagcatatgtctcttttgttgagaggaagagtagggaagtaaagcagagtttggttctagattttcgatgggctcagttcacctactatccctctactttacgttgagtctgtctaacatcccttatgtccaatactagaaatccccccccccccactatacgaaaccgtgtagaataggttctatggcagtataaataaatggttccgttgacgtgacatcctaatcagtaaagaggaaataaaaaaattatggggcccacatgtcatcctcactccttccacttctctctatcttctctctcgcatgccatgagcagggcaagcggggcggtgtcgctgtgtcgagcgaagcagcggcgcacaaagctggcaggcggcgggcggagcgctgtggcgggggtggagtgtagaggacggcagcgaacgccatagaggaggatggcgcagcggacggaaacgcaatgggtgaagtaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgatcccgtgtaattagcaaaacatgcatatttatttgcaaacagtaaaacatttgtaaattaggatcaacatgctcaaggggaatgtgtgacttgccttgcttcctcactttgatcttccgaactcttttcctcgcgaccgcggacttccgaaacgacggattctacacgctggcacgcaaaacgaggaaaaactctaataaagaccaaggaaacagtacataaaaactaaacaaacatgtagacctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcgccggcgccgacacgcgggccccacacgtcagtgagcaaaggggacaggcgcacggtggacacggtccaccgcagcctcgggcgcacgtccaccatttggacggcccagatcggcccgagctgatcgggcggccgaggggagcggcggccaggggcactggcgcgacacaaagccggcccggccgagccaaggcgcggcggcggcatgcagccaccggcggcagcagccggcgacgcggaacgacggcgggcagccggaggacagcggcccgcacaggggacggcgatgcacctcaagaggcggcagccggcaagaaagggtgacgggaaaaaaaaaggggagggaggagaggtcctcaccgaaaacggcggccgacgcggaggaagatgacgacgacgacgattgcccgatggcggctggcgaggacggagggcgaacgaggtcgcccttgacctgcggaaggagaagagggagttaggttggggagaaccgatgcggggtgactagaaatgaaggccgatggcgacgacgagaggtggggctcaccggcgaacttagaggatgagttggagcggcggaagacgacgaccaagcagcggacgaggtgagggcgagcactgcgaacgcgccagaggcagcagcacggccgggcgaggtccccctcaccggcaaggagcggctggagcgctgtggaagcggaggtagctcggctccgcggtgggagggggttccggtggtgaatgggagggatgaggcggcggccaggcttgcccttgtggcgtcgaagccggcggtggatgcggcgcagcacggcagcggcgggaccggcggtagcgcgcggctggagggcaccgacggtggtggagctcggggtcgacggtggaagcagtgctcgggctaccaaataaaggggtggtgcggcggccgaggcgtggcactacgcggtgcagcttttggtggcggtggcgcagcgcggttgcgacaggaacagcggtggcgggcggctggagttcgccggggagcggcggagagagggagcacggtggggaggtggctagaaggcgcggggtgctcggggagaggggaaaacggatgaggggaggcacgtgagtcgtttatataggtcccggagggggagaacgtggccgggagaggcggatttgaagggggaaaaggcgccggcgacgtgggcgagtggcggagcaaaccggcgccggtttttgggggaaatgggggaggagagtggaggaggtggaggggatgcggttgctctcagttcggatgcgagcgcgtgaacgggaggacgcgaaaacggcggcatcgtgggcggcaatggcggccacgagcggctgctggctgggatggagggaggttggggatgacaggcggggcccatgggtcccacacgtcggctggagagagaggagggaaactggggaggcaaagcagacttccctcaaggcctgagccggcctagagatggaggaggcgcgcggcccgggaagggggaggggattttgggccaagcccgaagggaggagagggaaattatttggttttctttttatttaattgattaaatgatcttcgtgactttaaactatttctcgagctccgaaaattcacggaaaattatggagagtacattagggcacaaagaatattacaaaatattcccggccaataatttttaaaggaaattttaatttcctctattaattcacttgaataaattgcttaactttttatttaatttctaggaaatgcattatcaaatgatttttaatcccgaacgaaaatcggggcgttacagtcggcctcctatcccccttctcctgccggcgcggccggcggcctctcccatttctccagtcgatgcggccggccgcctctcctcctattctcacaggcgcggncagcgcggccggcctcctctattccttctcccgccggcacggccggcgacctctcccctttctcccgctgatgcggccggctgcctctcccgccgacgcccccctctcctgccagctgtcccgggctggaagaaaagaaagacgattggctgacatgcggaccccacatttttcttctatcacttacatatggacccccacaatttttttattccctctttgcggattaggatgccacgttagtaaaaccatctattatactgccataggacctattctacatgatttcgtatagtttagggggggagatttctggtattggacataagggatgttttacagactcgacataaagttgagggacggtaggtgaacttattcctcgtaggaatcgtgcaagctgggaataagttcactttgtgaccctcaaaagtgattgaaatctaatccgtgaccctaaaacacaaaaccggatatcttgacccccaaactatgaaaaccggtgcaatttgactccctcagcggttttggagggcggtttcgctgacgtggcggtattgaccaggtcttctttacacgtggcgttgatgtggcgccaccccggcatttcaattaaaaagttatacgtgggactcatttgtcattcacacacaattgtggggcccactaacatgtgggcgccgcggatcctctagagaagncntgcaggcgtgcaagcatgaggtgtatccatcaacacgct

SEQ ID NO: 10298 - DNA, 8084 bp, Oryza sativa
  unsure (1)..(8084): unsure at all n locations
agaagaagaagatcgaatttgtttgcatgataaacaaaagaaggattatttgagcgaggggccgcgattcaaattttgcagccttttacaagantaaggaggctcttgccgggcccggccttattgccaccgcgggctccccaagtcctcccattgccacaagccgccgggttcacttgtccgccctcccgccaccccagcgggccacagtccattagccgccgctcgcaccgccgccgactcccctagtcttctcactgccgggccgagctcgccgtaccccgccacgtgtgcctccagccaccgccgttgtggtctcctccgtcttcgtcgcagtggagctcagcccaggtgccgccgcgcctccgcccctcgccaccatctccgcctgccgcgggaaagagagagggaacggcgaggagagagagggaactgagggaggggagagagaagggacacgtgggtcccacaatctattttctgtgtcattgacaaatgggtcccacatatattttttaatctaaatgccaccttaacgccacgtcaacgccacgtgtaaaggagacccggtcaataccgccacgttagcgaaaccgccctccaaaaccgctgagggagtcaaattgcaccggtttccatagtttggggggtcaagatatccggttttgtggtttagggtcacagattagatttcaatcacttttgaggggcaccaagtgaacttattcctgcaagctgggatgagccgtgggccgcggcctgtgtctccatatgatggaccatcaaagagttggtttccaagcgttcggccagaaggctagaaagacgtgaacagagacagccaatggcctactgccgagaggcccaaaagttgctaagattggtcgtagtttttgtcggcccatgtaggatagatatgaggtcccttactttttgacgaatccaatttttatccttcaaccaaaaaaccaaatacagcggtcaaaaccggtgtaaactaactccgaaggcggtttggacggtggacggtggtttcagctgaggtggcgctttgactctatctttatctgacgtggcacatgaagcaaaatctaacaatttaacaaataaacaaaatatgtgagcacgcatgtcagtcaaataataagattgaaaaatagtagaacccacgtatcagtggacctactttctccacctcatccccacttctatgtatcttatcctctcccaagggagtagggtgagcaaagcggcgcggcgcggtggcggaaattcgctggcgacgccgatcttcacagcttcggcgctcccaactcctttcgccgtcatcatcacgccttcttcaccgagctccactactgtcttggtcggcactcctactttcccacctgttttgacgatgacgatggcaacatgttcgaggatgcacacctcatcttcttcttcccagtctcctctgtcttcgcaccaccgtccctcgccatgtcagctgccgccgcatcatacaggcccctcttctccctgctcccacagcatgccacactcccccttttagccgccggacccctctaagcgcagcctttgccacttggtccactccacctccttcctccccttcatttatttcgactccctcgaggacaatgctctccactctgtccccatccttttcagcactctccaacttgctcgtcgtcctcgagccccgtctccgccgtcttacgcgccaccccccgacctcgacggcatcctcgccatgggcagcggctcgccgcgctgtcccctcgccatgggtggagaaaataggaccaccaacatgtgggtaccattatttttctttatcttagtttgactgaccatattttgtgtcaattatttagttttcaattttgtttttttccaaataaaactgtcacgaaaaagccacgtgtaacaaagatcaagttaaattagtcacgtatgtaccgcgtaagccaaaactagagataatagtaccgaagaacttcgtttgcactggttttataagttaagggggtggttgtatctggttttcggtttagggcgtaaatcggatttggtatcaagttaagagatatcaaatgaacttattccaacttagtttcggtcagcccatatgcacaaaactcatggaatcagccgtaccttaattgaaggaaagaaaaagaagaaagaaaagatactgattttctttttagaaaatgaattaaaatccggctacatcgatgtacacagcacagaaaagatactgatcggtaagcagacagccattcgatctcttgagatgagctcaacacgcggggggtgcacgcaacaagatcacaacaaagcttgcgaatgaaattatactactccagtacttaagtatactaagcattgtctcaaatttcaatgctgggtgagcagagcaccaaatgattccggcaaagcacactccagtagtagcaaatcaatcaatcattacaagggagaggggatccaagtttttgaccagctttgacgaatcctcactctcctctctggcacacattcccccaaccaacaaccttactagaacaggataaactaatacttataagcccagatctagcaataaaacccaccaccaattaactaatcaaccggatccatgagctaaaccagtgtcagtgaggcagtgacacaccaatgtagtagaactagtaggaggtattaatcatacggtaaaaaaacaaaaaaaaaagaagaaagaaaaaaaggcatgcatcttaggggcacttggggccgccttccttggtcttccagttgttgtagcaggggcaggcgcccttgttgccgtaggtgccgggcggcacgcacaagcacttggcgcagcacttgttgcagaacgtcaggcacgccttcttgtactgcgtgttggagcacctccccgcgcacttgggcgagcactcccacggcctcaggttcccgccggcggccacccctccgccgccgccgccgccgcgcccgcgccctcctgccatcacctcctgcacgcgagaaacaagaacgaacaagaacgtcaagattaacccaagattcaagatatatagtaatcaggttgaaggagaggttagagagattgtgaggttaccgatgggaaggcgatggaaaggaggaggaggacggcgaggaggaggaaggggatcttggtggaggacgccattggtgggtgcggtggtgtttgggtgggttagggacttagggtggtgtttatatagaggaggaggaggaggggaggacggcgagattggtgtggagccgtggaggagtaaagatttgtgcgtgcaggtgcggtgtttggtgatggggttggggttggggcatgtgacgcgccacagtggacgcgtgaaccggtcgatgggcgcaggcgcgcagctgggccgtagcactggcatagtgggcattggaaacgcaccgctctcgctctgtccattattgcgtcgtgctggtgttggtggtggcgggaacagatgaaaaacatcaaaaaaccactctgcattaatagttccagtacaggtagtagtagaggttttcaccggccgtggtggaccagtacgatactccttttgggtagctttgggcgggcaattcgagtttcgaggtaacgactaagagcaagttcaatagtatagctaactgctagctccaattcatctatagctaatctaatagttcatttatacaatagttacatactacactattaatacctggtcccacctgtcatacacacaccgtgtcttggagtccgtgctacagctagctataaatctgtagctcgctgtccttctctctcctcatttatctccttaaaatatgtttgcagctggcttatagcctgctattgtacctactctaagagccagtttaatagcatagcccattgctagctccaattcatttatagtcaattcatataatagttgtttactatactattaatatctgatcccacctaccataacacagtcttggagtccgtgctacagctggctacaaatctgtagcccgctgctcttctctctcttcctttatctttttaaaatatgtttacagctggcttatagcctgctattgtacctgctctaataccgggaatcaaacgaacccgaggagatgtaagagcaagtttaatattatagcctactactaactacaatttatctatagtcaatttaatagataaatcatacaatagttgtttattattttattaatatatgatcccatctgtcatatacacattgcgttttagagtccgtgctacagctgattacaggtctgtagcccactactcttctctcatattttatctcattaaaatatgtttatagctggctaatagtctgctattgtaactgttcttaacaaaaaaataacacgacgaggtggtgagatgctactccaagtctagattaaatcggtgagtgggtcatatactataagtaatagtactccgtagtttacgtccactagatcggcggcacatgctgatgccctttttccagtgcacctccactagctactagttctggtactccattctactcctggagagggcaccgcacatgcgcggttcgtatccacagcttgcgggcaccgcacatggatgatggatcgttccaggtttgtattcaccacagctcttgcggcacatggactcccccatctctttaccctacagattgtcgtgcactcgtgcagcagttcaattcgccatgtagtagtagtagtaaaaagtaaaaacttgtatatatactcaggtacttgtactatagtagtaaaaaggcgtccctcgtcgtcgcagagctgttcaaaatttcggttgcacggggcacgagggcagccggcaaaatctccctgttttgctgggggcttttcgcacgccaaaagtccaaacgctctctcgacagggtttcatttaccggggtaaaccgcgcggttaccgcggttaccgcgcttaccgcgggggtacggtaaggggtaaaccgcggtaaccgcgtcaaattcaaataaatttgaaaaataatttgaatttttgataaattttgtacggtttgtcgcggttaccgcggttaccgtgcggtaaccgtgcttaccgccggggcgcggtaaccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaaggaatccctgctgccggccgtgcgccgcccaagcatcgtctccacgcacgccggcctcgcgctacttcccctgcaccacccatccgcccttgtcagcgtgccgcccgtcacaggctgtgcgccgctcacacgtcgtcctcgcttgcgccgaccgcccccgccggagcaccgttgcccgcgcaccccacccgtgcgccgtcgctgctcgcatcgcccgccgtcaccgcaggagcgtcaccatcggcccgctgcctttgcccacatgtgggagttaagttttggggggggggggggggaaggggagaaggtgagcttgggataattcagtgacatttttatgtgaatgtgttaaaaattaaagggtagtggatcttttgggttggagtggagctgtggagcagaaaaaacccagctctacacctgtagtttattttttaggagtagctctactaacttcactccaaaaacagaaaatatggatcgtttggtacagctccgactctagataagttggagttgaaagttagagccgtgccaacggaccctcgtactccagctgagttcgcaatgttgcaatgcacgggcgacgatcgtcgtccgtggagtgtagattcctatcattttggtgaccttgcaagagggcgttgttgatcgatgatgcgcatttcggccattgcagatcaggtgaatcacgattagcgccctattgtttaggttcccggtcaatatggtcttactactgtatatgcgtctgattaatttcgaattatgtttatttatttcttctccagcatgtgtagtgctccctccgtcctataatatagcaatctagtataagacgagatacttcatagtatagcgaatctggacatgcttcatgtcatgtctaaattcgttgtactataaagtgacccatccggttctaggttgctatattatgggatggacgaagtagtagagtatgggtgtgttcggcactgctggttcctaatcttttccatctcgttttccgcgcgcacgcttttcaaactaataaacggtgttttttttaaaaaagtttctatatgaaagttgcttaaaaaatcatattgatccttttttaaaaaaaattagctaacactttattaatcacacgctaatggaccgctccgtttttcgcacgcactgttcccggctgggaacctccagtagcgaatacacccatatgtgtggtagagatctggatcctctgccttaggaaaaaagcagaggtgcacgataaaatgagtctactactatggtagaaaacagtgatttgcagttttcactgtagcaacagtacaaaacagtgaaaaatactgtgcgcaattactatagtgatcgatctcgtccatttcgtgtgaaccagacaactgaaaataccccaaagtcacggtactgttttacctctgactttaaccccgggaccttaatccgtgtggtagtagataatatgctatgcacatctcccgtgaggcaaagcgtaaccttgtggattgtcctccccgtgcgtaaaaaaaaactaaaatgtattcgatagaaaattaagtttaaaatcttgtatttttcttacctaatgatttgctttgagttccgtgctctgatgacccaagctcttattctacagttgaccccttctcctttagttctggtgaccccctacaaacagtaatggagctagtgtttagggtcctcgattatggctaggggtaaggccgtaagggtgggggagggggaagagagggaagatcgctggatttagaaggatggtcatgggaggcggcggctcggtgttgggtcgtggacatgagcaggcggtgaggcgctcatggcgacgtcgaagccatgagaatagaggaggatgatgagccatcgttaatgacgggagcaaagcaaacttgtggtgaggggcggatcaactgtgttaggtgtggtgtcacctgacaccaatagattcttgtttaatctaagagcaggtttaatagtatagccccactattggctccaattcatttatagacaatctaatagccaattcatacaatagttgctaactatacttgttggcggatggcatgaggcccttcgaccaaatttgccgaaacccgtggcgaaggctatgaaccaaagatgaggcgaggcgaagggtcgcgtgagtacctgacgaagaaggatgacttcgccatagccagttcgccctggcatccagcgaagaaggacggcttcgccatgtccagttcgcccccgcaagggccgaagaagccttttgggcactgcagctgaggttctacgccn

SEQ ID NO: 10299 - DNA, 4916 bp, Oryza sativa
  unsure (1)..(4916): unsure at all n locations
ccattttatctcctttttttaagaaaaagaactctttacaatgcaaaaggtgaacaacaatagttcccacatgtgatcgggtattggcctggtgacctggttttctcttaacccatccaatatttgtgcgctactaaatcgaagcatccaaagactcacatatttaccattcttttactttcaaaagaaggtgagacaattaaataatgagatagattaatataaaaaatgttatacttttatgaatttccaccaatatgaaaaaaaacctaatatatagatgaagcatgagaacacattagcataancccataaaaatataaaacagagcagattaattgatttagtaaagttacattaaagttgcgattttgtatagtaggaagcctacgtggtagacaaaacaaattttcaggcaactaatgcatagaaaaatattaagttttaatttacatttctcttcttgcaaaatatttaaacacgtttagtccataaggaaattaaaatcattgacaagtaacaccacctagcaactcttatttagagaactactactaactaccacattccaaaaccagaagagacatgatgagtctcttctggcatgggtcactgattcgtggacccgctgattatggggctatatagcaatcactcaaaaataatagaggaggtggtgtttctgaactctgaagagacgtgtagctggtaaataaaccaaaggccgagtttagttctaaaatttttctttaaacttttaacttttccatcacattaaaactttcctacacacagactttcaacttttccgtcgcatcattccaatttcaaccgaacttttaattttggagtgacctaaacaaacccaaagtttgagggaaaaagagatttggtactcactatcatgcaaccagcaaagccggggggtcgaagccaaaaaccattgatgaacaagaagacatggataagcagattaggaggagatgtcggccaatggcgccgaaacttagaacagctttttccacgctgcactgctgcagcacagtactgaaacgacagcagccgctggataatctatctcttgtggacttgtggtctctggcttttgataatttgactggaccaaagaaaatatgggaattcatgggtccatgattgattaagagatataactatgactacgagtgactcgtgattgcagcatcaatcatatgtctgtcaagatatgttctggtcaatagataattagttatggtttatttacttttttggatgagagaacaaagatgattgagcttaactagtaaataaaccataactagtaagctaaaaattagttatgtttttctaacaattattgtgcaaaaaaatattagcaaaaaatgacaatataagcttaaacatgaggtttctttaaacattttgtcataaaacctaggattattcagaacaaatagtaatatctggaaatgggtgcctaaaacctggcgttttttaatatcaaaaaaaaacctggcgttttgtgaaatttattcaattgttttcatgaggaacttggtaactctgttcaaactcaaaacgagtctctgctttgcttccgaaggctagctatgtcatgcaactttgagcacggtttggataggagtaacaagtaacaaactaaggccaaactttacaatatatttcagggtttagaggggtactgtgttttctgaaaacctctctagatttgctactttatgctcttggagaaatcctttagaaatgcaataagttttgtaatggcagataggaggtaccctttagtacttagtgaaagaaaccgtaagtcccagaatgatgtaaagctctgtcagaacctaaaattatattcaaatttccaaagctttcgtagtctcaacaaattgttataaaggtctttcaacaaaaagaaaacgtacactaatagcagcacagcctaaggttgagtgctagaatgtccattgcaaattgcaaactcttgccatttggtttcttctgatatgaatgtgttttgtgcaatgatttcgacttcgatccaattgtccaaaagtgttaactgatcgtgcaacaattatgatcaatttgattttttttctgttatttttgcactgattgtgatgtttcttgactccggtggtacagcttttttgaccgagcggccatcgtcaccgacggcgacctgacgacggacacctccaacggcaagccgtcgttgtctcccatccccaagccgtggcggctgagcacggtgcaccgcgtcgaggagctcaagtcgctgctccgcatgggcccgatctgggcagcgggcatcctggtgatcacggcgtactcgcagcagcacaccttcgccctgcagcaggcgagcaccatggaccgccgcctcgcgccggggctgtcgtcgttccagatcccagcaggctccatgaccgtgttcaccctgctcgccatgctcaccacgctccttgcctacgaccgtgtgctcgtcccgctagcgcgccgcgtcacgggactggaccgtggaatctcctacctccaccggatgggcgttgggttcgccatctccgtggcggctaccctcgtggccgggttcgtggagcgccaccggagggagtccgctgccgccgcgggcaccaccgacgcggggacgtcgccgctgtcggcgtactggctggtgccgcagtacgcgctccacggcatggcggaggcattcaactccgtgggtcacctcgagttcatgtacgaccagtcgccagagagcatgcggagcatggcgacggcgctgttctggctgtccatctcgctggggagctacgtcagcacgatgctcatctccgccgtgcatcgatggagcgccggcgccgacgggtccaactggctccccgacaacatcaaccgcggcaggctcgactacttctactggatcgtcgcgctgctccaggtgctcaacctggcatactacgccatttgcgctaggtgctacttgttcaagcccttgcagctccgtgaggtggacgatgatgccaagccccaaattgagctgcaagaaaaggcttcacctttgagtcattgagccagtgaaagtgcaagaaaaaggcttcacctttcagtcattgggccagtgaagagcattgatgtatctgagatgcaggtctagctagaatcaagtaggtaggttgatcaactttgaggtatatatcactatatgtatggatttgtatgtacatcaggaacaaaccagagaggaatgcatcactcgaattgagataatacaggaacctggaaggctagaacatctctagtttgatgcagattattcaggcaagctggattatgcagatcattccagtggccaatgagatgtaactggtgtgccaattccagagaagatttgatattggcatagcccacaattcacaattcacaactcaacatagagatggactattattgatgaagaaacactagcatacatggtactactagtattagcatcacaacctaacatggataaacaaatcaggttttcttgatctttattcgtgattgattgtacctgatgacgtggcggcggcggcgaagatcagacggtgaagttgatctcgaagccgagggaggggtggatggggtcggcgggggaggggacgacngcggtgacggcggaggcgggggagccgacggggaggtggcgggagaccatctcgtcgaccttggcggggtcgccggagaggagggcctccacggtgccgtcgcggcggttgcggacccacccggcgaggccgagggactccgccgtctccgccgtccagtcgcggaaccccaccccctgcacccgccctttcaccaccacccgcaccgccttgcgcgccggtgtctcctccggcggcggcgatggcgtgggcaagaagnacgtggcgtcgcccgccggcgtggccatggcgagcccgaggcggcggcagaggagacgtgtcctgcaaagaggaatctggagtgtggtggacgctgctgcttgctgggcctctcgagctacttgcaaaccggccggcccaataagttagttttatcacttttaataaggggcaattaataaagtaccgaaaaatacaatattttctaatacaaatttagtacctttagtgctaacatcgaggtactaaaatttgtagggtaattccagcgtaaattttgatacctctggtacttaatacttcgaggtatcaaaatttgtaaggtaaaatttagttacctcgagacattctagaaatcgtaaaatttcttctctaaaaatggattttggcggaggcaagagtaaccacgagaagaaacatactagagcgtcaacgggatcaaaaatccctttttctttaagatcggtctcggtctcgtgtgtttgcgtgatttttaacaccctgctcgataaccggtttcgaccaatctaatgagcaatattttaagagcacaccaaaccaaacgcaacaacacaacaacaatgagcaatagagaagtcagcgatgttaacctttgggtgagatcaccatcatctgctaataaactttcattcttaacagaacagaagcacacagtttaaaagttgtgtcatgctaacagtttctgaagacacaaacagcgcatatagtaaccgcaaagtggcacaccgccattatcaacatctgaacaaatttctaaacatcgtatgatcaaatcgctcatcgatcgagaaacaaacactcccagtgaaactcgtaaggattagaggtgaagattattttatcgcatcatcaaacaagaagaagcagtacgtcgtcttcctcctcaggcggtgggcttgcggggtgaagccctcggcggggtcgacggggtcggcgggggaggggaggaccnnnnccnncncnnncccn

SEQ ID NO: 10300 - DNA, 7789 bp, Oryza sativa
  unsure (1)..(7789): unsure at all n locations
aaaaaaggacgttgtcttcttctccaaccggtgagcttgtgggtaaagcccccgccgggtttaacggggtcgccgaggcagggaagttcggccggtaacgtcggcggcgcggggggccnacggggaggtggcggaacaccatctcgtcgaccctggcggggtcgccggaaagaagggcctccacggttccgtcgcggcggttgcggacccagccggcgaggcccagcgcgcgcgccgtctccaccgtccagtcgcggaaaaagaccccctgcacccggcccttcaccacaacccgcaccgccttggggctgggcgggcttggctacggggtggcggcgtagaccatggcgcggcgggcggcggcaacggagcgcggggtgagggcgaggcgtggcacggtggcgaaagggaacattctggaagacacggggaaggaaggggagagagacagagagagagagagagagagagagagagggtttctggagcttcgaagcgtcggcccatagatgggaaactgcggtgccatctagcacgttaactgcaccattggatttggatcggacggttcatgcatgcttcacactacacgcaatgtgtgtgcccgtgtagatttctgtgtgttttcgtcaatttaagagcaagttaaatagtatagcccactactaactccaatttatctataataaccgatctaatagccaattcgtataatagttgcttactatactattaacacatggtcccacctaccatacacatattgtattctggagtccgtgctgcagctggctacagatctgtagcccgctactcctctctcatcttttatctcattaaaatatgcttatagctggctaatagcccgctattgtacctgctctaatagacccctcactgaactcgtaataaaacaatttgaaaaacctatgtaaatatatgctccctcagctttctcattttcattgcaatctatcaaccagacatccgctagtaaaaagaaaataaaaataaaataaattttacaaaactattgatatttaaaacaaactgtcgtaaaactacaaacttataaggatgtgtattacaaactatagatttagtgtcaattttttttacaaaacgatagatctaaggaaactgtcgtaaaactacaaacttataagaatgtgtattacaaactatagatttagtgtcaattatttttacaaaacgatagatctaaggaattgtatcacaaaactatatattgaacatcaattttattaataaattacaacttttgtaactttaaataaataatagtgctacagatctaaagctaaaatatgtgaaatgatatgtattgccatagcatttggctttgagatacaagagttcatgttggacctcgtaccaagttgtcaatacataattggcgagatgaaagggatttactggcatgtgagctatagcaaagtaggatccacatgtcagtgactcaactgcatgtgcagttaagtcagagggtttgcttccttggcaatgaagcgtagaagcctacaactaaagaatttggcaacgaagaccgaacccttcaagtgttcactctgcaaccaaggactatttggtactaatggcttattcattttattgctaaaatcaacattaccaaaattcagccaaattttagcacgtttttgtgtcactaaaatttggcagcgttggatgtgtctagtttaatacctttgttatgctggtgttgtttttatgagaggaaattcctagagctaccaaattctggtatgatagcattagtaagactatcttaaattcattatcttaccaaaaattgataggattaaaggcaacaataaaataaacaagcctcaaagtctataaggcccatgccaatgagattggattaaagatagaaataaaatgaacaagacttggagtccataagcctcaaaccccttggcatgaacgaggtttgtgttgaccctcggccacatctacaaacatggtaccgagctgtcatatataagtgcctagtgtgcttgaggaggatatatttgtaaaatacttcatccattttaaaatataagtattttaggatttaaatgttgtaccacaatataagcatttatgtattggttcctatcattaattttttatgggttcaaagccaatcacatacttaattgtaatctatctattatatactaaaagtccataaaacttcctacaaacactctcaagccgccatgtggccttctacaaatgctcttatgtcgtcatgtggcattctaaaatctcaccgtcgattttttttttaaaatcggtggacccattaattttaaccattagatctccatctaaaaaataaatctggtgtccctactttttttttaaaaaaattaccatgtttactctaactaatatatagaaaaagtctggatcgggcaggaaacgttagtattattttttttccttttttttccggcggcatacatacatactccacgttagtattgttttttttcctttcttttgcaaaagtacttttcctttacacgttctgaaaacagtactactactacgcacatcgtacgtacactaggggagtttaggaggtagtgttaatagatatataaaatcacatcttaccgatttaagtgaaaatccacagttagattttttttctttttcttataatttttaataattcttttaattgagagatatgacatgtggtgacctacaagcttttatatgagtgtcacgtgacagcttaatagcgtttctaaaaagtttaaaggacttatatactaaaagttaattaaactttcaataaatactctcaagccgtcatatggccttctacaaacgctcataaatcaccacgtggtattctataatcacaccgtcgattttcttttaaaatggtggacccgttaattttaacaattagatctccaacgcaaagaaaataaatttggtatccccaccaccaacaccttacgtacataaggtaaaaaaaggtagtacgtactccttccatcctccgaatctcccatcctctcctattttcgagctaacttatcctattttctcattaacactcaatatatcaaaaaataattcggacatctaaatgatcacgactctcaagttataattttatactcagtttttatcagttgttgtgttatttataattaaatataaaattcaaaatccatattactcatattttgttattaaaaaatagatcgtgctgccgttctaactacaaatgttagggcctaatggtacgcccataaacacttctaagttgatctcgccacgtaacactctaataaattagaaaaatctataagtatgacaaatgaaaataaaacatctaaccatcgctttccacttaaatcgatggatccactattttatatggttagatctatctttaaaaagaaaatcccaaaaccccctcctgttcctcccattcctccgattcctctctccctaccattccttctctgttcttttttttatctccatagtaactaaatccaacattatctttgtgataaaaacaaactcccacaaatggactccgcataacaagtctagccagtttcccctgtgtcaagtgcttttcttctctttctcctcaagctagcacttataaaaacaacgtaaattagactttaaaatactcataaaattttaaatcgtatattcatttatgatatttctacactattgtaattttcaattaaatcaataatttaatatttgtattgacttacattgtggaccacatctatccacctttaagcctccaataaataaaatagaatactaaaatttctcattaaaaagttaaaatataccacttatgtttttaataaacggtcaacccattatttataccatgctagacatctaatcacctttttccaactccttctatttcagattataagtcattttaaattttgtcaatgtgaaattacttgaattagtttataaaaaatatagtaatattttcaacacaaaacaatcatattataaaaacatattcaattttgaattcaataaaaataatttggtgttgtaaatattgatatatttttcctcaacagtggaagtagttaatttatcttaacatgcatataggggggctatttacttgatcataagtagatacacttttataaataaatgatctttttagggataaataaacgttcctaagatgatgataatatctaaattatacatatgatatctgatgtcactaatagattagagaaaaaacttttaattatatcattatttcatgtcataacgtgtaccccgtctaggatctatttatcatacacaacacattgaaaacatttaagggatacctttatctcatgccaagttgtatagccttaactcacttatattaccattctagatggcagagatcaaaacatttaagagatgcttgatggaatggaaatctataaaaaaataacatgataaaaataattgaagactgaacttttttttttctaaatttaacattttcttaaaaaaattgatacccatcctaaatagcaatgttttaatatttttggagtactgaaataatgaaaataactaaaattttaaataaaatataatagaaaatttgaatttttctgtattatgttggaaacaaaatctaacataatttcagttcaaagtatacaaccctaaactacaacttgggagcgataaaagtcttattttctaatatattttctcattgagaaaaacatttaccgctaaactgtagtttcatactgcaatactatatacacacaaataaatgctaaactgtagtttcatactgcaatactatatacacacaaataaatcaatatttcaacatattcagctcataattatatgtagtcatattaggcatatttttaatagaaaatatcttcaattaatatatcctaaaattcataaagacatatatattatacaaaagaaaattgttacttagagtttagaaagtacaaaattaagttatgctaaatattaaaaaaaagaaacgcgttatgtacaaatgatatatagtttcatatatattttttcttataaaaccaaaactgcattgttttgagtaattttagtttacaatttatacgtcggcgatggttactagcattcagagaaacaccacacaaattattaaaaaattaaagatatttacaatagattaatcataaatattcctaatcaaatttctaacacaattaaatatgatgtccgcgcatatgcgcgggctaccttcctagttgatctaaacaactgaaaatttaaaaattaacaaaaacaaagtgattaaaaagaaatattttaacctatccttaatatttgctaaacaacataaaaattctttatttttaaacagaggaaataatttttttaaggacaaatatgaaaaattcctacggttggtccattgcatttcaacccttgtatgcgggaacaccgtcgcttcaatatgggccacattctgtgaccggtctcgctgtgaataagcatttctgtaaattgactttctgcggtgtcatgttccttgtgttttgcatattattttggttgtttcactacctcccgaattgttatagaatcaatattttctggcgttatttgttgtaggagataattgcacttatgaagatctgaagggaggagtcatggtaaacgggataattgcttcttcataaatcagcaggatcgttaatggccatgaggggatgcatttcagagatgtttatcatcaactcatttgcaattcttttctaatgagtcgatcaaccattctccgagatatatattctcattgtcatacgccagattatatgaacacttccacgcaacaagaaagcgaagaaattgttttgaatttcgaagaaacaactgatagtaggtttgatacagtttttgcactacgctgttactgcacatgggagcagaacatattctcgtagagatatacaaacatcacacagaggaagcagcagcaagcactctagagagtcaccccccaaaacttccccggacaaatgcagctgcttaattactccgttccagcgatcttcttcttcaaggtctcgatgtcggtcgccaactctttcctgctctcctgttgtttatatcacacgaaaaaaaaaacattcacagaaattcagattccaattcaaattgaagtaaactgatagagaagttcaggacgattattcgacttgaaaatccaaacttttcagtgcatgaattggacaagattcggttaattcccatgttaattaataccgatggatgcatctgcatggacgattgatttcttagttaccttgaagaggaggtagcggtagacgaaccagccggtgtagccgaggccgacgagctccaggatcttggggagctgcaagagaagagcacgtcggccaactcgtcatcagtcacagttcagacaaagctgcaagtgattgattaattcgatggtacgtaccagcggcacggagttgatggcgccgacgacgacggtggtgagccagaaggcgacgacagggttgggcccccgcccccgtagattttttttttttaaaaagaggaggaacgtcggcttgtcctcgatcgcctcccactgcatccaaccatatgtcaaattaagacaagatgttccatgggaccatggatggatgcaaacatatgcacgaactcacctttgccttgaggtcggcgacgagctcgtcgccgctggccgaggtgaaggtgtcgtcggaggcggcccttacgcggagcagggacagtcgcggcgcgtcctgaaggcgcaccggttggagcacgccgccgcggcgcggcaaaagctcggcggagcgtggaacggcggggacgcgcgcgccggtggcgccaaggagcgccacggtgtacgccgtggctgcggccatgtcggtgccctcctcctcctcctcctctttatcaccaagtaagctagaggcagcagctgagctctcttcgtggcctctctttttttttcagctcgatctcacactgtcacgctatctactagcgaaacgaaattaacggtgcacccttgcaccacagctcgggacctcggcctcgcatggtgggtagccacgtggcaggatggtgtgctgcctctggctgacacgtggcaggatgctggtctgtgattggttggctccctatcttggaaatccctggatggcctctcattcccggcatttgatttgtagatgatggagaatgcaaggtccacactttggtacttcttgctgcttttgcttctctgaattctggcagtacagctttggtttctctgaattctggcagtacagctatctgggtgtactttttcggttaggaggcatactgtacactatacagtaccatgtttccattttaccagaaacagttatacttccaggtcataatcataagccatcactgttcaataggggtaaaatgttttgttatctcctggtaaattttcaatcaacaatgtcaaataagccagtaatatttctggaatgattccatccagtacgcaatgtacaagccatcataccccagcataacagttaacaatagttagtcaacaagttcttgctttgctctagtgatgcaagaacaaatacatccattaaatgctagtaagtttcttttcttattttgttcagcactagctaggatccattaaaagctaacttaatattgcctgcgagtattgaaggtt

SEQ ID NO: 10301 - DNA, 734 bp, Oryza sativa
  unsure (1)..(734): unsure at all n locations
cgtggccntttgtttgtcantctagctcggtacccctttatttggtagcccgagcactgcttccaccgtcgaccccgagctccaccaccgtcggtgccctccagccgcgcgctaccgccggtcccgccgctgccgtgctgcgccgcatccaccgccggcttcgacgccacaagggcaagcctggccgccgcctcatccctcccattcaccaccggaaccccctcccaccgcggagccgagctacctccgcttccacagcgctccagccgctccttgccggtgagggggacctcgcccggccgtgctgctgcctctggcgcgttcgcagtgctcgccctcacctcgtccgctgcttggtcgtcgtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtt

SEQ ID NO: 10302 - DNA, 742 bp, Oryza sativa
  unsure (1)..(742): unsure at all n locations
cgaggttcntttgtttgtcantctagctcggtacccttgcagatgatcatttaagttactgtgatgatcaaatgagaataccctggttggaagacccctagttctcctcaaaaaacccacaggcagagtatctaaaactctggagcattcaagccctgcagtgtaccttaaagaaagaatatcagccacatttttattttattttattctgcgtcatactgtacttttgagcaattgcatcatactgtattagaaagtatttagaagcataccacaggtaatcaacagtgccaagaaacttcttgtgataggaagttgcaaggggttcgccatgatgacccctattgtttgagtttccctaatataattggcaactagtttcagcaaaatatgaaatggtcaaacaatcagttttgatcttaactagaaactagtacctttaacatagcatacgaactacaaatattcaatggatgtttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtggcaacctgcaataatga

SEQ ID NO: 10303 - DNA, 745 bp, Oryza sativa
  unsure (1)..(745): unsure at all n locations
catggattgttgatcgacattcgagctcggtaccctgcactcaaacacaagagacaggaatactccgttgaggggttgatagcgtctcttgatgttgaggagaaagctcgggaaaaagatgcggcgtctaagggcgatggtgggcagtccattgccaatgttgtgcaccaggcccagaacaagagcaaggggaaatacaaagctcagcagaccaccaacttcaagaagaagaagaacaacagcaatcctaatcaggatgagaggacttgctttgtgtgtggtcaacctggccatctggccaggaagtgtccacaacgcaaggggatgaaggcacctggagggcagacctctaagtttgctaatgtgaccattggcaacactggagatggaagcgggtatggtaatttacctactgttttttcagttaaccagtctactaattggtgggttgatacaggggccaatgtacatgtttgtgctgacatctcattattgtcttcttatcaggtcgcacggggttctaccgtcctaatggggaatgggtcacatgcttctgttcatgatgttggcacggtagatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10304 - DNA, 736 bp, Oryza sativa
  unsure (1)..(736): unsure at all n locations
gatgtggttgattgcanaattgatanccgactcggtacccatcagcatcagttccgtgacctaggcgcccaccaaattcctcaccccacgtaaacacctctccttgcctggtagtaagagctacatgtctcgtaccacatgctatctgattaacatctaacacgacatcagattctaaaggtttggggatcaaaacatctacttttgagcatgaagagcttgtgtgcccatctgatggggttacatcagtccatacttcaccccagacataaacatcaccaagggattctatgtcatctgttccagaaccttgactgtaagaactaagggcactagaaatactaacccggctactgtctgcagcacttgttcttatcatatttagacgatcaaatcccacatctgattttctgaaactaaatgaattggttccacagtaaccagctgagttaaaactgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10305 - DNA, 821 bp, Oryza sativa
  unsure (1)..(821): unsure at all n locations
ngtttacggcatttaattaagttaaaacggctggctgcaagcggatcgacgaggcgaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtgtagtcttgctccgtgatagctcgcaggcacatcagactactcactatgaaaaagaaaataatgagacgtgtgggttacattcattgattctgctcacgatacttataggtgtcgaggatgatacatgtgaggtatctgtatattgacgataggaacccaaatgatacatggtatgtatcgtgatgatacctaagatgtatcagtgagtaatgatacttgtaaataccagggatgatacctttcagatagcaatgtatcgaagatttgtttttatgtacccaaatggtacctgacaggtatcgtgatgatacctatgaggtatcaatgattgatgatgattgtaggtatcagtgattaaaaatacttggaagtaaaatttcaaagttacactaaacgagggtaccgagcgagacattcaattcaaggcgt

SEQ ID NO: 10306 - DNA, 3462 bp, Oryza sativa
  unsure (1)..(3462): unsure at all n locations
ccttttggggaactttgnnancnnctnnnnnnnannnagaggatnccccagtccaataaactaacccaaataattaactggattgagtttcctcagatttgccttctctctaacttatgttactgatatgggaggctttgacgcatcatgtacagcaccaattaatcgcagcacaaatgacttccttttttttttcattttgaaacagtccaagattgatcgatccagtgcgcaacattatatagcataatattgcgtgaattcttgatcagcaaactgccggcgatgtcttcttcactccagtgccccgacgacccggcgccatccatgaacgtggaggccgtcctccacatgaaagaaggtgtcggcgagaccagttacgccaagaactctacgcttcaggtcagcactccacatcggctcgtcaccatccatatctatatagttatctacgcatacggcatacgcccttggttaatccttggaaaaactaattggcgctatgcatgcatgcacgcccgcgcgcacccgtgttgttcctgcaaaagaagagcatggacaccgtgaagagcctcgtgacggagtccgcgagggacgtgtacgcgtcgctcaagccggaaaggttcaccctggccgacctcggctgctcgtcggggacgaacgctctcggcatggtgaaggagatcgtcaggagcgtcaccgaggtgtgccccgggtcgtcgccaccgccggagttctcggtgctcctcaacgacctccccaccaacgacttcaacaccatcttctcccgccttcccgagttcaccggcaagctcaaggccgacgccgacgccgacgccggcgacgacccgatggtgttcctgtccggcgtccccgggtccttctacgggaggctgttccccagcaagaatgtgcacttcgtctgctccttctccagcctgcactggctctctcaggtacgatgcgcgcgtcgtacgaacgtgcaatgttcgatcggttgatttttgtgatgatatccttgtcagttgtctagatcatgtcgttttaaaatgcacatttctcaggttcctcccggtcttttggatgagacgaacgggcccgtgaacaaggggaagatgttcatatcgagcacgagccctccagccgtggcagcggcgtactcgaggcagttccggagagacttcagcctgttcctcaggtcacgcgccgccgaggtcgtcgccggcggccggatggtggtctccatgctcggcagggagggcgagcgccacgcggacaggaacacgaccctgctgtgggatctcctctccgagtcgttcgccgcgctggtgtcacaggtgagccaagttttcacatagcgtcttcggccgtgcatgacacgcgcaatatgcattgacgccgcgtgtggccgtacgccgcgcagggggtggtggagcagggcaaggtggacgcgtacgacgcgccgttctacgcgccgtcgataggggagatcgaggaggaggtgcggcggcaggggtcgttcaggatggaggtcgcgcgggcgtacgaggcgagcctgagcggcagcggcgacgcgaggaaggacggaaggacggtgtcgatggcggtgagggccatccaggagtccatgctggggcaccacttcgggacggagatcgtcgacgcgctcttcgccaagtacaccgagctcgtcacggcgaccatggagagggaggaggtcaggagcgtccagattggagtggtcctcacgaggctgtgacctgtcagcttggagactcggggagccctatgtgtatgtgttgacttgtgccgttcagtgttacaaaagaaagttctcaaaacaaaccagttttgtttcttatgggacaaagggatgtatgaacctaagcaacgtatgatggtcatcgttcctaactcacctcctttatttttcacacatatatttcctaaactgttaaatagtgtttttttaacaaaatttttctataagaaaattgattaaaaaagcatattaatctattttttaaaaaaaaatagctaacacttatgaatcgtttcgttttagttccaacgtcatccaccgaacacagcctaatgttcgtgataacatcacctaattcggtcattctgaaagagtttaatggccttatcgaatgaagagccccccgtcatcaaaatttctgactttttaaagtcagtttggtcacttaattcttttggtatatatttaaaaaaattacaggagtgagtatgtacggcggaaaaaacatactcatgcattttcatataaccaaacatccagactacacatcttagacaaaaaaaaaaaaaaacctttggtcaaaataagtacaatttgactctatgcttgtcagggagtcattcctttttcacaggctcactctatgcctcaccagagatagtcaatacttttttcaggaatacgccacaggcgcattttttctattaagagaaataaaagttatttacaattaaagatcgaaaaacagcagggggccgatactggaagacagaaacaaaatggcctgggatttgtgaaagaaatgatgggattgccgagtttgccgcccgccagagcgccgcttcctccgtcattccttcgcaacatcgacccaaatagtcaataccccatactctactaatttctcacctagaaaagagttacttaactccgacttgcttttaatatgggctgtaactaaactaagttttggcactaaataaaaattatcctatactttcgacataagcaggtatttttctccgagcaataaccaattagagagtcgaaatttcctgtcaagactcgctgtacagtgtctcaccaatttgaagcttcttccgcaatttgtagaaacctcattaaagatcatgagtgatgttcttcctcgttagaagatcctgttttcgttgatgttgtttgaggaacagtcggatggctgtacttcttgaagacccgctcttggttttcccgccaccattcttcagcctgattctctgcaaatttcttcttgctgtccgacaaatttaaggagacggaaaattttagatggaaaggatgtagcagtttaacatctagattgcagcatggatagggagatgtacctgaaccggacccgcttgaatactttgctaccatccttcagctggataagtgtgacatatacaccaggttcaaactgctcaattaattgaacttctccatgagtatcatgcttcggtacaaaatcgttaggaacctttgcgtggtgttccatgccccgatgggaagggggttcacttgtaagtgaaatggcagagccacttgcagaactggcatcttgtgacatgaacaagtagcgtgtacttcctgacctatgattggaaaaatcatgtaatgcatttnnnnnnnnnnnnnnnnnnnnnnnnnnnnnnnnnnnnnnnnnnnnnnnnnatccaccg

SEQ ID NO: 10307 - DNA, 10990 bp, Oryza sativa
  unsure (1)..(10990): unsure at all n locations
acaaactcgaccacagcactgcatctagtatattcttccgtggccatagagacaactgttttagttttcttatctgatatctgaagctgctcgtgttgggcctcgcacttttgttttaagctatcaacctattgaaaacacaatggtttatcagaatagctagctgtaacaaggtacagaataaacagcagtttcattcttgcctgagattgcagcttcaacatttcttgattcagcaattcgttagacttctgcaagttatctatatcagttttagggaattgcgggattgcaggtgcaggtgattttgttttctttgtgtatggagatggtgttgagagtgcaggtactgcaggtgacatagttacagctggtgacatcgccgtgggttgaagagcagagaagctaagatctttgaactgtagcaaggaagaaatttgggatgctctcatatcatttcttgcagcttttacctctgtatacttgactgattccgctggtgctgttgtcctggaaggccttatttctggcctctcaagcttctctctcccatcaatagagcgacgagtaacagcatttcttctgttagaattgttgctgccggtctctgcggctttcaattttagaaagcatgaatcacacacacgatgtggcttgcctggagttggtgctagagcagccttcaacacttttcttgaactgcaagcatgacaatgaaccagcccacagttgtagcaatcatgtctctttctagtgaaaccaaatgcttgcctgcaacccgtgcagacagattgatctgcacctgatacccacttatgtatgcaaatacatgttgtgaaatttgaaccacatgatatactcttgacatgccgatctttaagtgcttcaacaagacatggcttcttcctgtccttgagatcgccatgaccaagtcttccattggcacccattccccatgtatatacttcacttcttgaagtcaaaactgtaacatgagaagctccacatgaaatctcttcaaccaactcactagccaatctatcttgaactaagcaaggctgcttgccatcagattttggatttccaagctggccattgctggaactacccatggtaaacacacgaccagatgtagctagggcaacagtcatattatgtccacaagccagctgatgaaaattgtactctaaaagcgcttgaacacatttaggaactaacctaggctctttgtccccatggccaaggcggttcttatctccatcaccccaggtatataacttcttagacatcacatttgcacctgtctgattagtaacctccacaattgctgcagaatgccaaattccacatgcaactttgatcgttttgaatccactcaaggcttctacctcttttgggtatgctaaagtttcacggtcaccatgtccaagaacaccaaatgttccatcaccaaatgtgtaaagttttccacttgatgtggtcaaagcagaatgccatgagccacatgcaacagatagaacttgaagaccttctagggccctgagactttcttggaagccagtagctaacttcagtgccacacccaagcagtccgacattgtaagaaccatccccccaattaaatagatcaccgaaagtagtcacagcacaagtatggaattctccacatgaaataagatcaactacggttagtgataaagactcgacaagcttggggcgactaatatcagcatcagttccgtgacctaggcgcccaccaaattcctcaccccacgtaaacacctccccttgcctggtagtaagagctacatgtctcgtaccacatgctatctgattaacatctaacacgacatcagattctaaaggtttggggatcaaaacatctacttttgagcatgaagagcttgtgtgcccatctgatggggttacatcagtccatacttcaccccagacataaacatcaccaagggattctatgtcatctgttccagaaccttgactgtaagaactaagggcactagaaatactaacccggctactgtctgcagcacttgttcttatcatatttagacgatcaaatcccacatctgattttctgaaactaaatgaattggttccacagtaaccagctgagttaaaactgcgtgaaatatttgaagcaatatctagtgttgaatcataggaatggcgatcttgataataagttacttcctggaaaaaagaaggaaggcgcactatattagaatatttgtaaagacttgctgtctcagaatatactatacatcctaattatataggggcttataattctcgaagaggagcagagttagttgatagaaagaggagaagagttggtaaccaaaatctagatagataaaagattcaaagtggatacctagctcccacatgttacagagcggagtagagtacataactaaaaactagattgatcaaagtaacattttaatgatgtatgcttttagtatgtacatatatttttttcagtaacaatcatagaattttggtggatgagttaattgttcagagcaaaacaaaaggtagggagctgaggcagtcttagcctggactcatcatcctggaaaagtttatgttccatcttgtctagagggtctgcactcctaaagtttaggtgcttttgtttcatgtacattattgtaagctagtaacccctacttttacttttgctgtataaacctataactttcattataaattgaactaaatttcttttctcgaaaaaacttacggtattatggtatttgtgcgttatatgcatatctacgatgcttgagtcattttttccttctaaaatggtaactgtatagcaaaactgaaccatgaatatagttgcgtacagaggcacagaaattcctgtaggaaggtcgagcataactcacttcagaaaatgatactctatccttgtgttcgttaatcaaagattttttgcggaatgaacttattaacccctcaagtgctgaaaaccagacttcaacttcagcttgatccttacaaacctgcagaatagaaagaagttcatactaggaatgtcctctgcagtgcatgctatcatagactcaacctatgctatgaatcgaaaaaaaataagtatttatcataagctaatgattgggacttagattgagtgaattacataattttatctttaccataccagatcaagtgagcgttgcccgtttttaaatatgagggaaaatgataaataatccttctcagggtgtaaaaacctcccaaacacagcctggtgaaaagttgattagtaggatagcaaggtaccagcttgatggaagtttatgctcttttgcaactgttgttgtttaaggatatggaggacttacagttctctgtccaggaatgatcttagtgacagaagacagtctgaggaacttttcctttttgtgagaaaaccaaattaaagatgtttcatcctgcaatacgtaaaggtcaaagggacataatcaaatttggtatcaccgacatcaagcaatcggcacatacttggggcttatcgcttacgctagaaagtctgaacgcacggatcttgggttttcctctccggctatacttgatgagtttagtacctttctttaaagtaataagggccttgagaatattaaacatggagcattagtgttagccaatagtttgacacatgcacgcacaaatacaaaaggagatcaataaagaaggcatcacaattgtgtctagaattgtacagtttcatctggtgtcatctaaacagcaacatgtcaacatcctattgtcagctttacacagtcacctgcataaaaataaacaaaagagaccaagcttgagtagcagtatctgtgtatcacaggaaccgatcaacccacccgccctccaaatcacatttgcattcagcaatcagagaaataacaagtaggctgcacagatggaaatgtctgtagtttgcacttagtttttccccctaaattcgaagacatgcaggtgctcggttgaatcagaattattactttttgaacttttgtacattctctcttttactctcttttctctctttttttcctccaccccccttcctcatgtaccttacactcatttatatcgatgaaatggctgactctaccttcttacgtaaaaaaaaaaaaatcagaagaactcacatatttgcgccggccagctagcgtccgagtctacctgcatgaacccccaatccccatgcatttcaatacagcattatcatccgcaatgacatacaaatttgcatctaacatcatgacctaattaatcacaatggaatcaaaagccagacgaaacagacatcagagtgcagggagacggctcacagattaaaaactgggggatttagactccatcgaaccaaccaaaatgctagcccaggcatccgctgcgaggggctgatctcttctaagggcggagacgagattagcggcttattgggcggaggaggaagaacacagggatggttggttaatctgcgctccgtttggtccgaacgccacgaggacgaggaggagaacggaacgggatggattccacgttacgggccaactgaaacgtgtttcgctggatgggcttgggcctaattagatctataaggcccggtacatttaccactgttttacatttgattaggtctattttccacttgtagaaatcggaattctagggtgagataaaattttgagctgtccaaaaatggtgcttaattgttttttatttgtgcgaggagatatgaatttttattttttttgtgtgaaattcaagttcaataaaacataatacaaaatgtagctcaactagttaggtttcttatgttagaaccctagattcaaatcatatatttgatatggatgctcctatttacggctaattattattttagtagtaggtggcgtacctatcggcaacgatgcgcatgtgatgacttcgtcaatatcaagatatgtcagtccaatatttcggaagtgctcgtagggataggatatgtgtgtgtatttataaggataagagtgtgtgtacattcatagccaggatggtgcaaacatgtcgtacaccttcctcacggacgaaccaaatatctcggacttgccctaggtgtcataaacattggccattgattgcagtttaccaacagcagcaaaacaaaattatcatctcaacttgtacatatatgacgtggccattgatttgttgttcacacagtttggcgagaagaatattgcagtttacaaacagcaacgaaacaaaactatcatcgcaacttatacatatgtgacatgtcataattgataacaagaagtgaggctcaatgtgcatagctgaaataattttgcacaccaagtattcaaggaaaaggagggaatcaaattaaaaaaaatccatcatttgcccccctggtgtgcaaaactttccaacatgtttgaagaatgcagtttgaagtacagcttccagtaccaacatgtgaagactgagccaaaactgtacaattcaccataaacccactctttcaagaatccaaaccatggcaaaaccagctgatcgatcaatcattcactccggttttgatcatgcgagcagcaacggtgcagatgaatcctggcctctccattttctgctgtagtaagcgtagagcgccagctgcattgctcccaggataagtccaagcccattagggaactgaaaaatcaaaatggttaaaaaaaaaagaatcaagctgtcagtacaagatccatcaagctcataaacatgcatgtcgattcaagaaatgaagtgatttaaagcgatacaagatgatgctcacataaatgaagaaatctcgcagcagcaacccatacaatgcaaaactggcgctcatcaagaacgtagagagtgacagatagaacggcatgaactccacagactctgaccgaatcacaactccctgtagacacaaggatggatggagcaagcaaaggttagtgagatccctcagttctattaaacatgccggagatgatattgatcaagagctcagcttgatcgagaggcatacgtaccatgacagctaacggagaagcgaacatggagatcagcgaagccatgctcacagctcccacaaactgctgccgaagcggttgatcaaagaaaaagacgctcgcatgtgaaactagcgcaaacccgcaaactaccagcaccaagagccctatgatcttcatctgtggaggaattggaaaacattatccatcatcttttcctttcttgatggcatattggcatcagacaaaattgaaaatgtacagtactaggctactacattagcaatctattactgcagtctacaagtacatttttctgagacaaaattggttgcaggatgggaagaattaccctcgtcttcctgctgtccgcgtagaagatgaagaggcaaatgtaggcgagctggaacaccgctccaatgccgttgacggtagcgacgagcagcctgccatcggcgacccagggaagtccataccacaggcagatgaggcaattcagcagcgagaacaggtaagggagcccgtcgaatcgctcggtcgatttggccttcaggatcctcttaaacgtcgtcctgaaacaaggaaaattcagttatgaacttcggctacgaatcaaaggatcaagaaaaaaccaaaccgaacgtgtgcttacactggcgacaggaagagagcaagcgcaaagatgttgcctgcagcgacaaaacaaaaggaggcggccagattttcagaagattagcaagcctcttttcgatccagaccattttgcgataggaacttaagaagaattgtaagtgcgagatcgaaatgaagttccgtacctgcaagaccagcagcaaagcaggagatatcatacaaggagtccatggttgttggatgcgggatgacacttgtatcttcccttttctcgtgtctgcctctttgtgctaaaattccgtggctattataaagggcagcacgagtcggtcagtgagagacacaaagcgccacagccaccagttaaatttttgagtaatcattaagagtttgctcctgagaatatccctcttctcctttcactcatatggtaatactgcaagaatgaacaatccctgtctccagtaaatctcatgatctctgtatttttcttctgaattccacggagtgattaatttcgccaaatgcaaaattacaccactcgctggcgaaaagcacgttgcgagggtttctgtcagcaaggaaattaccgtagttactgcagtccttttactacgtagaggactatcgttttccgatgatataaagaatcttcagtggcgtccgggtgaccgaaaggctggataccaggatcgtcgccatgaacacgaatcgaccatgtcgctgtacggagtactatagtacacagctcgtggctgttagagctttggatggttggatggttgccacttgctcttgcaaatcaaacaatccagcgaccagtaagcttgcacggccacaaacggctctggaaaactgatgattagggcgaaatattctggttcacacgctgtgtcatgtcacctcttaaaaacgacccgctaaaatctagtaggatggaggaatgaaaaattacggcccccgagttaattaggaccaccagactgactcagcgcagacgtgtcatgcaattttgtgctcagaatttccaaggaaacgtcgttaatttcattaaatgttactggagtaccatgtttcagacaaaaatacacgtataagaataagaaatcaccatgctactaatatattcatgctgctactacatttttgcacgtgacgttcaagccgacaaggctgtagctttcttgcaccggtaggaggtagccgctgcagagacgctatcattccggaccgtcccctttgttcaacgaacaaattgtccggttttactaaataaaattcgtatagcaaacaccatgtggagccatgaaaacaatggcacgatagatgccatgccaggattttgacaggatgacacataccgggcagggaagtgagcagaatcaatgaatgtaacccacacgtctcattattttctttttcatagtgagtagtctgatgtgcctgcgagctatcacggagcaagactacacaatggaacacctaaatagtttcaacgttactcctttcaaggtgaccgaaccatagaagggggcaaaccggatgacaccccccccccccccaaaaaaaaataagtatgaaacagaaagaacaaaatttctttgctgacgactcaactcaactcttatgctacatgaacataacctagatgataatagacaagggtgtagatttcagagtactacgcgactcgagaatattaaccacaaccaaggggatgtaactttgcacagcacggtgtagaaacatgggccagagagaaacatcagctcgatgttatccattcttcaactccattcatatgagcataaaccagactagttacaattaccatcagctttgaacaacttcgcgtctactgtcttcttggcttccaagttccaacctggtatgtgggaaaaacaagagaacttttaagacaacatagaagattagaagtacatgttattctcagtaataaatactacgaaaccaaaatagtaaataaacatcttgtcccattagagcaaagataataagatgatgtaagcgggctctacatgttgcaacatcatatttgtgcttatgtggagaagaaataagaggagatgaaaggcgggctacagattgcagctcgtgctccaagaactgagagaaatatggagtgcacaataatggtgcagtatacgtatctatagttaactattgtatgagtggtttattaagttagctatatatgatgtgttattttttagagctaatagttggctatattattaaacttgctcttagtactttctcagataaatcatctgagcccaagaaaaattccgatttagtcatttcctatacgattgtcatccaatttcactttgacattacacaaatttgagaggtttggtatccacaacctcaagcataccaagcattacagctggactgtatctcaaatggaattggccagctatgatagttatccatgttatccacaagtacaaaatagttgttattaggaacagaggtaaccattttaaagatgaggggaaaaagagcagagaaatagttcagaatacaaaaggtgcatcctcgtattttcatgtggtagacatcacaatattgctggtagcaaaatggtagggtaaactttagtctctttggatgccaagttggattgccaacagaacataattacgtgtaaaagtctaagagagatcattcagctattttggaaattaaaacttgatttaaccaaatcaacagggaaaacaaattagaacatgtaaaactccaatcatgttcatatgcatagcatgactattctccactaagatgtaaacttggggcatcatgttccatgtgcataacatatatacaacagacaaatcaaataaatcatgtgttttcaatttctcgtagttacagtgttaccattgtgcatccttccttagtttatcagcattggaacaaacactgcttatgaaatgactcgataactataccgggtatctcgtttcttaagcaactaacagattctctgcaaacaaattgactaacatatagcaagcatatccaaatattcaaaactaaaaaaatatgtccacgtggcatatcaaaattgatcgtaatcatacagctagttttatcaaaattatgttcagttagcttttactgacactgggcatctgatttcaaaaggtagttttagttttgagttcactgtcctcttggtaaggaaaagcaaacactaagaaaactctatttgatcagctagatgttgcaaccttaaacagtccaatgatttacagaagcatttacaagaaaaaatgtattgacaatcaaattaaaaaaaaaaaggcattgaaaggttaaaatagcatgaagctttgggagattagttgacaattgtataactgtattctctaatatggtctgataagccttacacaaccttaagtcatcagtcattaacattcttcagctcccttctacaggcacatcaggagactgaactggacagttttttagaaacaaggaaaagagggtgtcctgacatcattgctctgactaggttaaaaatatggtagccatttgaaaaaacaagcagcaaagcacacagaagcgcaaagtgatgcaattataaaacatatagaataatcttgctgctaataacattagtcatgaataaaaaggcataaacgcagctatagtaccaccttcattcctacaaaagaaatcaggcccggtgcttatattaacaaacatcgaaatagtcctagagcatgagcaaaggacagaaaattaaaagaaacaaacaatttagtaaaatatctgttattttaagcctccccaatgacatctaacagtaatggtaatgatatattctttccacaaagcatcatcatcataaaaaaaaaagataaaccatgatacagcgatacagaccttaatctatctctccgaaccagagaacgcatcaaataccccacagcaattccaccatgttgcccgctgccctgctgcagccacagccactgcaggtccccgggccacctgcaatcataagggaaaaaataatgaaccaaatgagacctctcgatttcaaaacatggggaccgatggcatagcactcgatcgcgaacagtaatacctctgtagtatcagctgcacccagagaccgtgacacctccaccacatccttgaccaacaccccaccgctcttcgtctccgattcctgcaccgcaggcggcgcagccgtctccatnnnnnnnnnnnnnnnnnnnnnnnnnnnnnnnnnnnnnnnnnnttatatattcagtcgt

SEQ ID NO: 10308 - DNA, 1680 bp, Oryza sativa
  unsure (1)..(1680): unsure at all n locations
aagggaatanntatgnnttnnctcttnnntcttnntttnnnnnncntggggacccgatggcatagcactcgttcgcgaacagtaatacctcntgtagtatcagctgcacccagagaccgtgcacctnacccatccttacccccaaaaaaaaaaaaccccaaaaaccccccccccccccaaaacccccgggcttttncttttcggttncctncccgaaatttccccttggcaaccgcaggcggcgcagccgtctccatgaccaccacctcatcgcgcttcacttccggttcttgcaccgcggataccgcagccgcctccacgatgagcacctcctcgccctgcggttccgggtcatgcatcggatgcaccttggccaccaactcctcgcgcttcacctccggttcctgcaccaccacaagcgcctccgccttaccctgttgctcctgcgcacctgcggcggcttcgggcggcaaggcgtccaccatgacctcctccccggcctcgaccacctccacgggcacctccgacgtggcggccttcctctcctcctcgtccgcctcggacgcggcggccctcggcgtcaccatctcctcggagctctccatggagtcctcactcacatccactgcacccacacaccacagcatcagaaacacacacgcatccatcgtaatatagcggaagaaaggaagcaatcaaaagagaaagaaaaggcgaacagctcgaaagaggaggtgggaacgtggccggagagccagcgaagagcacgggaatgccaccctcgccgcaagagggagtggggggaaaaggcgattcctctccccgctggtgcggaaagcggcgtgccgtggggggagacagatctacacgggcttaaagcgggggacggggagggaagggtagatgccatccataccatgaggaacgtttggtcgcgacggtaggtggtggttgccgtcgctggcggcgtcgcggcggcggctggagtcattgctgccgttttcggcggcgttgtttttgttgttgttgttgttgccgccgtcatcggagccggcggggtggtccccctgctgcttcttcttgagcttggcgcgcttcttggcacccttcggcatggcgggattcgacgggacggcgcggcggaggggagcgaggcggcgaggagggaaaggggaggcgaggcggaaggaaggaaggggagaaaagagatggatttgattcgatgtggagggagggggatcggctcttttttttaggtttttacaccgatgacgcatcaacctggttgtttttttcaggataaaaaaaatatcgatatatactaacagcacataggcagcccgttatatcgatttttttcgttaaaaaacgatttgttttactttttaagttcttttgttttttatctttatattttgattgtataagactataatacatcttcacaatctttgaatttcgtttttttagtttagtttatgtaatgtgcaattatagacagtttcttataaaaatataaatacaaattatagtgtagttatatttaatagcttcacatttttttaaaaaacactctataacttacctacaattacattgtaattattatataaattttaaaacttgggggatcctctagagtcgacctgcaggcaaacaagaataggtttacaatgcaca

SEQ ID NO: 10309 - DNA, 11850 bp, Oryza sativa
  unsure (1)..(11850): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgcatgcatagcgccaattagtttttccaaggattaaccaagggcgtatgccgtatgcgtagataactatatagatatggatggtgacgagccgatgtggagtgctgacctgaagcgtagagttcttggcgtaactggtctcgccgacaccttccttcatgtggaggacggcctccacgttcatggatggcgccgggtcgtcggggcactggagtgaagaagacatcgccggcagtttgctgatcaagaattcacgcaatattatgctatataatgttgcgcactggatcgatcaatcttggactgtttcaaaatgaaaaaaaaaaggaagtcatttgtgctgcgattaattggtgctgtacatgctgcgtaaaaggcccacatatcagtaacataagttagagagaaggcaaatctgaggaaactcaatccagttaattatttgggttagtttatgtggacttgaccgtaaacattttcggaggcgaacaataatatttaccttcaaaattttctaatacatgcactgcacattacttcaggacgatcgatctgatttctgatctccactccaggttgggtcaagtcgtgcactctgtccctaaaagaaaagaaagtaagaaaatgagaagtcctgcactctgcacagtactgcgtggtgaggtgattttttaagagcaccggtacacgtactaaattattcttgctaaatttttactaacaatcatatttcaacagtttgatttaggtaaatagaaattataaaaaatctagatgcactcatagcatgacacatcgatgttagtaagaatttagtaacatctgtgctagtaagaatttagtaagaaaaaagttagtatgtacgtgcagctttttcctttttaaaaaaccaaaggtgttgaggtgatatttataggcaaggcacgcaatcggaataaggaattcagtggattgcgctaccatggcgaaatgattttttccattttaaaatatttatcagtattggctactattaccgtttcaatttttatataagccttgtttagatcccaaaaaattttgaccaaaaacgtcacatcaaatatttggacacatgcatagggtattaaatgtggggaaaacaaaccaattgcacaatttgcatgtaagttgtgagacgaatcttttgagtctaattacgccatgatttgacaatatgatgctacagtaaacatttgctaattacggattaattaggcttaatcaatttgtctcgcagtttacatgcagaatatgtaatatgttttgttattagtctacgtttaatatttcaaatgtgcgcccgtatacttaaaaactttacacctaaagaactaaatacacccatagtttttaaatagtaaggttataatgaatgaaagttatgtggttatactatactctccccgatttttaatggtgcaattgacttttatacatacgtttgaccattcatttaattttcaaaaatatataattataatttattttgttgttacttggtttatcattaattgtaccttaagcatatttgtacaagattttctaaataagatggttagtcaaacatatgtttcaagtcaaaggtgttgtctattaaaaattcgaggatcacatttttatgagaattcaactcttagcataaagatttggccaaaatataaaacaccacaaaatttggaaagtaccaattaataccacatgatatttaggagtaaaaagtgaaggtaagagagttagaaagggggcaaaagtgacacattatctagttatgtggtataaatggaagtcatggtattaattggcactctctaacaaattttgtggtattatttgaatttggtgaaatccacatgctttattaatcaatttgccaatcaagtgataaaagtttgaatatggatctggcaacaagtatccaaaacaaaggtgttaattcctttttgaacaaattcactttgcatgtgttgtactgtctccggtttttaatatttgacgtaactattggactgatcattcattttatttaaaagttttataaaaatataataaatataaatcatactggaagtacctttaatgataaaacagatcataacaaaacaaataataattacatattttttataaaacaaatggtcaaatatatttttaaaagtaaaaggtactattaaatattaaaaatcgaaaggagtatgaaagtacgacccgcaaatatcaacagcttgttctacgcgccagcaaactctagtttttatgtgcttactgtgttagagattcggcttaatttaatgtattgaaagttcagttttattgcctggggtggtcgaagtaactatgccagcggacatccagatgggaagtaattctttacttttgtacatataagtattttgaaggggaaaaaaacaattccctgataggtgcacatatctctaaattttaaacaagtatatggtctcctactctcctttggtttgtcttattgtggccttggtatctcaatggttttgatacctagcttcaactgcccctggatagaaatttagacacaagctgatggtggtatacctgacaatcattacagattttcttaactattaagcatgttattgatcgaatagttttagggagatgctctgcatgttctatacgaataatacaagataccactaagattgaacactaaaatattaaggccgtgtttagtcgttttggtaaattttttgacgtatacagacacacagttgaaatattaaacgtagactaataacaaaacaaattgcagattccgcttgtaaactacgagacaaataaattaagcctaattaatccattgttattaaatgtttactgtagcaccacattgtcaaatcataacgtaattaggctcaaaagatccgtctcgcaatttacatgcaaattgtgtaattggtttttttcatccacatttaatgcttcatatatgtgtccatacatttgatgtgatggaaaagttagaagtttaaagggaaaacacagcctaagtgggttctatatgcatggccggctggccagattccctcaaacttaaaaggaatataccagagtgatgcattctgttttttcgagcagctgcgaccatactgttgtcttatttgaggcgctacctagttgctctgttctttttttaaaaaaagaaaaaatgaatcaaatcttgtcttagagcatgtacaaatagaactatctataactgctagctatagataagtcatatcacctaagtccaccattatctatttttttcatccgatgagacctgcaaaaataaaatattgtatcacctctttccacgtggcacgtgctatagctttgactaaaaatttgagagaaaattcgatctgaaaaaagggtaaaaaaattagcacacaaaaatttcctcttaagttaaaagcacaggtcaccgattttcctttgataagtagcatttccgtctcattttgagtaaatgacgttagattttatccgagtagagaaatttatcctcaggctaattaaatttgctctttgctttcatcgtcactgagccaagtgccaaagaggcggttcggcacgggagcaggcatggtggtgtgggtggtgcaggcgcattgcggactcatggcggtgacgcgtgatagtggctacggctcgggagaccgacaagtaggcttggcaaggcggcggtcggcgtgggccgcgcaacggcgcaggcacaggagcgagcatcaagcagctgtgcagttcagcacgagatcgagcaggcacgggcgcgtcgtggattcaggcgccgccgcgcggcagtggctaaacgggtacaggaggctggcagcgagtaggctcaccgaggaaaacgaagggcaaaatattctaaggatagattactctacttcagtctaacgtcgtttgttcaaaatgtaacagaagtgttatatatagaagataaatatgtacgacctgtgttttttgatggaagggaaaacttcttgtgctatctttttttaccgggttgtttttttttctatgaattgaattttctctaaatttatagctgggtacactctctcatccagaacacttgatccaaaattaatcagacactcacacaacaaattgttcatcacaaaacactaaattgacgaaatgatttcacatctatattcctacaaaaagtacaccttaaactactaaattgtataccctaaattttagtttataaatccgaagccattaaaaatgtccccttaacccaaaaccacatcaaatgtttttttcacttaggcataattacttatttgtgctaaatctcttccttgcgtactttacatgagtatttataattgagataaaccctttttgctccttaattatggtcttgtccacacatgcaagtctaaattcgagctacaaatgaagaaattaaaataataaattttatctgcattgcacaaatactattcattgtctgattttattatgtttgttttagtggttgttaatcaaatttagtctttgcatgtttgtctatatagatttatgtcatcccaattggtgttactattttttttaacatttctataactatttaaatcacatgtaaataacggctgctatagcacctagttgtagaaaattcttgtctctaccatcttcctctcccttaagcatcgtctacttctatcctggccctcctactttgcccaacactagccgcacccccctcccccaaaaaaaagaaagagaatcattggatctcaatccgatcatcaatattgattgagaatatttcacgactgatttgagcaaatagtaatagattgggaaagtgattttatccctcgagggatatcctcttgttcggtgcatgccacctaaatagtcataaaaaatatgaaataattggcaacatagattaatatgaaatatatcactccacaaacatgcaaatttaaattcaacttctacaagttgtaacaaaaataacaaatatagttgtgaatgtacgataactatttttagtttaatgtactatttttattgcaacttgtagaagttaaatttggtcatacatatttatggagtgatatatttcttattaatctatattgttaattttttttaatttttttaataactattcagatgacatgtaaacaatgaggggaggttccctgtagggataaaaatccacatctataatagattgaggaatggaagggtgagaatgattggatagtacgttgtcgacaaaacaagaatctcaattgttctcatcgactgatacctttcaaattcggcctgaagctagctgacagtggcatttatagatcgcttgggtagagcgtggtatttgataagatactgctactacttctcacagtgatgcatctccatagtcatgcagcccatggcaacagcaaatcttctctacgctgcattgcttgtgccaacggtgctgtacctcgccgtcacccggcggcgcagccgccgcttgccaccaggaccggtggggcttcctctcgttggcagcctcccattcatcgacccaaacttgcacacctacttcgctagcctcgccgcgaagcacgggcccatcctctccatccgcctcggttccaaggtggacatcgtcgtcaattccgcccagctggcccgcgaggtgctccgcgaccaggactccgtcttcgccaaccgggtcatgctggatgccggcgacgccgtctccttcggcggcgcacagaatatcgtgggcaacccgctcgggcctatgtggcgcctgctccgccgcgtctgcgtccaggagatgatgagccccgcggggctcgccagcgtgcacggcctccgtcggcgcgagttcaggtccaccctccggtacctccactccaagcccggcgagccggtggacgtcggcgcgcagatgttcctgaacaccatgaatgtgatcacgggcaccatgtgggggggaacgatcggaagcgagagcgagaggtcggcggtggggagcgagttcaggggtctcgtcgcagaggtcaccgagctcctcggaacgcccaacgtctcggacttgtttccggtgctgaagccgttcgacctgcagggtatccggaggaagatggagcggctcaggtcgcggttcgacctgttgttcaccaagatcatacagcagcggatgagatcccagcaagacgggggcgagatgacaacggacttcttggagtgcttgctcaagatggaaaaggaaggtagcgacggcaaaacaacctttaccatggacaacgtaaagggcttcctcttggtaattaattaattaattgcaactcgatttcatttctccacattagcatttcatcccgcaggttccgaaatggtctcaaaatttcaataatcagaaatcggttaatctctatatgttatatatatgcgtgaacaggagatggtggtcggcgggacggacaccacgtcgaacagtgtggaatggattatggcggagttgctgcagaaccctcaggttctgaacaaggtgcagcaagaactcgacagcatcgtgggccgggacgccgtcgtggaggagtcccacctcccgcagctccactacctccgcatggtgatcaaggagacgctccggctgcacccgccggtgcccctcttggtgccgcacagcccgagcgccgccgcgacggtcggcggataccacgtccccgagggctgccgcgtgctcatcaacgtctgggcgatccagcggaacccactggtctggaacaagccactcgatttcaacccggataggttcgccagggacggcggccacaagggggacttcaccggtagccagctggactacctcccgttcgggtccggccggaggatgtgcgccgggatggccatgggggagaaggtgatggtgtactcggttgccatgctgctgcaggcgttcgactggaagctgccgcagggcgtgcagcttgacctgtccgagaagtttgggatcgtgatgaagaaggccacaccgctggtggcaataccgacacctaggttgtctaagcctgaactttattattcgtgaggtcaccttaccttaaataattcagcttaagcagatccaggccagtgcaacaaattttataaggtgatggtgtactagcacgcaggggcggatccagaaataactaataggagagataaaacaaactatacaaagctatagccccctcttctaatggatgtatgacagaaaattttagtgggggctttacgagggctctcatggtttcaacgtcagtagtgaaggctcgagatcccatagcccctatggtagatccgccaccgctagcacgtgatgtttgttgtgaaaccgctaaggcttcatatgcgggtgggcccatatgtcattttttttttgtgtatattactcttagagagataggtttgtactggctcatactaaatctttattatgtataagtaacccaaaagtcccagcgaaagtgaaaatatttattgctgtcaatcaaaacctattataatttgataccatcacgatctaatggcttaaattttattttattttaactagtatggtggcccgcgcagattgcgcggctagtatcgttatatttttttcttaaaatagcatatatagttttacattttattattaaccaatgtgtgatatttatattgtattgtatatatgtgatagttatttgtagattgtatttatgggtctattgggtgtagctaaactgcagctgcacaacagcagccgctacagtgtatggtaaagaaaatatataaataggctgtacagcacagccggttacaacagtagagtagtgttgccgaacagagcctatatactatatatatatggactctaagttcctctcataatattcctcagttttttatttcgaatttctattatttttgaactttattcctgtatgggctctagacacctctttcaacactccttttttaatttttaattttagttattttataaattgtactttatgtggactctaactctctttcaatattccctatttaaatttcagctgtttctaaattgcattttcatatgaactatagactctttttctaatatgtattcattttaatttcgaattttagttatttataatttccattatttatgaattttatttctatatggactctagacatctcttctaacattttttttaatttttaattttagttatttgtaaatgtatttatatatggaatctaaacttttctttcaatattctttttttctaattcctaattctagttagttgtaaattatatttctatatcgactctagaattttttttaatattcattcattttaattccgaatttcaattatttataaatcgtattcctatatagactgtaaactcttctcccactcttccttttttttctaatttctagttttagttatttctaaattgtatttctatatgggctctaaactctacttttgatgtttcttatttttttaattctgaattttcattagttctaaattatatgcttgtagtatggactttagtctcttctttcaatattgcttatttttaattctgaattacaactatttttaggttttatttttatgtggattctatttttttctttcttctaattaatatgaaaatatctaggccatgagaatttcatctgatttttcttatttttaatttttaatttttatcatttgtaaattgtattcctatatgggcttcagacttttttcccctaatattcctttttttaattctaaatttcggttatttataaattttatttctatatggactctagaatttttttggacgcgactcccggtcgggcgtccgatcgagagggagtcaaatcggaatttattatgcaaccaaattagaattgattggaaatttcaatataattaccacgcctcgaccgaccgatctatattagctactgcatgttcagaatttcacactttcagactttcaaaccaaagttcatttagtgatgtgctcaatagtgggtaattgggctgggtcttcataggacattggtttcctaacacggtcaagtcacgattttgttgttgttttccgtttgtaacaaactcttggagtttggaatataaataatgaaagagaaccgagaaaagttgctgaaatattacgcagcaccaaaactctgtttttgcgttcgatactctgttttttttcgatttccgtcagttaattgtagcagtctgaaaaactttagaaaccaacattcagagttcagtgagagcgagtgttttaggattaggtacagaaatttccaacatatttgatgatcatgttggttactgctctatgttttagtacgcatgcacccatcttgctaaatgctaactagcgattttcttacttaaacaatcacgaatatgctaatatattccaaggttgcttccagagaagaaagtggagatggtggcgcaaggattttgagaaaggaaaaagtacgaattaccctcctaaactatcgtggtcgaccaaattacccctctgaatccgaaaaccagacattactcacccagaactttcaataccggacgaattaccccacctcggctcaatccagagcagttttgtcctacgtggcgtatacgtgacaatccagtcaacattttatatactaaaaaaatgtgggtctcacctgtcatactcctctttccctcttcctccctctcctctctattctctctctcacggggcagcgcacaagggccgggaggtgggtggcggcgtggggacgggcggtgggctgatggaggggccgcgctggcacctgcgggcggtgctttcggcggtggagggccccgccggacagcgactgcaccccgcgaaggctgagctggggcggaatgcagagcacgatgagactccctctctctcgggcatgggcacaggtcgtgcggtggcaagcaacagcacggaaaacgaagccggtcggtcggtcggcgccggtgtcacgcccagaaattctcgaaccagaatttctaagctgaatgtgcattaaatccctgtccaggaccagccagggtacacaaacgacaattgttgacatacagatccacgtcttacaaaaatggaaaagattacaaatgcagcggaaaagataaaagcgagctaaaccggaaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacattgcaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccataccccgaagtatcaccatgatactgcaaaaggggaaatcgtgacaagaccctccacataaccttcccctaaccatccacaccacgctaaggtttcacccccacccctcataaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacagcccaccattcagtgtattttaattaactaataccattgcggtggcaccaatctaacgctatgccaatagacaaagtctatgtaataaggtgatccccatttgtgtgctagttgaactaagcatggctaagcatttcctaaaccaacatctagtcattttgatacccaggttatcaatggcatatggtaaacaataaatggctgagtagtaggacccatcccacatgatattgtaaaagaatgcaacatttaatagaaatgcgggatatttgtaaattgggtacaatatgatcaaacgtattgcatgacttgccttgctctcacactgacgagacctcagcaacgtcttcgagaaaccgcggatcgacgaaacggccgaaatctacgcgacaaacaaagcacacaagcaaaacatgctataagactactgaaacaggaaacaaaagtatttttaatggattctttgcatttttcttgatttactgagacttgaatggacttaaacggagctcggatgaattacttatgaattttagaagataaactgtgtttttactaataaagaaaagtccttnnnnnnnnnnnnnnnnnnnnnnnnnnnnnnnnnnnnnnnnngttntacaaatntcaaagcaaccagg

SEQ ID NO: 10310 - DNA, 6062 bp, Oryza sativa
  unsure (1)..(6062): unsure at all n locations
naaaaacctagaataagcacgcggggaccgatataatagccgaaggggaagggcgaacgtgcccgggaacccaccctattgctccgcaaacgtgggaaggtgtgggaaaagagagaggggtgggattcaaattcgaatcccgcccatttgcggggcgcgcgagggcgggagactcgggggagagctggcnacgtgggcacagcgcgcggggtgggacggagtgggcgcggtaaaagcggacggctacgtgggagcggcggttgccggccgagcgcggtcggctgaaggaagggatcgacctgacaggtgggccccacctgtcagcgtcccgtagagaggggaaggggaacgggctggcccaaagaaagtaggccgagcgcggaagggagtggtccgacggcccaatagagaaaaaagaaggaaaagaaaaagaaaaggaagaaaggatttttccttggattaaaaattgcactttggtgatttttaattggttaaaattattcccaaggctctgaaaattccactaaaaatcttgttaatgcattggagcatggggaactcaagaaaaattccaccacgccgaattcaattattaatcgcatttattaactagggaattagctctaggttaattaagataatttcttcggacgatttatttaaccaatttttaaagcaagcaaaagggggaaaacttcagggcgtgacaaacctaccccccttaaacggaatctcgaccccgagattcggaagagctggcgaaaaggtgcgggtgggtggccttcaactcatcttctctttcccaagtggcctcttcttctgtgtgatgactccactgaaccttgcagaatctgattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacatgttgtggatgccaagcatgttggagggaagctcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgtgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgcttggtctggccatctgtttgtggatggtaagcagtgctgaagtttagacgggttcccaattcttcttgtaatttctgccagaactttgaagtgaattggcttcctcgatcagacacgatcttcttaggtacaccatgtaaacacatgattcttgctagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggggttctgcctttactcgttgacggacgtcacatagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatctccgctgtctgagattcaaatcaggttgagtgaagatgtactttagacttttgtgatccgtatatacctcacaacggttaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaaattttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaattccataaacaccttattcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgtaggtctatcttagagaacacagtagctcctttcaactgatcaaacagatcatcaatccttggcaaaggatacttgttcttgatggtgacctcattgagtgcgcggtagtcaacgcacatccttttggttttgtctttcttctccacaaagataaccggagcaccccaaggcgacgtgctcaggcggatgtatcccttctgtaactgttcatcaacttgtttcttgacttccgccaactcgttggctcccattctgtaaggcctcttgtggatcggtgcagttccaggtaccaagtcaatccggaactcgatatccctttttggtggcattgttgtcagatcatccggaaaaaccactggatactctctgactatgggaatatcctccagcttcttagtggttttctccactgctacctcttgttcttcaccagcagcctggtttaaactaatccctggcttccgcggcactggagactggaagattaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatatttttgccggtgtcgagttgacaggaaatgtgcccaatataacctctggtgctgactgcgcctcctccgcagatgcatgattgacccgggcctgaacgaacttgggtccagcacgtcttggcttcgagcactttccaaccatgtgtctgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacggtactgccggataatcatggtggaaggtccaccctgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactgggtaccgaattcatcatcaagaccagacagaaacttctgctgcttctcggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaagcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaactcaaataaagacactaatgcaactaaacaataaattaatgcatagactagttgcatggaaaatgatgcgcataacattgcccccatcgaatatagacacgacctaatgtataacccccaataaattcccgactgactgtcgaataaactccaactaaaatttttctaaagccctagactgagctaatttttttttttaaaaaaaatccgatccgaaagaacgaccaagatttttcccgcaacccaaaagaggcaaacttcaaatttttccgaaacaaaaacaagtgaaaaagggcatatgcctatgaaaaagggttcacaaagctcctaaggttttcaagtggcttgg

SEQ ID NO: 10311 - DNA, 32776 bp, Oryza sativa
  unsure (1)..(32776): unsure at all n locations
acgcttgattactttagtgaacnnnnnnnnnnnnnnnnnnnnnnnnnnnnnnnnnnnnnnnnntgttttctctctccctgttattttaagcatatttttatttttagaaatagaattagtaccattttaattgtttatgtctgcttattaatttaattctagctaaattgaacaaactaaaaatttggctagatttttctcacgatatggatttattttctgactaacgttgattataaattcgtataaatttcatttatgttcatgtttcttaattatttacgtcaacaatgatgtaatttaggaattatttctgtttaactatgtaaataattgagacaacgcaaattaattattcatgttcatccataggtttcatgaacatatagtattactcgttcatcgacactataaatttggtcgagtagaactgattagatcagacgttgtatttcaattaattagtatgtaatatgctttaattcaattttctcctttttttcttcccgtagcaacgcacgggcacttttgctagtatacaatagttttaatcttgatcaaatttttaggtggtccatggcccacagtgccacctagctagctatgcgtctgccgcataaagcatctaaaaccaaaacccgctactcaagatcaaagcagagcacatcatctctaaagaaaacgatattctaaatgacacctctagaaaggatgcggcaccaggagtaactccgccgcccgccctgaggcgctaggacatgatttaaacctaaaaattcatgcaaataatgccccaagggaaaagcagcgtccgtagatgtcgctattgcttgtctgaagggctaggcttctgcccgtaagctttctaccctcccgtgtcgaggttgcctgcaaaaagggtaccagcaccacctgcacaccttcgacggatggccaccgcgccaacaccttgccattggtcgacctttgagtaggagctcaacatcggacgcgctccaaatcgatccacgcatttgggttggagagggagagggaaagagaagaatggatcccctctcccttgcactagcccgcctaacgtggccattttgtgacagcaaggcgccaccacaagaggactatcatttagattggagcccccctcaagcttgtaacgcaacctcacaacaccaccatcgtcaacacatcgaccaaacagcccgcatcaccgccacctcaggccgctctttcgcatcgcggtcgcctcgccccgttgcctcagctcccgccgccattggacccgctggagcactgtcagcggtagtcttgccttgtgcccgtgctgcggaagctttgcctgccaccggccatggcctcccacaccaggtcagtacaggcacacccatcgccagcagagccgtcgtcgtcgcaccattgcaaaccaccgcccagactaccaccaagccactgcggctcacaccggagtggccagatctggactaggggttctactttgtagctatagatgtcccgtcaatcaccaccaccctactcctttatggtcagcatgttgcccctcctatttactatctttgggatttttaaagtcgaacctgattgttgttgggtttttctttttatagcttttagaagtagccacaattgttctatccaagtatatgaggtatagcggatccacgtaaattgtatacttgtcgatgttttagatcacgattacggtatttgcatggtatggggatcgttggtaccagggtatatgcgaaattgaggtaaaagaggcagagataaggatttttatacaggttcaggccccttattcatcgaaatcaggtaatagccctactcctgttggccgaaaccggtgctgctcttattcatcagaatcacacaggtacaatatttgggataacctatctagccattgtcgacttggtggcatggaacaccatcatgtagtcgacgacagggcagtcttcctcctcgaatatagacttggtgagatcagagatagcgctagatccctcttgttagcctctgatggtaccagattgggtctgtctaggtttatctctgatatcgatatctggcggcatgcattggtgtctattctgattgagcgtgctggtctgtgctggcttgtcttggtttgtccctctctcctccttggggtcttgtatttatatccatagatgtccctttgtccaagtataattagggagacaaatatggatataatctgatcagtcctcatagttttcatgtagaactcttcttcttgtcattccttatccagaactccatctatatacgaggtatgattccgtataaaacttagtatatggtaggccctgccgagcttagtcgattacttttagatatgtgttattcataaccttgacactacttcaactctattttttcttttctctgattaatgtgagaattttagagcagagcaaacttatttacacgtatggtctattttttggcccttagactttgcttggagttcatttctcacctgaattacaaaactggttattttttcaacaataacttttaaaatcatgcatataattttatgatggttctttttatagacgacatgatatagtggtttaattttcgctagcatgaattttagtcaggcaaacttcatgcttatagacctaattatgtgttatttaattttcatcaacaaagtatgcataataagagtataaactacggaaaccatctccatttgaagcaaaacaactactaaatactccatccatattaaaaaaaaaacttctgtctacgaatctagaaaggcttgtgtccaaattcaaattcagaagttgattttttttcttccaagacagagagattatatccgaaagtgtttaccttttcagttttgaatttgaaagtgagaatgaaaaatagactttgtagttcacgatgaaatatacgctttgagcaaagttaaaggttaaaataggcttaaccatctaataataacaacagtagattggatcaataaaccctgtgaatggaaaactgctgacaatgtattgtaaaatagtggcgaccactgggtttgttatctttcccttctatgtttttttagaagcgtgagaagatactaaacacccgtggccatttcacctcaaaatatcacagaaactaaacagcgaacataataactgtctttattagatctattttcatcgtacaacatgatatgtcccacggcttgctcctctacctatagaggtctttatgagaagaaaaatcttatattcggatatttactcataagaaactttatgcctcggagatttgctagctgtggttcatatatattacgagtacaacacggactgcccggcgaaaacaagtacagtacaacataaactgaaaacgagtacttaataatatgcgcaatacccaaaatccaaacgaatagttctcctgatgatgtgattaagcattatatatgcctcttgatgacctgaagcttggcgccgttcttgaaattggagacgatcgagtacacaaactcaggaggagactccatgctgggcgagggccgaaatacgtaatgacggtagaagtggatcgctgacaatttcatctcctgtatggcgaacttctggccgatgcacgccctcggccctatcccgaacggaaagagcgcgtacgggtgcctcctcttctcttcctcgccgtttgggtcgaagcgctccgcccggaacacctctggctctgggaaatttttgggatcctttcctaggacaccaggtgccatccacacccatgttccctgaaaaaacgaatgaaatgtatactgaagtagtacataagaggaaacatgaaagcaagcctgtcatgtcctataaaaatgtgaatattaaggaaagacctaatatcaaataattagaagggtgaggcttcgaacccagatcgtctagcccaccaccttgtgaagctagacggaagtcccctagaaatttctccctgtcatgtcctatatggacttgtatataaagatcgtcggatgtacctttggaaggggatatcctccaatttcgagctgttggtttagttcccttgctatcaatggcgatgaggggtaatatctcatcgcttccttcaggacctgcatgcgtgcacgatgcgcggtcagaaattcatgtctgacgatataaacacgtcgaggaagggtttggcgtgcctgatcaaggtaggggaatttggtctgcagatcctcggccgtcggcacgcggtcgcggggtccgaacccgtcgatctctctgagcagcttctcctccacctccgggtgcttggcgacgaggtagagcgccgtggtgagagtgaacgccgtcgtggccgacccggcgaggaggtgctcgtaagtgagcgcgctgatgtagtccggcgtgagcagctccctcgaggatttgttcgactctctcgccgtgagcatgacggacaggaagtccttgcgctgctgcagcgccgccgggtctcgcttcattgcagccgtccgctcggcgacgatcctgtcaagctgcctcccgagcgtgaggttcacgcggtcgatctcgtggtccgccgtccagcgaagcctcttgagaacctgccggaacggttcatggaggaacggcaggagctggccgacgatgatggagagcgagccggacatgtccatttttagagacgtggtcgcgtgcacgtgcatcttgatgaactccgatgatgccttggcctccgcgcaggtatcggccgcgatcttgcgggtgtcctcgtcgtcgtccgacgaggccaactttttcgacaggccaaagtccgttccgaacgctgcctgcccgaggacgtcagtggtgaagctgagagagagcttggagaagttgatctcctcttggccctcgagattctcggccgcgcgttcaatacacgactccatgctggggatcagggtggccaggtgcgacggctggtagatggagaggatcatgtttcgcatagtcgtccacctcgaaccactgtcgacaaagagtactgatgttttatttgaatgttcgtgaatttataaagttccaacgggggaaactgttttaacggctccagtggacgtccacccatttattgcatgtcatctaaatggttatgaaaaaaatttaaaaaatatgaacaagatagatcaatatgtaatatattaatccacaaatatgcaaattaaaattcaacttcaataaattgtaacaaaaataacaaacaaaactcaaattactatatgtatatttacaattaaatttgttattttgttacaatttgtagaagttaaatttgaacgtgcatgcttgtggagtgatatattacatattgatctattttatcattttttttgaaaatttttcgtaaccatctagttgacatacaataaacgggtagacgtccattcgagctattagaatccatctatgttccaacagtaattaactactaaccaaggatggaagctggcccggtacggtgtgcatgcacgaacacttttacttcttcgagtgatcatttgagttttatcttatgccaaatatcattaagttcgaccatattataaaatgcccctataaaaatatacagtaacatccatcattcaatatatttttatagtatatttatttttaacataaaatgttaaaaatattatattttttaaaaaataattaaacttaaaaatatgacataggaaaacttataatataaaacggagagagagagagtactatttaaatatttaaacattgatggaccttttacccttgctagatctttacatcagaactcttcagtgcctacctgacacaaacaatagtgtaataaaaccattttacatttttgcgagggtaataaaacctttttatggctctactatatggcatatgtacctccattgcatattgctatgaaaaaatagaatggtttctaagacatatgttcttgaatgtattctaagacatattctctcttttcttgtaaaaaaattataggcctaataatttgtaaaagttcaatggaacattatgcatttcaaataagggacaattactaatttgactctatttcgaagtctaactatcagtgactcttatttatttggccctgtttttaaaaattgggattaccgtttgaccatgttagaaaaaacaaaaaaaaaatgcatttatgtgctggacttacaaatatccctaagaacacaataatcctatccccaatttcttctcatccattcatcttcggagactagcatggatgacggtatcagtgcggagagagcaaggctggcattgtgaggagggagcagggatggcagtgacggcggcgcgcagagagagaaggggtggcggcacgcgtgagatgggagcatgggtggtggtggcacgaggagggagcagtggcaacaacatcgtgaggtggcggcggcgacaatgacagcatgaagaggtggaggtggcggcacgtggtaagagcggtggtgtgtggaggtagcggtggcggcgcgcggagggagaagctatagcatcgcgcagagagagcaggagcgacgacacgcagtggaagcgccggagtggaggtcacgacggcttgcggagagagcgatggcggtggcgatcgtggcgacacgcggggagcaggggttacgatggtggtgcacggaagaggggcgatagtggcatggttatctgtattttgctttatctgtgtttttttttcaatttgggatggaaaaaacaatatgatgtgaaaatcttgtaaaatttcattcatagttatgtgagattttgttaattttatttttgccaaattgacgtcaaatttgtcagtttgaagccaaatctgtcaaagcaatgctaatttattacaagtttgtcaaaggtttgaataaaaaaagcttttatgcagttatggtcaaatgagcaagggcaaaaagaacaatttatctcttagctaacacttttatcttgttttcacggaatagggtaagtcttaatcttcgattttgaaaaagggttaaatgtacaaacttgaaaaagtggggtcaaattattaattgggctttagaacagagtcaaatagaaaattgcccctccatataactaatgggttatggccgatcacgctcaaaggaatcaaacaaaaatactacaggctctttaaatttatttttctaaattttaataatttcgaatttacagttaataaatttattttgtcaattcaattccgaaattcaaatttaaaatagcattttataactggagctgacttttataaatctaactaaacagacagaattcaaaaatataaccaatatatttattttaatatttataacattaagaatactagcatgtgcaacatacaactagtaaaatttaattctacttttaatttagctccaagaaaagttatggataaagttctctggtctttattataagagagtatatatgaagaaaatccaacaagttcgctccagacatataaaaaggtatcatgttatccttagaaaaagagaactacaaatatcacttaatcgagttgggtcaaattataataactgtgtaaattggtaaatatagttttatacaaaatatactcgcaaatggggaggcccgagaggtattgtggtggatcatgtgtgtatgggtccgtacactaggatttaaataccagtgtctataaacatgtgggtaagattttagtagaaatttagtgaaataaatatgtactatacgtacttaaggatgcgcattcatagtatatgtgtatctttcatgcaataaaaacatgtatacatatatatttttcttttggatgtagaagtgagggatgtatatcaaatctatttaaatttagcttcaggtaaaattgcgcgaaataaagaaagtaaagcaatcaactgctagttgctactaccttgtgaagaataggcccttctgatgaacaggagaattggtaatgggtgagggcatacttcggttagggaagttcttgaatttcttcacgcccacttccttgcacaactcagcatccgccaccatgaccaacggttgccttcccatgtgaaacctacaagcaaagtaaactagatccagttagcaatagaccctggtatcctcgtcatctctgagctctgcattaaagaaacagaagaagcagcaagcagagaagccagttacctgaagatggggccgtacttcctcgtgagcactgagaacacgtccggcccgtgcatggcgagcaggtggaggtggccgatgagcggcaggggcacgggacctggcacgtgccgcactttccagtatggctcgtacaagtagcctaccaccaggaaacccacagccatggccaccaaggtgaccgcgtactctgccaatattgcgcccagcactgtgctgatctccatctcaacccttccgttccctgacttcctctttgcctcactctcgcagttgatcgtagtgtgccaagcgttgctggttaaataggcttgtgaaccgtccaacagtgtagatggagataagcattgaggtatcgttcagaggcatctttgagaggcgtatggttttggctgtattagtttctccttaatgatgttctaaaacaaccataattaatcgcgtgcagccaatgagtacatcgtgacaaattgatctttgttttcttcagtggggtatctgtcagatgctaatggtggtgggttcatgtccggagtcctgacgtgtatgcacgagagaacccattgtcgcgtacttacacgtaactattctaaacgctcgaggggatgccatctgggtgtttatatgtcattaatataagaaaatctgaagtaatttaaaaaatttatcaacatgtgatatatatcactccacaaacataaaagttaaaattcaccttctacgtgtcacaactaaaaaaccaaatttgactgtgaatatacgttaactagccgtagtttaatttatttttttcgttgcgatatgtataagttaaatttaaacttacatgattgtgaagtgacatataacatattaatacatctttctcaatttttttcataactatttgagtaacatgcaaataacagtttaaaatccaccctccgtgcttgcatgagttcgtcgatgcatgatgaaataggtcccgtgtatttgttggcactcataaattctcgcgcaaaaaagtaaaaaaaaatccaaaaatagcagaatttgttagttcctacttagttacgaatatgaaaaatatgtaaagaactggcacttaaaaaatggagataggaagagatataaatatgcaagtcttgtgtgtgacaatgggtgtcaaattcaattgaaataaggtatcaatttcattgagaggacatcttgaaaatcgtcaaggaaggtaatcggataatctaaaacttgttaattaaatcggtatgattgaataacttgccttatctttgtgcatctagactaagtttcatttctttctaattagcctagtttacaaaatgttgtaccgaaatgcttgttcaatcaataagcgagtattagtcacaaaatggtgtctatgggaatcaaagtactcggagaccttattctagctatgtgaattttgtcttagtgttggtatatatttcttaacgtcacaaatagaatccacaagcgcacggaagatatcaatacagcacttcactctagagtattccaaggcatcgattttcacagggaatgtgtatgtcagcacggaagataccgatgaacatgtatgtcagctcttctccaggtttatccaaggacacaaagctaagataggctaagagaggatttactagcgagagacagtgtctacagaaagcttaatttaatcctaacatggtacttcaggcgctggccagcccgctgctcccagatatggctctacagcgtaaccgggtagggaggactttagtgtacttagggttgtgttgatgtaaaaacacgaggcctgagagatctgcttaactccagtgcaggtcaaatttggttgttaacaggttgccaccacctcttcacctacctcaaacctactatgggatacgaaggaaattaactacccaaacaccatgtctacaccgttaataactactttaatgtttataactcactaaagcaatcactatattttaatggactataatgaacaatgatcccatacgttgattaggaactaactaagaggtaactctcatagaataaatcttaattcctcagaatgatatttgattaaagtagagtaattgccagagtaaaataaataagaagaggattatcgacaactctggaattcctccgacttcctctactccacctctccctaatctagtatacaataaagtagaataaagcctcttgtaattaagctcaagcttcaagtgtgttgtgaatgagggaggagagaggtatttatagtgtggaggtaacttgagagagtggagatcctccaagcatccaaagagcatcttctctcttgtgttgccaagtgtccatgcttatgacagtttctactagtgaaaacggccattttccaaagagcattgggaagcggttttctactgaacgcaacctgggcttgggccagtggcctctgtcaaggttcggcagaactcagagttcggtcgatccctagccggctccgttggccccaattttcggcttggacactcattttgggcccctcattctattggtatggatgtttggcccatttggaggtgtttaattgggtttttgggtccaaaactccataagttcggatgcgagtttgattctcatcctccttcatgtatatttcttctcaacttagatagtttgtcacctacatatgaatatacaccaacactcgtggaaattattagaaataaatcctaccactatgttggatgttttatatttatggtttaatgcagctattgatggcgaaaatttggtacttaacagccatcaacacttagcaaaatctttgggattcatgtatactaaatccgtttgcgatatgctttgtgaaaatttgtgtgagttgttctttttaaaactcttgaatctcactcaagtttgtgaagaagtggtttggcatgttcaaatctcgatgatcccccatcattatatatcatatgctcttcttgccatgcttaaatgccaaagtgggagaggagaactaagggggagggatacattaaatgaagaaaataagaatgtccttgacatgcaaaggggagactttttgttctatgatttaaaccctttggatgtgagctttttatgtgcaaaatttgtatctcaatgcttattgatttacttgtgatctttgtgtcaatttgatgttcattacctaatcacaagtgatgaaatataaaattgagaggaaaatactcgatgattcctcatcaattatccctttgctttcctttccttacttatgccttagtttttagatgtcaaagggggagaagtatattaaagggtataaagaattattataaagggtgagataattgtgagaaattatcaaaatgcatgctttgaaagatgccaaagggtaaatgagaaagggagagagaatatttgaaaatgtttatcaattagcgtgcgcatggtgtgatggattcaatgcgtattatttgatcaccatgccacatgcaaatgaaattatatatttatacttgaaattgattatgaaatttggttattcgtgctttataaattggtaccggaatcaattggcatagaatcaagtttttgcaatcagcgaatgaaatttgaaaatatagtgttcattcaattttttcttagaaatattccatatgcaatatttttagtagaaatataccaccgaatcattgaatcattgcgcgagaatgacgtggacatgacgacgcgggaagtctcgcgcgacaacggcgcgagaccgtgcagtgaagttgcgagaccgcttggtctcgcataaccaacaagcgagaccacaacagcaggtcaattcaaattgattaattagtgattaattatctaattagcgattaattaattttttctaataagataattaatcattaattactattaattaatcaatgttttggccgcggtcgttgtcgctatgttggccgcattgtcgctgtgtatccgcgcgagactgctcggtctcgcgtcttccccgtgcacgttattctcgtgcaatggttcagcgtatcaacattataattctatcaaaaaaaatactttctggatatttctgagaaaaaaatgaacaatatgttttcaaacttttgcctgcaatcaacatcaagaatttcatttgatacattttgaatcgataccaagaatttgaattgtaagtttttttacttttggtatctcttgtcacacacaacacaccccactaacgccaagagttagagggagctctcacattctaaaatatatatgcatatgagttcacttcatatatttgtatgcacaaattgaggggagctctttggattcaaaatcatttattatcaatctttgtaagctttaatcatgttgtcatcaatcaccaaaatgggggagattgaaagagcatctatgcccctagtgggttttggttaattgatgacaaacgattaggggaatagtgtgcttattgagtgtataagcaaaggattagtctggtgaagaactgataaagatgataaagaatatgcaatacaatgagttttcattgcaatccaaggccacaagtgacggaagatggctagatgtggtgaagggttggtaagacttggctacgtagtggactgatggaccatgcataggagaagggcaagcggagacttggcgccaaaggacctgacgtagtggtgaaggagcaagtgcttggccgaataccgttgaaccgatcgaggccataggatgtcacaagttgctgacgatcaatccttgttgaagaagaagtgcaagatgaaatgtcgaaagatcaagaggatatgattcgttgatgatcaagtcaaattttgtattagcattgttcaaggcaaagaaacaagaagacataaatgtattcgtattggtatagcttttcaatttgttcttgatttggtaggaaagccatactattaagaggaacgtggccttgatgtctagtgatgagtttggagctcaaaatctttgttgaagtggttctcactcttgggtttgtgtactggagttttctaaatttgatttaggaagttcccgaattggtttttgccttcgaaaaatggtaatggtctttgttagaagttctcaaaagtcattttggaaattcccgaactacttcgagtttacaaaaacggtactggtgtttttcggaatttttgaaaattgcttcagaaattctcgaaatgcagtgttggcgcaaaatcagtacgggtgttttcagatttttttccgaaatgcttttttgcccagttttctgctgtgctcgtgctggaattttgtactgttcggaaaattccaaagttattgtagcaagttttgaaagttgtttttgctctctggtgattttcgaatatttcaaaaatcacttcagaaatttctaaaaaatggaatatttgctcccatcggacaaatctgaggccgtggctacaaatagccccctccaccccccaagttaaggtggctggttccattccaaatcttttgcccttttgagccttgagatccacttttgagccttgcctttctcacttcttcctctccaccaatctacaagcttagatttcgtgagtgtacatgtgtgtgtgagtggttgattttagtttgtttgagtgcttgttgttaactttgtaaatatttgttgagatttatccccaagaaatcttttttgcatttgttactcttggtggtggaggacacctatagacggctagagtcaacctcgagacaccgatttgtttgtagtgtgccgagggagtttgtgaaggtcggatcgcacctccgaaaggaaagagatacccttagtggaaggcgaagtgcatttgtgcaacctcatgaggatagaactggaaaagacctggctcattgtgggctcctcaacggagagtagaacccccctcagggatttgaacttcgggaacacaacatcttataagaaccccggtgatatctctctctcgctcatctagctttgttatttggtgcctctagtagtttagttgttgtttgtgcaatccctttcctaattgtgccactatccccttttgcttgccttgctagtttgcttgtaaatatgagattttcaaaaaaaaaatcggaaaatatttggaaatatccaaaaatatttagaaatatccgaaaagcctagctttcgaacttacttaaaagttttaaacgcctattcaccctctctaggtgacataaggtccttttagaagtaaatgggggcatatgtgtgtgcatgcatgcatgcaaccatttgcatgccatgtgagctgcttcagattctctaggcttatatatactccatccatctatttcatttactcttccattgaagcgacaacgcaccttcaccgatgcacagtaaatggaatataggtctttagaatgatttttgtttccttggtcttgatgcacttctcttatatggtgatcaaaagtgaatgaagggagtactaacaggtgcatgcacatcgtgtagtggtatctagggttacaatactccgttctaaaataattgtttctgggttatttagcatatattaaggtttagaaaaaaaatataggactcctattaaatgttgtatggttgggactgtgagtggttgtaatacccctccctctagaaccgtgcagtttagcccatccgatggatgggcccatttatacataccacccacttacattttcgctctaacttcatgtgaaagggtcaacacgggagtgttacagttagagtaagaagaccttataagttttttgcactcttgctaaactagctatgtggtattaaaaatgagcacatagctatcatgggtcacacatgggccatccaaattaatccggatgtcacattcacccctttcccctaaaaggatccaacgttctcgttggtctaacttcatgtgaaaggatcaacacgggagtgttacggttagagcgagaaaaccttataagcttttgctctcttgctaaactagctatgtggtattaaaaatgagcatgtagctatcatgggtcacacatgggccatccaaattagttcggatgtcacattcacccatttcccctcaaacgatccgacgttctcatcggtttaacttcatgtgaaaggatcaacacgggagttttacggtaagagcgagaagaccttataagttttttacactcttgctaaactagctatgtggtactaaaaatgagcacgtagctatcatgggtcacacatggaccatcgaaattagtccggatgtcacattcacccctttcccctcaaaggatccgacgttctcgtcggtctaacttatccatgtagccacataggcaaataggcaaatatctaggaacacgtctccttttagtgtgcgtccatacgtccagtgccgatgctacatgtctcacatagagcccacgtgtgccattctcccgcgcactgtcccatacacgcgcacaactgcgagggtcggttctaataccatttgtaacagcccattctccaaaactggcagctcagctcattagatgaatgggcccacttaaatattccaccccacttacaattccgttcccgtttcatgtaaaagggtgaacccatgagtggtatggtttgaaggacaataccttataagttgattccactaggggtgaaaacggatcttattctgatggatagtagttatatcatatcctatatcatatttttttaaatggattcggaggtgatttggataatgtgcggatgcggagcggattgtttcagatgtcgaaaatggtgtggagctagtgcggactcggttcggaaatggatgaaaataatcggatgtggcatatatatacaatcgatacaatatttattcatctatacaatgagcaacaatacggtaccaatatcacaattcacatggttcatgaaagcacacatcacatcacaatataatgttaagttgttaacgattaacttgtcatctgtccaaatgcattcaattgacgcatgtagtaccaacatcaagatatatctcattcagataacagatatagaagttccacaaattaaaaatacagtaccaacatcaaagtatcacatgacataggtatcacatacataggtgatagaacattggaggcgtcgccggcaccgagacggagacaaccagccacaggcggcggccctgtggtggaatggagatggcaggtggtgacagcggggtggagatggtaggccgcagagccggggtggaggaggcggcggtgtggtaggacaggaagaagagtcgaagaaaaaattgcaatgggtgatggcagcgtactctactatgacggactgaaggttttatgacctagctagattgatcgatggataggttggatctggatgggctagatttttacacgactaaaatgctcatgccaaatgggccaaattgagtggttatatgggctacgaaattcggattatccgccaaaacgttcatcggataatccgcttaaaatagcggataatccgtatccaccggatattatcgataccatatcctcatccgcacgtcactatccacatccgcatccatattcgtcggatagctaaaaacccttaccatatccgtcggataactaaaaacccataccatatcctcacttcgaacggatttggagcggatcggattggataatatccgatccgttttgtcacgtcctgataaattcatcccgaaataaaaatcattccctaaaaggaataatagaattaattaaaattcgaaaagaaattggcaagcactaaaatacgtacaagaaaaattcgaatgtggcccggagaatttttgttaaattctccttggtctaaaaggagctctcaaattttacttgaattttcagagcaccggaaatatttattaagcaacaaaaacaattatcaaagtttattaaaaagaaaacctagaaataaccctctctttccctttgggccaagtctggcccaaagtcctctctctctctctcggcccgcggccaaagtcctctcttcctccctctctttctctccctctccttctctccctcctcttgggccttccctccccctcccggcccagcttccttcccttccctttttcttccgggcctcctcgccctcctctccttctgggccgcctctcggcccaagcctccccgccccctcccacctgggccgccttcgggcccaactcgagcggcgcccttccgcccgtgccgtgcacgtgcgcgcgcgtgcgcgccgttgccgcgcgctgacgcgcgccgcgcgtgggtcctaccgcccggtcgtcgttctcctcccgcccagctctctctctttcccgtgaaccctagtttctttctttctcaaatcgcgcaaaatcaattcccttatttccaaattaagtgggggcttttaatcccctttccatcctctttgatttcccccattttcccccttgattcgtgccctctaacgcccggaacggccgcgccattccggccgcccttccatggccgccggccgtcttttccgccgccgttccgccctctcccgtggccggctcccatcccgcgcttataaaatggaaccacctctttgcgttctatcgttttagcctcctcccgcgtcatccagtggccgcaccacttctccccgctttccctttttttttctccgaccgccgcccgcctcaagccgcttttcccgcttggcccgcgcgccgtccggttgtgccgtcgcttccctcggttttgcaacaccgtccctttcaccggcttcaccgtttcttcgccggaaactcgccggaacggtgcccccgccggcaaccagtggcattggtgccactgtactccctcaagccggctactgttcctcgtcctcgtcggtgcggcagccgtcgtcgtcgccatcctcctcgacgtcaccgcgtcgccctccaccccggcctgccctctatttcccgcgaagacctccggaagtgcatccccgccggcaacagtggcgttgccgccgctgttccgcctccggccgcctctgccgcgtcccctgtgcgccggccgacgtcgccaccacctctccctgcaccggaacgccatcctcttccccggccaagccacggcgtcgcccgtatttcgtcggaacgccgtcgtgcgcgccgcctctccctcggtctcgtcggcacccactccggcagcccctttcgctgtgccagtgcgccggccgacgtcgccatctcctccggcatcgcagcggcaaggtcgccctcggcctcgcctccccttcgaccgaaccccgccggtgttcgtcgtcgtcgtgatcgttcctcctcgccggctcgtcgtctcgcggcgccgcctccgtcatcggattcgcagtggcgtgttccacgccatcctcgtctccgtgcaaccactgccggctgccctcgtcgcctcctcgccggccccggtcgtcgtcgtcgtcgtcctctcgtcgttcccggtcgtcgtggcgttcgtccctccgtcgagccctcctcgtccgtcctcggtgtttcgtcaaggtcgctgcagcccccgtcgtcgtcttcgtcctcggctccgcgtcgtcaagcctcgtgccggccgcgtctcgccttcgtccaaggatcgccaccgaagtcgtcccctcgccgttcgtctccgtcgttccgggctgtctccgccgcgcccgttcgtcgttgtcgttccctcgcctcgtcgcgtggtggtaaggatccctccttcgctgccccgtcctcgtcctttcggtgtcgcccgtgcccgttgtgcggttgtcggccccggtatccgtgtatcggtatcggtagtcgttcgcttgtccgtgtagtgtccgtgttagtgtgcccgcttggtagccgcgttgtttccacgtgtgcaacccatgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacagcgcagccttcctgtcttttcccggctagcgcttccacatgttttatagtcgcaaagcctaattataataatccgcaaatctccatataacagcattaaacttcggatgatcatatcttggtcatacgaactctgaatcgacccgttcaagtctcctaatgtttgttataacctaaagaaccgtgtggtttctttttatgtattgttattgcttctttataggcttgtggctttgcttgtgtgcttcgcgtagcttctgtcgttccggaggttctcgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattgttgttattgttattattaccttgttcaccctaggataaacaaaaccccaactagtgggtactctgttcatggttctactattatgaatttaggtagatgcttcgctgattaattaggcaacattaggtggttttataactttagactttgggaattctcatatcatttggacagtatggaatggttggcttattgtggaattggacacacacctccccctctattcaaaactcccaaaatggttttaggctgggctcgaggtgcgtggttgggttttgttagtcgtacctcgggtactataaggattaagctcgggcctctgttgcaaagcactaccatacttccacatgtctagtgggtaaggcttagtttgtagctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtgtggttgggtcggtactcttgtttatggctaggatgggttgggaactatgtcacgtcttccgtccgtataccgtggtggtatgtggcacgtggatacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggttcgtgcgggttcacgaccttgattaataatactgtgtagctctaggatcgtctttttaaaatggctttgggcaactaagtgacttttaaatgctgtttactgcaaacacttaacccctattattaaccccttgtacccccttgcattaatcatgcatctgccggtgtgacttgctgagtactgtggttgtactcattcttgctcaatctttcccccccttcagtaagagaagcttcggagaagatgtcttaggtggagtcctggcttataccccagttgagcgcctgtgaagataaagccgtaggcccgctagtccgctgctgtttatttttgattgtcaggccttaagtgcctttgtaataatgtaaatattatcgatataataaaaatgtgtcttttatatcatgtttgtgtggtgtaccccggcttttcctgggacggggattaatacactagcgttcgggaaaaggcaattttctcggtcgcgacacgttttcacccctagatcccacccatactaaactagctatgtggtactaaatatgagcacacaactcttataaaccatacaagggaatatggcatgtcgcagtggtggttgcgggtagaatgtgaaaattttaaacagaaggtgattgtgtgatatttattttggaacaaatttaaataaaaacaagtattttaagacgaaatgagtatgtagcacacgtcgatacacgggttgatgcatagtttctcaaagaaaaaagtacgaacatttgacaccccaaactcttaaaaccggataaattaccaccctaactcgattggaagcggttttcagcctacgtagacacatacgtggcgatacaatcagcaaaaacaaataaaaactggtggggcccacctgtcagcgccttttttctctccttctctgcccatctctctctctctctctctccaggtgaatagaggagacggccggtgggcacggaggaggctgcgggcggcgggcgaggagccgaggccggcggcaggcagatgcgaaggaagctgcgggcggcgggcgaggagccgagaccgacggcgggttgagtaggctgcgccgatctccatcccgtgaactaagcaggggggcgccgccgtcgtctgtcttgctacttccaccgcagtcccggtgagcacccatccgccacgcacaccctcctcgtctcgtgccgccgcctcctcgtctcgtgacgacaacgccagaaaactccagctctcccccagagttcgtcgctcccacctccgtttaccgcaccggctgtcacgccctgaagttttcccccttttgcttgctttaaaaattggttaaataaatcgtccgaagaaattatcttaattaacctagagctaattccctagttaataaatgcgattaataattgaattcggcgtggtggaatttttcttgagttccccatgctccaatgcattaacaagatttttagtggaattttcagagccttgggaataattttaaccaattaaaaatcaccaaagtgcaatttttaatcccaggaaaaatcctttcttccttttctttttcttttccttcttttttctctattgggccgtcggcccactccctcccgcgctcggcctcctttctttgggccggcccgttccccttcccctctctccgggacgctgacaggtggggcccacctgtcaggtcgtccccttcctccagccgaccgcgctcggccggcaaccgccgctcccacgtcgccgtccgcgtttcccgcgcccactccaccccaccccgcgcgctgcgcccacgtcgccgcctctcccccgcctctcccgccctcgcgcgccccgcaaatgggcgggattcgaatttgaatcccacccctctctctctccccccaccttcccacgtcgccggcgcaatagggtgggttcccggccacgtccgcctccccctccgcctataaatcgttccccgcgtccttctatcgctttttcctcttttcaccgcactctcccgtgccgtctaccgccctcgcgccgcgcacccgagctctgccgcccaccgcccatctccggccgcgcgccgccgccgctagagtcaccgccgcgccgcgtagtcgccaccgtcacgctcaccgagcccgcctgcacctcggccaccattcggttgccgccaatcgtcgccgaagcgccgtttctctcgcacgccggtgagctctccatttccacccaactccggccggccgctctagccgccgtggtcgctctccctacccctaacccctctctgttttctcctagcgtgccgccgccgcccgtccgcacctcagcatcgccggtcgtcgccgccgtttccttccttcgcgccggccgtcgtgctcgccggtgaggaatcccctctcctccttcctttcctctctctcccatggtagtagaaaataatttgaatcattaattttatttgatcgaatggcttatatctatttatattaccacccaattaacaacagtatanacatggaggggtattattataaaaaaaataggtgagaaggggcataattgtcatttagcagtgattaaacctttttttttctttttttagcttttatcgatggaatataaacaatgccagtgcaattgatgaccatagatcaatctagtcaagcataaataacaaagttacctccaatcattatattagtaaatcattactaatttactattaataacgaaccgttgaaatcatttctacagatagtataatattattagtaggaagcaccggagcatctccttgatgtacttatatatagatcgttggatctagtacctttgggaggacatatcctccaatttcgacttgttcaagtgtttccctggctagcaatggcgacataatgtagaatctcatcgattccttcacaacctgcattcataaccaggtgaaaagtgcagtggttagaaaaaaaaaaattggtctcacgaacccatgaacacacaagaaaatatacgcaacacatacctgatcaaggtacgggaacttggtctgcagatcgtcggccatcggcacgcagtagcgggggccgaacgcgtcaatctccttgagcaacttctcctccacctccgggtgcttcgcgacgaggtagagcaccgtggagagggtgaacgccgtcgtggtcgacccggcgaggaggtgctcgtaggtgagcgcgctgatgtagtccggcgtgagcagctccctcgatgacttgttagactccctcgccgtgagcacgacggacaggaagtccttgcgctgctgcgacgccgcaagatcgtgctccattgccgcctccctctcggcgacgatgctgtccatatgtgttttcagcgcgcggttgacccggtcgatcttgtagtcccccatgccgggaatcctcttgagcacttgccggaacggctcttggaggaacggtaggagcataccgacgagtatggagagcgatccggacaggtccatcttgagagatgtggtcgcgtgcatgtgcatcttgatgaactccgacgatgccttagcctccacgctggtatcagcggcgatcttgtctatgttgctgtcgtcaggtgtgactggcagctttgacaggccgaagtccgtgccgaacgccgcgaggccgatcacgtcggtggcgaggctgagagagagatcggagaaggtgatctccttctggccgtcgaggttcttggacgcacgctgaatgcacgactccatggtggggatcaggctggccaggtgcgacggctggtagatggagatgatcatatttctcatcgacgtccacctcggtcccctgcggtgcagcagccatgatgttgtttcctttaatttaacccaaatcaattttttcgacacaactagcataatattcaatgaaattcggccaaattttatgggaaatagctagtctctgctgctagccagctagttgatacttgatattacctgggaaactctaaactatggaggagacaatcctttattgtttacatgttatctaaataattatgaaaaacttagaaaaaaatcaataagatagattaatatgtgataaatcactttacaaacatgcaagatcacatttaacttatacaagatgtaatgaaaaaataaatttaactgcgaatatacgttaactagaaagtttaatttgctttttctgctgcaactcgtagaaattgaattttaacttgcatgtgttgtgcaatgatctatcttcttaaatcttttcaattttttcataactatttggatgacatgtaaaccacggagtaatgtcccctcttagagtttagaatccactctcgatgctaccttatgaagaacaaccctttcttatggataggagaattggcaatgggggagggcatgcttcgatttggaatgctcttgaatttcttcacgcccacttccttgcacagctccgcatccgccacaatgatcagtggttgccttcccatgtgaaatctgcaagtaaattgaataattgtgctatgtgtatgaactttgatctaggttcacactgggtgtgttgttttaatctaggtttgcacagactagataagtttttcaccgaagagtactttgcaatttattacacatatttgcatccacatcataaatttatgcatcatgaatgtagtttactctaaattgaattccagttaactggttggtactgttatcctaagctatgctctccacgcaaaacaaattagaagaactgaatctgcgagcagaggaggcagtcacctgaagacaggaccgtgcttcctagcgagaacggagaacacatccggcccgtgcatggcgagcaggtggaggtggccgatgagcggcagaggcacgggacccggcacgtgccaaaccttccggtacggctcgtacaagtaggccaccaccaggagacccacagccatggccaccaaggtgaccgcccactccgccgttgcgcccagcacctcgctgatgtccatctcagcgatctcactctcaccctgccttgcctccctcttgccttgctatcatttatcgcactgttgacgttctgtgacaactgcgaagcatggttggttaagtaggcttgtgaaacggtccgttcccgcaggattcgatggagaggcatcgttttggttggattagtttgtcctgcttggctgatgtatttgttgttagtcactggttccgaccaaccaattttatttgagcgagatttctgagtctacgtgtgatgatggacgtgccggtcgaggaagaagtttgctaaaaacatgcttaattaaatatcgctgggccggaaaatgcataatcaaatgacgtgcagccagtgagtgcagtgtgacaaaaaaaataaataaataaggaaggtagctgccaaacgtgttgatgccttagatattactcttccatttcagattataagtttggtcaaagtcaaacaactttaaatttaattaagtttataaataaatatagtaatatttataatattaaattattttcattaaatcaataattgaatatattttcataataaatttgtaggttaaaaatgttaatatttttttctacaaacttagttaaatttgaagcagtttgacttgattgaccaaagttaaaacgtcttataacttgaaaaggaggtagtatttttttaaaaaaaataaactttatatgctaatggtggagcaggcgagattctactcagtaggtttcttgtcctcgtgtatataataaggtgtactaatcgacaatcaatatgatcgatgtaatactcttaacggatgtgccgctagctgattggtggatttattccgcaccaaattactgacacttgtccctttttctatttggtatgcagtaccatgcgactatgcgagtatgactatgagacgatacttggctaggctccgtgaagttcttatgggcctcaagaaaacaatcttagctgtttttcttaacccgttttaaaaatggtatgttaagtaaactaagatacataatgacacaatcctatataggcttacaattattgtatttcacgaagaaaaagtactgttgaaaaaaacaatttatgtatgtgaagatatatacagtgattaatatgaaacatggcgaaaaataatttaatagtgttacttccacatagtaaaggatgtcaatatcgcacataataattgttcacgtaagattaacaaatctataaaatataaagaaagaaacaaatcaatttaagggtaaaactttccatatctctaataagttcaaaagaccaccaaggctaaaaaaaatttaagaagaaagaacacaaaattaactttaatattttattaaaattaaattttgtttgtggcttataaaacaataaataggctatgatggtactaacaagttttcaacttccttagtccttaccaaagtcttgaatcctacaagttacttcaaggtatactgtcacaagtcgaattcctttgatcgtcgacgcgctcttcgccaagtacaccgagctcgtcaccgcgtccagattggggtcgtcctcaccatgttgtgaaacaaaccacaaagctgtgacgactgtccagagtgatttgtaccagtttatagtttgacccctgtttctgaattctaatgtgtggcgatgtggtgtttagttgttgtatcgagtaactgataatattaacaaattccatgtgtacttaactggtaggatggagagaaattaatggaaactggattaacaagtgcgttgaaatgccataaatcatccgctacttcctttcatcaccagtaattctgtatccagcaatactactgatttgtggtttatagctccacactcctacgaacgctaataaatgtttgcgatttttttttttggtttcataaaaaaacattttttctcaattttcttgaacgcctttatactttcccttcaaaatcaatgttcacaaatatgaaaacaactgaacaagaggccttgtaatgggctggcaagagcaaacaagggcaacctttcggccatcgtggaatgagatgggctgaaagaggccttagggcttgttcggcctgttgctaaaatcaaccataccaaattttagccaaattttgataagacaataaactaaatgacactttaccgtcacaaccttgtcaatccgtaccaacgtctggtaatctagaaacttctactcatagaattataccaaaaattagtaaggtgttagactaaacaccatcttcacatcttgatcttgctaaaattttagcattaccaaattttggttaaatggtaaggcttttttttggcaatgaacaagccctttgttccattttatatccgtcatcttttcgttgagtttaaattgtatgcttaatactgaaaatcttaacccctaacttacaaaaccaggttaaattaggtcccataatagtattgagaactgatttcactagcgtgacatactatttagcaaaaagaaaaaacatatagtgcccacatgtaagtgagcttgcacctctccccacctaccctctcttctcatccctccacctctcccctctttttttccccaagagctcaccaatgagaagaggggtgttggcgggcggctggtagaaaagaagcaagatggtggcgactcatatcctcaccgacgagccctacatgggaggttggaggaggagaccacgtggtggagaggggatggagcgagccggtgaccatcattaggggtagagctcggggagccaccgtcggtgtggagagggtcactatggtcagaatatgacggacgctatccttgcttgcatccgctgtcaaggccgatggtggctgtgaacccgtggtcgccaaagcaagagccaatgtccagattgtggcagtaggaggagcacaatcagtggactctacagttttgccatgggctgcggtgattgggaggcttcgggtggcctcggtctctggctcgatcggattggtgagtgatgcttcggcctcctgtttgggtggctcggccaccgcgcctctctcattgccatcgccgccgagatggatcaaagtaggggaatgtgtttgcgttgaggtgcacacgatgaggcgcaatgagagctgtgatccacaatgagtaactgctccgtgtgttgagacagttgctcacgctttaccaggaggatgacaggtgggtcccacatgtcagtgggtctcacaatacttttttttttgaatgacataagggtcccacatatttttttatttttgtttttattctaataccacgtaagcgtcacgtaggataaaaacttggtcaataccgccacgtcagccaaaaccaccttcaaaaccatcgagggacattgtttgcaccggtattgatagttggaggagtcgatatacccggttttgtggttggaggatatgaatcatactcaggcgatagttatgggagccaaagtatactttttccaaattttttacaagagaccccattaaacgtagctgggctatgtgcctgtgttggacttcggactggtagaacaatactagtaggagtaccattttagcagtggcgaagtgaaccgttgacagttcttttgttttgacacagtattaaatgcagacgcttagctcgaactgataaatatacagttctgctgatgatgtgcctatgcagtgtgcctcttgatgacccgaagcttgacgccgtacttgaagttgcaaacgatcgagtactgaaactcgagaggtgactccatgctgggcgagtgccgaaacacgtagttacggtacagatggatcactgacagtttgatctcctggatggagaacttctggccgatgcacgcccttggcccgatcccaaacggaatgaacgcgtatgggtgcctcctcttctcctcctcgccgttggggtcgaaccgctccggccggaatacctctggctccgggaagttcttgggatccttcgctaggactcctggtgccagccacacccatgttccctgaaaaaaacaagggtatactagtacggaaacaacgaagcagagtctgtctggaactctggattattggccggatctagtacctttggaagggcatatcctccaatttcaacctgttcgcacgtttcccttgctatcaatggcgataaaaagtagaatctcatcgattccttcacgacctgcatagtacgcacatgataagtgcaatgctcggtcagaaattcaggtcttactattcacgactccacaatcgaagaccataaatacgaccaatgtcgaagaagggcatgcatgcctgatcaaggtaggggaacttggtctgcaaatcctcggccgtcggcgcatggtcgtgtggtccgaacccgtcaatctccctgagcaacttctcctccacctccgggtgcttggagacgaggtagagcaccgtggagagagtgaacgccgtcgtggccgacccggcgaggaggtgctcgtaagtgagcgcgctgatgtagtccggcgtaagaagctcccgccaggatttgttcgactctctcgccgcgaggacgacggacaggaagtccttgcgctgctgcgcatgcggcgctgcctggtcgcgctccattgccgccgctctctcggcaacgattttgtccatctgtcccccgagcgcgaggttcacatggtcgatctcgtggtccgccgtccagggaatcctcttgagcacctgccggaacggctcttggaggaatggcaggagttggccgatgatgatggacagtgagccggacaggtccatcttgagagacgtggtcgcgtgcacgtgcatcctgatgaactccgatgatgccttggcctccgcgctggtatcagtggcgatcttgtcgatgtcgtcgtcattcgaagatgctgatatttttgacaggccaaagtccgttccgaacgccgcctggccgatgacatcggtggcgaagccgagagcgagatcggagaatgttatgtcctcttggccatcaaggttcttggacacgcactcaatgcacgactgcatggtggggatcaggctagccaggtgagacggctggtagatggagatgatcatgtttcgcaacgccgtccacctcgaacccctgcatgtgcagcactacagccatttttctacgtttgcaacggaaaaaagaaagtacaccaaatattaaataactttaaaatgacaatttttttcataacctagtgtaatatatgttttctttccgtgtagaagaactatatatatgctttttccacatatttataaattattttattacagtaataaaggaatatttgttcacatgtgtggcttagaaatcaacacattaattgaaacaaaaatatacaccgttgattatagtagatctagaaaaagttttgatacatgtttaaatataatgatgtagatttatcaaatatatgctctatctttataattagatttaatccaaatcatgatcccataccggctaacaaaacaaattgttttctttctaccaacacacatgggataaagctaggtctgggaacacgaacacaaaataaacgaaagattatttcagcaattatttaattagaaaatggaatcaaaatcctcacttttaggtttgggccgaatatgaaaaagtccagattctttcccttttgtctcttttttggttctagcctgtttccctgtttcctttctccgttaaagtccagtttgcgttctcctagatcgcctaggaaaataagtctaattaatttaacttcctgtcgctacattagcttcttcaagctccagccgagccaccccaatcccgcatccgattcaactaaacccgtggagataatcttaaattagttgaaggcttttgatctatatctcatactctatcttttccctcaagaaattgaaggaaatcccatggaaaatcgctcccgtatcaagctcgaacttgagtttatcgaaccctagtttttatctttctggtgaactcgagtccgattcaaccaaattagcacattgacgggcaaaaatgcagacaaaaaagagatgatgaacggaaagttaacaatttgtaattagttaaaatatttatgaactgtaaaaaacggtcagcaaattttcatattgatgaatttaaatatttagtgccaactccaatgtggcactgacagaaattagaaaagtaaattttagaatcgataaatttattattattattattattattattattattattattattattattattattattattattattattattattattattattattattattattattattatatgttagctttgcaaaaaatgtatcagtatggatgggaaatttccataccattttcacccgtagctcgctctgtcccaaaatatagcaaccaggattggatgtgactcatgctactgatacaaatctggacagaggtaatataccgtgtcccatccaatcttggcttggtatattttgggacgagtgacttataatatgaaaaaagagagtatcagatagcaaatgtgagttcaaatactaggaatgataccaagttataaaccatatatgccaggctgtggagattgttcgatctggttaacgaaactagaggattttcctgtgcaatttgcacggagctagatttaaaaattgagttgaatttgtatacaactttgattctgtttctatacgggtcgatttatgctaccatatttaacattgtactttgtatacaattatatcaataaatctccaccgatgtattctagaccaacacaatttaacggttaacatatttctccttttgtccgattaaatgtggtaatttttaggcctccagagtaaacgcggtgaaactcattttagagctatcttaataataatatgctccccctgtctcaacatataactattttgagttccgaatctacataagtgcatgtcgagatctatagttaaaagttaatatattttaggacggatgtagtaatatatnnnnnnnnnnnnnnnnnnnnnnnnnnnnnnnnnnnnnnnnngatntgcaatcaagccg

SEQ ID NO: 10312 - DNA, 738 bp, Oryza sativa
  unsure (1)..(738): unsure at all n locations
ccgctgattgacgatcnnnnnnnnnnnnnnnnnnnnnnnnnnnnnnnnnnnnnnnnnaatctgtagcccgcctttcatctcctcttatttcttctccacataagcacaaatatgatgttgcaacatgtagagcccgcttacatcatcttattatctttgctctaatgggacaagatgtttatttactattttggtttcgtagtatttattactgagaataacatgtacttctaatcttctatgttgtcttaaaagttctcttgtttttcccacataccaagttggaacttggaagccaagaagacagtagacgcgaagttgttcaaagctgatggtaattgtaactagtctggtttatgctcatatgaatggagttgaagaatggataacatcgagctgatgtttctctctggcccatgtttctacaccgtgctgtgcaaagttacatccccttggttgtggttaatattctcgagtcgcgtagtactctgaaatctacacccttgtctattatcatctaggttatgttcatgtagcataagagttgagttgagtcgtcagcaaagaaattttgttctttctgtttcatacttatttttttttggggggggggggagggggattcggtttgcccccttttatggttcggtcaccctgaaagggataaccgtgaaacttttttacgtggtccattgggtagtcctgcttccagaatagcttgcaggaccataaactact

SEQ ID NO: 10313 - DNA, 1331 bp, Oryza sativa
  unsure (1)..(1331): unsure at all n locations
ccgctgatgatcnnnnnnnnnnnnnnnnnnnnnnnnnnnnnnnnnnnnnnnnnnnnnnntgcagccggggggggggggggagggggaaggagtacagtggcagcatttgacggaatttataaaaattataaagacgaattctataggacaataaactataaaaactaagatctgattttcaaaaggtctcaatgaggatgaaaatggagtcatggtaggccaaataaaacgtggcacagaagtaagggggtggagacttatctgatttttaaaatcctaaaacaacaagatgactgttttaattttttaaaagaaaaccatgtgtaaaaaaattatataattctgtaggaaagctagccgcaaaattatgcgggccatccagatagtcttattaaaatatatgtagttttgcaataaaacaataaagaagtaaaaacttagtacacatgaagtaaaagaaatatactcctcctagttaaaaatatttcacgttggcagaacttcatttttctgatgtcaaataaatttgactagaggaagtatattataagtttttttacaacgtgtttgttaaaaatatgacgctacacttttcacttgatttcaatcacttttttcctcctataattgttttctctcctatttatatgtatgcttccatctcttccatcccctcttccacgtgaaactacttttaatcataattctcttatacattgcgtattagaaaattacatataaatattgaaacttaccatacaagttttaaaatttatataataattacaatgtaattgtaggtaagttatagagtgttttttaaaaaaatgtgaagctattaaatataactacactataatttgtatttatatttttataagaaactgtctataattgcacattacataaactaaactaaaaaaacgaaattcaaagattgtgaagatgtattatagtcttatacaatcaaaatataaagataaaaaacaaaagaacttaaaaagtaaaacaaatcgttttttaacgaaaaaaatcgatataacgggctgcctatgtgctgttagtatatatcgatattttttttatcctgaaaaaaacaaccaggttgatgcgtcatcggtgtaaaaacctaaaaaaaagagccgatccccctccctccacatcgaatcaaatccatctcttttctccccttccttctttccgcctcgcctccccttcccctccttgccgcctcgctcccctccgccgcgccgtcccgtcgaatcccgccatnnnnnnnnnnnnnnnnnnnnnnnnnnnnnnnntaggatgaggatatataatcaccagtg

SEQ ID NO: 10314 - DNA, 18302 bp, Oryza sativa
  unsure (1)..(18302): unsure at all n locations
cggttnatgataaacctattnnnnnnnnnnnnnnnnnnnnnnnnnnnnnnnnnnnataaaagctaatacgattttctaaggattgtgtctgggccattggttccttttgaagagttttggcttgaattagcacgctcgtgctcgagcctgccctcggtggcccgggccggcggaaatcgccaaagggggcccagaaccgagccgtgccccggggcgtggtgaactccgggggggaatcggcaaaggcccacaatcgggtccccataaccattggtcaccgagctcccggcctagccagtctcgacatgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaaggaggcccgaaggcctcggaagaagaaaggaaaaactatttaagattggcgggggcctgggggctcacttcgaggctcccgggtcaccggcctcgtggtcgctgtcgtccacaccaccgtcgccgccctcctcgtcggagtcgagggcgaacgcgagctgaggggccgtaccctcgaagctgtggacgatgtggtcggcggcgtcccggacctgcgcgcgcgcgcgtcgtcctcggttccgggagggaactcgtccagcgctgcccacggggagaagtccgggtccctggcctggtagcttgccagtacaagctccactactccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccggcgcggtctagacgggagacggcgtcccgaagcatgccgggccctacctcgcccgccaagcggagggcctcgacctccccggcggacgagtccagcgcgccctgcagatcggcgatggtgtgttcggcagctacgaggcgggcggctagatcgctgtcgcccgcggccgccccaccgctgcgcgccctcgcgtccagctccttcgcccgcgcctcgagctcagcggcccgctgatccagtgcggccctctcggcgcgggcgccttccagattacggcgcgcctgctcctcccgcgctgcctcgcggagggacaggctgtccgccagccgctgcgccgcggcctcggcctcctcgagagctcgctcccgctcggtgagcgcatcctcgtggaggcggagtgcggactcctcttcggcgcaggcggcctcgtgcgccgccagcgttgcctcccggatagcgacggcggtctcgcggtccgccaggtccctttccctcgcgcgggcgcgctcttccagcgccgtggcgcgagcctaaagggccacttcgcgccgccgggacgccgccttgttctccgtcgcccgccattcccgggcaggggcggcgtcaaggactccccgggcggcgtcgagtttttttttagctccgccacccggctcccgtattgaaggcggagatcgtcccgcgcctcgttgagcacggcggtggcgatgagggcagtctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccgtcgtgttcgcggcggccagggcctgcaggaggggctctgtgttcaatggggcggcggaaggcagaggggagagccgcctcggtgtgggcgctgtgcggctcggcccgccaatcgacgtgccggactcaggggcgtcccccgaggctggctcgtcccgaacatcgcccgaagggtcgggtccgagcggtgcgcccgcggcctcgtcgtgggtggcctcggaagtcgtcgtcgcctcgggcggagtcgggtcgggggcttggcaggccgcctggcgtgcgcacgtcgcctctgcctcccgggctgacttcccggcccggtggagtctggcctcctcccgagcggcctcctcagcctggcaaacccggacggcttcgtgggcagcctcctcagcttcccggagacggtccgcggcttctcgccggatagcttcccgcctccgggcctccgcggtcgctgtctccttggcctcagaccggccggacttggaatggcgaggggggcgcgacggaatctcgctgaaagcggaagaaaaaccagaagacaaaaggaaacgggtaagtgaaaactcgccttgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccctctcgggctgcgacgtcggcacagcaccctccgggcgcctgctgctggcacgcaccgccccgccccctcggggaggagatggagagggggtatcctcctgtttcctcttcccccgggcgtcggcagggcggctgccccccgggcccccgtcacggggcccagaagcatgaccccctcccggggtagattgttcccccctgcggctcccgcccgtgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggaccaccatcttgaagtcctcaggggcccagtcccatctgcccccctggtgggtcctcatgtagtccttagacccggtgtactcccaggcgccccgggcgcgccgctggagtggcgcgatccggcgatgaaggtagtcaccgaacaccatggcccccgtgagcccctgggatcgcagacccgccaggcagtcaagaacggcgtcgtagccatctcccagatctaccggcgcccgccagctggaggcctgcgctgggggctggctcggaagtcggaggcgcgcttcgtcggcgagaggggtgtagaaccagtcgctcttccagtcgtcccacttcttgcgaaggacgcagggaatgtagcagttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccatggcagtcgagatgggacatatcgtgcgcgcgttaactacgctcgccgaccgatgcaccgtcatcacatctccaggcgaaacgaaccagctcgtcccggttcgcgcgctacttaagtaatgtagcggtcttgaaggaagccgctcattattgtcggtcggttttttccttgacgatgtgcgcgatttgcgaccgctgggtttctgccgcctgtggagaccggccccacctgtcaccaggtctaaggagtggcgtcacgcccgagcgcttccctcgggggggcgatcgccctagcgtaacgccgggggctactgtcggtgacatgggaccgggggtatcttgactagaggtttggggcagctgcagtcacccacgtggcctgaccccctcgggggggggtcgggcccaagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccatgtcgcatttaatgcagcgcagcacactcgttcggtccgtgacaggtcacagtgtgtgaccggtcacagaccggtcagatcgtgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatggcaaccattgcaaggaagtcattgtatgaagaagggcagacgtgtagcatgctgaactgacacgtggtggacaagaatgaccggtctgtgactggtctgacgccggtcacgtcatcggcagacaaccgtgctcccgcgatgcatctgcctccgatggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaagagaggagggagggggagtgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcaccaagagtaagtgctcaaaccatcctagccttcaaaaccttctccaatccttaccttcaccctcaaaatcactctcacacacaagaagggctcaagattggggtggagagagcaaaatcacattgcgaaaagctagaaaccactaaggaacagaagagcaaaagtgaaatggcaaaagagtgagttagggtcgagtttgatatatataacggctagatgatgtcatctagctgttactcacatttttgaaccggaatgttgcccggaagttccggtccttggtgccaggaactttcggtcatcatttaggaaattttcttcatttctcctcggcccggaagttccggacatgggggcctaaagcttccagacatgctttgctatcttgaggaggctatttccaaaaatagctcctaaaaatatttcaactgttggatatagctaagggcacttagagtatctcagaaccacacttgaaacccctcttaatagtaaggtttttcctaaactcaaagtgaaaaattaaactagcctaactcggctccaattcttttcaccactttgaatttgatgatttgggggctccaagcatcctagccacctcgtaagcaacctgggactaatacacctgcatttactcagtaaaatcataagtcccttaatcattttgtcattaatcaccaaaacccacataggaggggggttaggtgcacttttagttacaacccaccacattctaaaacttaacatgtaaagatgtcacatcatcattcactggcaattattgtatcttcaagttgtgtttgtttcctaaggttcccaacctccagtatctcgtttccgcacgcacagttatgttttttttaaaaaaaaatacagaaattgcttaaaaaatatattaatctattttttttaagtttgctatgttttccatgcatgggattagtctccactccgcactaaagaatacaggcatactacgttatttataatttgttgtattttagagatttaaaatattagcatgttaaatcatcattacacatcatctacatagcatttcaatatatatatcaattcattatatttctacgatatccagtatattgcatccccacttaattaattgtttatctcttctctcattaagccacgacactttaattgtttctatcccttggatgactactctatgctttaagttatctctcattttcttctctcatgaagtcacaccaccttacttttgcttttggtcaattattaatatatactagaaaatcggcacgccttgctagtataatccatgctaagatccttttcaaaaaaaatattgaagatattttgctagccttaatccaatttctgtaaaatcctttaatttgtttcaatcagtgtcaaacgaacgatgattgtataaagaaaatactccctccatctcattttgatcatctcctaagcaaatggtaccaaaaccaataacatcaacgcattcatcattctaaaattaatccgcatcgatgaatgtgctatatcccctcgtgtccaacataaattaattcacgctttaaatgttgcatgggttgaaccaatagaaattaatattggttgaccgaatgtgtatagttgcatgcatgcatgcagggcattccacgatgtgcatttactctttgtacaaataaataaagagacactttgttagatgatcatcattttgagaaaacctcaaaaacttaggcgatgatcaaactgggagagagggagtatgtttgactagctctgttacttgttcttacaaaaaaaaaactcgagttatgatttactaactcaattcaacctaatttttcaataaattcaattgaacccaagttgtgtgtcctcttaaactccacaactccttagatttgccattgcgcaacaatagctcgctgtccagcacaaggttagcgttgctgtgctctcagctatcaaccattggcattttgtctcattggtatatggaagtagcgagggcgtcaacgtgagcttgacaggggtttaccatcaccatcaaggcgacgatggtgtcgtagccgaaaggcaagtgagactttttttccacaatgtttgatttcttatagagtttttcttaacaatggatttatatttgatcgagaggttcaaggaatgcaaatttatttgattgctaatgagaagataattgttttgtttttcagcacaccaatgatccctagatttatcttaatgtctatgtgtgttgtgagcagggaagatactaaaagttgaaaccctgtttatctcgatttttaacttcacacacatcaggatctatctagatccttcacttcaagggtatctgtatccttttgtcgacggggatacccataaaccggataaatagagtattagggtatgttggtacgaggatctacacgatacaacatcaagcaaacgaaaagacaaggattatactggttcgggccctcgtaaggtaatagccctaatccagtttatatatatgagatagatatgaaaaaaccacatattacaatagaagaccaataatcctgggattatcggcgagacccttgtcgttggcgagacccttgtcgttggcgagacccttgtcgagatggtttcaacgagatctcatggcgagtaggcttcacgtcctccggattgtaggctatggtggtggtgctggcgctatgattcggtcatctaaacccctcagggggtatgccttttacaccgtgaatcaccttagtcttcaagtagaactcggagactacggaccccgcatgatatagtataaacccgattctctccaagtaggactctgctattcacttgctgtcacaccccaatctggcaccgccggacaacggcacctgataggagcgtgtcataggaaaaacggcgcgaactgcttcctacgaaactgcgatcacagtaccagtcccaggacttagcactggtacccacggtgacaaatatgaatcattgcaatccttaaatttaatagagaacttatttaccttaacttaggttgcagctcaggacagcctgagaatacaaccgacgacgcggacgaggaaacatcaacagcagcagcagcagcggaaccaatgaactaacacctaacaccacaggcgacggctgggaaccaggacgaaaccttaatcttcacttcacttcatcttgacttcaaggcagaggaactatatttatatagagcaagggtgagtactttcgcactcagcaagtcacgggaatttaggtgtctgatgcaagcttggaagagaggcaaggttgttttgcaaatcttttgttttggaaatcattttgaaatcactaagtgatttatttctttctaagtttgggccaaaaagagatttgtgtctcgattcgactttaagagatgtttttcaacagctcatttggtaatgtaccgacctcccggttcagatcattacttctcggctcccagagccatttcacttgattaatcggctcccaaagccttttcattttctcggactcccagagtccagctgcccagcagcacaacaatccgcttccactcaggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggcacggctgttcgaacagttagttaacctctgcagaggaggtacactttacccacacgacattactaacctggatcacccagccggagaccctaaggccgagataacgggccggccagcctaaggagacacggcccattagggcgcgcgggaggcgaggagagagggaaccgatggaccgggctcacctcgcgtggtcccgagtgggacccgcttgttagcggctcggctcaccgtgagcggggcgcacgcggagcgcgctagggtttgggagggggagtcgcagcgcacgtgcggtttgcggtggacgcggatgcggcgggcccacgagcagcctcatggctcgcggtggaccgcgcgcgcgcgagcgggggtgcaggggagcgttggaccagggtcagccttgaaccggtcgcagccgagatggcgccgacgtggcgccttcgtggcagccacgcgggccagcgggaggaggaagaaggggaaggccgagatggacggcggacggcggccgagttcaccggagctcgacaagacgactatggtcaagggggagcacaccggattggcgagcggcacaagagaggacgagccaatggctcggatcgcgccgggagaggtcaagggcggtggattgcgacggcggcggctggcggcgtgcaaaaggggaaaaactggcggggcggcgagggttcgattcaaggcgtcgggagcatctccgttgttcggggaactcattctcggggtcggatgggacggaggggcctcgagggaggccgacgagcggcggctccccggaacgggtggcaatggtggcgaggccatgccgggcggcggcggggcttcgtctacgcgcgttcaggagggctaccgagctaccacgcgagctaaaagagggagagggcaagcgagaagggagaacggagggaggcactaccgagccgagacgggcgctgtgacgagcggccgacggcgcggggcatgatcgctacggcctcgggccggggaagaggaagatgagggtgcccggagtccgcgttagctcctcgcgcgcacgccggcttcaccagcacacacggcggcggagggaggcaaggacagcggcagcaaggcggcgagggtggcaagaacagagagagagagcaggcgagcggcttggctgtggttttataggcgtggggtgtggagcttcgaggggaaggaaccgagcacgggcagtcaaggggagctcggttgggtcaaggtgggggcgacagtggaggtgacaatggcgctggtcagggaaaaagaagaaaaggggagagaaagggagctctgcccatgccattttgggagaaaggaggagggagagagcgcgagctctggctccgcgttttggaagcatgcggcatgggggcgtcgggactgggcgatgacagcggcgatgactgcaaaaaagcgagcggggttcggcggctgcacggcgtaggcgtggcagggctgacgcggcggcgactgggcggcagcgcgggcacgggcggcgaccgggcgacggttgccaccagggcgcgcgcgcgcgggggaaacggcggccgaccgaaaattgaatggcggagagcgggggatttgacgccggtggaggagctcgncgagagagagagagagaaccagagagggagagagagaaagaacgagagggcgagagctctctctctctcggctcggctcagctcggcgcgtgcaatgcacgtgcgaggctgagggaggagatgggccaagggaggaagaatcggcccaacgaccaagagggagtcaaaatagacttctgcttagaatttgaattggagagaattgcagcttggatttgaatctaaatttgatacttgtgcacaagggttcaaggagatgaggaaggaaacaaagcgggagtttgatacttttgggaacaattatttggagaggattcaaaggaggggattgactttaggaatttgatttcggagactcgaatcggaattggaaacttgaggtgggggattttgatgaggcgatttttgaattcgacgagagggatcaaggagatttatatcgagatccacggcacgacttagactcagcactcaaagaatgaaattttcgcatataggattttgccgaaatagtttttaacgcctcacgaaatgcggagcgttacacttgcccgcgagggtaatttccataatctcttgataattaccttatcgtatacggaaacatatcatacatacgaaaacatgccgtatccacatattccataagtcataggatatgagatatgccttatccgtaaccatgacagtagccccccgacttcaactcaaatgagtactcgttgtcatccgagacttcacagtcaacgttgtcatgctcactaggtcgttctcgatgaaaatcgagaaggacatggagtatgcggcatcattgaaagaaaatttattctaacccacagcacactgcatatctctagatacttctcttgatttattttggtttacagagcctagcaattttttacacttattaatttccaattatttctcaaacattgttgtgccacgtggaccaatcaacaataggcaaaactgccggcttgagaaggattgattgatattgtttaagttatcataaacaacatcaatttaatggtttatagctttttttcaatgatcgatcaaatatgatgattatataaacttatattatttagttatcttatacgctatttctactattatcataccaagctcccgtaatattgtgcgggatttcatgtagtttcgttaagaatgtgcccttgtcaagtaacatggcattgctagtattttgtgcatatcttgtgccgttcttgtaagggacacaaatgcaatatgttggaggaaataatcaagacttgaatcctgacaagttcttttagggggagaatcttgacaagttggaccatttgaattcatgcttctatgattttctaaacaactattgcccactccaatcaggagggcaaataatatattggtagggtagatctccatattcgatctgctgatttaaataaacttgagtcaatttccggcaaatataaagcccgtaagccagctatgttcttagggttctgtttttttacaaaagttcaggtatgatagctggccacgtccaactataaacagggattatctatagagctcaaaataaaatcccatccaatcacttttattctctctcaattttattattggttgctacacagagctggtttcttcgtaagaaatgatttcttcatcttttttttcatctcttctcattaactattttatcgcctctttttacttatgtgactgttttttttttaaatacgcgagagacgcatctttatattaagaaggaataaaagtatttacagagcgggccgaaaaatcaaaaacacgaaggggacaagatacaggagggggaggaggaagaaaataaaagtctaatctcccaacgaatgtgacgaacttccatccgacataggtgactgtatatttaacggtatgtaagctaggtgtgagaaagagggtttggactgctctaatgcctttgctctaatcctgagcactagctgttttgcatgctgcgcgcgcatgtggacggatccattatctgctgtctggtaattaagcagtactggtgacttaggagtagatgccaggttatccaacacgtgagctcgtgctcctcactacggacatactgatcagaaggttgaccttggcgtctataaattgcgggattatgtgaacagagtagacacgaagcagatcaaccaatcatcagaatgaggggacggtcccgagtttttctcctcgccttggtgctcttcctcgcgctgcaggcgccggcgtccgcaggcacaaaggcaatgctctttcttcacttctctctcttaccctctcgatctattcatcatacatgccctcaatattttttaaaaatatatccgccaaagtcattttgttctttaattgcatgtcctctcgtttctcttgtatgtcattcgaatatttatgaaaaatatttttttaaaaaaatgtatttaatggattttttaatcatacatggagattatatttttaaggggatgctcttttacttcttgccactcaaatagttttacaaaaaaaaatggcaacatatataacatattcatatgtgatttaaatttgatcaattataaatcaacaactaaattcaatgagaaaatcaaactaaactgtaacgtgtactacttaccgtcgtatttatttatttatttctaatttagagttacaaagagtgatatatcacatattaatttgtgttgttaaatttatttaatttttataactatttcgatgatatatgacagaaaacagggtatatattccttaaaactgcaaaaatgtttttccatcgtatattcgtcacgtacaatacaagcaagtcaacaaatataggactgcgattaaatgttctattgacgatctctaatccatgaagcggggtactttcgtgcatgcagacttatgtgatcgtctttgatggcttaccagcttctccttctggtttgcttgctacagtcgtcaccaggtcagaaaatactagtgtggccgttatggatgtcggtgctaccgtactaggctactagctatgtactcctacatcactaatgtgttcattttgtgccgtaaaaataaacagctttcagttactgtacgtcttgagccccatccaagtgatcgtggtgcagatcgatgagagtttcgtaggagtcatcaagcgtacgccacatatatcatcatgttatagtgtgttccccccttggagtttgcagttcatacctgtcactgacgagcgcgttctttttttcgcgtactttggactcagagctgcccggcgtgctggccgtgatccccgacgtcctgcacaaggtccacacgacgcgttcctgggatttcctcgagctagagcgaaatggcgcggcgaccggtgcgtggaaggacgccgcgaagtacggggtggacgctatcatcggcaacgtcgacacaggtaccactacttgaaaaatgatattcgagacgatcaaaatggatttcacgagcgactggtacaaccgctagcaaccaaaaactaatgaaaatcgaattttttaaattaatttttcaatggatttttttttaaaaaaaacgcactaagagcacccacaatagtaaagtaaggtgctctctataaaaatgtacatctcagcaatagactagattgatagtaaaccacctcaatagtatgtctacatgggtatctgtagctctctcatccattgcctcgtttttctctataaactatctccagtttagtagatagatttactctctctctcttcatttaatctgttccaagtagaaaaatatgctgacatggatctcttgtagagagtctatagataaccattgcgggtgccctagaatatgaggaagtgaaattgagaaacacagccccaaataatgaacacagaacgatcggagcgaatcagttattccgtgcatcggtacatgcttcccgatgagatacatgcgcgagataacttaaaataatcaccccaagatgacatgaggttaacagaatcaaatcccaagaatacgggaactaaaaagtcaattcaaacctcgcaaaatggtagcgtcgccatgggcgcagtgcgcctgtgcctctgttggattacgggatccctggtggcctggttcagatgtgctgtcgtcctatctgctgtactgaagtgctgtgcagttagccatagccggaacctgttctgattcctgaactcctgattcttattttctgtgcgtgcacgtactccctacaaatgaaggtgtatggccggaatccgcgagcttcaaagacgacggctattcagtcccgtcgaggtggcgcggcaagtgcatcactggcaacgacacgaccttcaaatgcaacaagtaactccactgtccacagctgctcatcaagctgcatgcaactaatgcagtaaattttctggcgagaaactaacatgtcgtacatgcagcaagctgatcggcgcggggttcttcaacctcggcttcctagcgtcgggcttgctgcaggggaagccgccaagccaggctgcagagctgtacacgccacgggactacatcgggcacggcacgcacacgctgtccaccgccggcggcgggttcgtgccggacgccagcgtgttcggccatgggaagggcacggccaagggcggctcgccgctggcgcgggtcgccgcctacaaggcgtgctacgccgagggctgctccagctcggacatcctcgcggccatggtcacggcggtggaagacggcgtgaacgtgctctcgctctccgtcggcgggccggcggacgactacctgtcggacccgatcgccatcggcgcgttctacgccgtccagaagggcgtcatcgtcgtctgctccgccagcaactccggcccgcagccgggctcggtcaccaacgtggcaccatggatacttacggtcggcgcgagcaccatggacagggacttcccggcttatgtcaccttcggcggcgtcacgagcagcatgaccatcaaggtttgacaatacgaccgaccaaatcacactgtagtttgcgcacatgagaatacggcgtacttttgctcatgccattgggatttgggcaatttgcaggggcaaagtctgtcaaacagcactctgcctcaagggcaacggtacgcgatgatcaacgcgaagaacgccaacgccgcaaacgtaccgagcgagaactcgtaagaaatcaaaaactcagatatcatctcgacttgcaccgatcgaatcgaaccgacgtcgatttgcttgcactgctgcgtgcgtgcaggacgttgtgcttccctggctccctggacagcgacaaggtgcgcggcaagatagttgtctgcaccagaggggtgaacgccagagttgagaaggggctggtggtgaagcaggccggcggcgttggcatggtgctctgcaactacgccggcaacggggaggatgtcatcgcggacccgcacctcatcgcggcggctcacgtctcctactcccagtgcatcaacctctttaactacctcgggtcaacagagtaagcatcgctcatcagcacatagtactacttttcaggtgcaacacatcacagcatggttatatactatactaattaacgttactgctctggttcatgtagcaacccggtcggttacatcactgcatcggatgccaggcttggcgtaaagccagcgcctgtgatggcagccttctcttcccgtgggccaaacccgataactccccagattctcaaggttggcacattgctcatcgtattcctacagatactcgagagagaaagcttgccccttccaaataggaccagcagctgtgtgtgtatgctaacctggtggtgattttgcagcctgacatcaccgcgccaggagtcagcgtcatcgcggcttacagcgaggcggtttcgccgacggaactctctttcgacgaccgccgtgtcccctacaacataatgtccggcacctccatgtcgtgccctcacgtgtcgggcatcgtcggcctgatcaagaccaagtaccccgactggacccccgcgatgatcaagtcggcgatcatgaccacaggtgagcgagaaatgcagatcgcgatcaatcgagccagcgcaaacatcacataaactctgatcgatctcacgtccttaatatgcctgtgcattgcagcgatcaccggggacaacgacagcggcaagatccgggacgagaccggcgcggccgcgacgccgttcgcctacgggtcggggcacgtgaggtccgtgcaggcgctggacccgggcctcgtgtacgacaccacgtcggccgactacgccgacttcctctgcgccctgaggcccacccagaaccctctcccgctcccggtgttcggcgacgacggcaagccgcgcgcgtgcagccagggcgcgcagtacggccgccccgaggacctcaactacccgtccatcgccgtgccgtgcctgtccggctccgcgacggtgcggcgccgggtgaagaacgtcggcgcggcgccgtgccggtacgcggtcagcgtcaccgaggcgctggcgggggtgaaggtcacggtgtatccgcccgagctcagcttcgagtcctacggggaggagagggagttcacggtgaggctgaaggtgcaagacgccgcggcggccgccaactacgtgttcggaagcatcgagtggtcggaggagtcggagtcggacccggaccggaagcatcgcgtgcggagccccatcgttgccaagacgacctgcgggtagcacggacggggtcgattcttttcgagtcagaactggaaactgaataactgttggtgttgtcacgccaaggtccacaagtcgttagggctaactgcctaaatcctaatggcaggagacttggttagagaggagaggatcgatttcgttttatctggcagatagatgtgagctatcgaatccagatatttgttctgattccgacggtcaagttgtttttgtgctactcgaatagtgtaatgcatcaatcttcatcttgttacgataattatatacttctcgtcgggccggcgaagcgccggccgaaatatataattacgataattatatacttgttcgttcttttctgccagagatgtgtcgctacatttctccatggaaatcagtcaaactttgaactgtataatttatactgtgttttatgctgtagtgttgcttggtttctcttttttgcctcttcacggaggagtgtaatttattttcctaccataaactgtgnnnnnnnnnnnnnnnnnnnnnnnnnnnnnnnnnnnnnnaggattcgtaataacgc

SEQ ID NO: 10315 - DNA, 740 bp, Oryza sativa
  unsure (1)..(740): unsure at all n locations
nnaaggttgnattgtagaacctatggnnnnnnnnnnnnnnnnnnnnnnnnnnnnnnnnnnnaagcgaacatggagatcagcgaagccatgctcacagctcccacaaactgctgccgaagcggttgatcaaagaaaaagacgctcgcatgtgaaactagcgcaaacccgcaaactaccagcaccaagagccctatgatcttcatctgtggaggaattggaaaacattatccatcatcttttcctttcttgatggcatattggcatcagacaaaattgaaaatgtacagtactaggctactacattagcaatctattactgcagtctacaagtacatttttctgagacaaaattggttgcaggatgggaagaattaccctcgtcttcctgctgtccgcgtagaagatgaagaggcaaatgtaggcgagctggaacaccgctccaatgccgttgacggtagcgacgagcagcctgccatcggcgacccagggaagtccataccacaggcagatgaggcaattcagcagcgagaacaggtaagggagcccgtcgaatcgctcggtcgatttggccttcaggatcctcttaaacgtcgtcctgaaacaaggaaaattcagttatgaacttcggctacgaatcaaaggatcaagaaaaaaccaaaccgaacgtgtgcttacactggcgacaggaagagagcaagcgcaaagatgttgcctgcagcgacaaaacaaaaggaggcggg

SEQ ID NO: 10316 - DNA, 12240 bp, Oryza sativa
  unsure (1)..(12240): unsure at all n locations
cgcgctgngnattgtaanaccnattgnataacnnnnnnnnnnnnnnnnnnnnnnnnnnnnnnnnnnnnnnnnntcctccctctgggcttcaattaacaggacattttagtgtcgcggtgcgatcggatcgagatcatctcggggggatccaccagaatttcgggttcccaacaccgattgaattgcagttttgtttcgggacataataatcgttaaatggagcatccgcgaggtgagtggaatacgccttcccaattttcaggggtcaatcgaacactctgcagagctgaaaagatggctcagccgaaaaaggaaaattaaaggtccggcagtgtagacacaaagactcacacctgctgccgttcgagctttgagaaaaagaactgaattggggccaaaaaaagcatctgctgggctttgcgagatagctaaacaaagttaattaccatgtggacctactaaccaaatttcattagcaagcagctgttctgtcgcttccgtttcaacaaggaattattggcagaagaaacgatcgatacgatgcctttcaccctgggttatgcgtatccttatctgaatatttgtttacgtttcggcatctaccagacgtgtcctcgacgcagcatccagcaatcctaacacctcgcagacattcgccgcggttcgttgggcaaagcagcggtctccggctgttaaggaataaagcgctcgttagaactgtgctgaagtgaactgaactgaaaggatacacatgtctctgcatgaaagaaaaggctgtacttttccagctagccgtcatcttaacctccagacgaacagaatctctgaaaactctagatggtctgaaaccaaacccccggaccccagccgggtacgtatgttttcttctttctttcatgccttaagcatcacgtttgtcacaaaaacttaacgtaattcggctgtccatatgcatcccatggaagcaaggaacaaaaccagctatgtcccgtcagtaaaatagttcatattatttcgcgttctctatcgatcgcgtgtatatatataaggcccggatgctaacgccgaatcggtgcgcctcctgaatcaagtagaaatagtactactacgcaagtaacgtagatcagcacgtagatagcttgcgaagacgttctgaaagagtgcagagagtttttgctagctctcggtggtgatatccatggctaacgcggggctgaagccggtggccggccttctcctggttctcaacttctgcatgtacgtcatcgtggcggcggtcggcggctgggccatcaaccacgccatccacaccggctacttcatcggtaaaactagctcacattttgatttaccgtgtcgatctcgatggtgtcttgttatcgggcacaacgaaccaaaacttgctctaaattgagattggtgcctaattatgtttgtcaatagaaagtgcatatattttgaagctagatttgtgactgtttgagcgtatgtactgcatgtacgtgtaggttccgggatggcgctgccggcgaacttctccccgatctacttcccgatggggaacgcggcgaccgggttcttcgtcatcttcgcggtgatcgccggagtcgtcggcgccgcggcggcgctcgctgggttccaccacgtccgcgcgtggagccacgagagcttgccggcggcggcctcctccgggttcatcgcatggacgctcaccctgctcgccatggggtaaattaacgcaactaaatctgaccctgtcccatgcatgcatacgggtatactaaatcaatttccttgattcatttgttacgttttcagattggccgtcaaggagattgacctgcacggcaggaacgccagattggtaagatcgaacaacatcaaacacagtttttttttttagttcgtcgtgacaaccgaagacacgctattaactgtgtgcatgctgctctggtcttgatttttgcagaaaaccatggagtccttcaccatcatactctcggcaacacagctgttttatctgctcgccattcacggcgggaggtagaagaaggtcaggtttttctgattaaagttgtgaaggtgaagacacctttgtgagcattattgggcatagatcatggactttacgagcctaatttgatttcaccggtttgtgagattaagttcgacatggatcaaccagatcgaggcgctgtttgtgcttgtctacgaatacgtgtgtgtgtgtgtgtgtgtgttttatgcagtgtgtgactagcacttcttagtaattcgtgtgccgaatactcgaactcctgtgtgatttgttgattatttggatgcgttgatttatactgtattgatttcgccgtgtctggttaatcgatttgattatgtggacgtgatggtttacctgtttgaaattcagtccgaatggctatctccgcacgacaatcgtttatcccgtgaataataggggactgctatatgacgggataccgtttggacggtatacccctgtaattcatcccgtggaaagacgtgcgtgctgcttcgtacgatggtgagcacaccacgttcatgtactcctcccaaggtatattttacttgcctagtgatctgtattatttttgtattatttttttggattattattgtattatttttttattgggccatgctctgttacgtatttatgggcactattggttgggttttttatatatgcatgtaccaatgatgatacttataggtaccgagaatggtatctgtgagatatcaatatattgatgataggtatccaaatgatacctgtcatgtatcgtgatgatacctaggaggtatcaatgagtgataacacttataggtgccgagtatgatacttgtgaggtatctgtatgttgacgataggaaccaaatgataccttccatatatcgtgatgatacctatgaggtatcagagagtgatgatacttataggtaccaagaacattacacatgaggtatcatagatatccaaatgatacctaccatgtatcatgatgatacctacgaggtatcaatgagtgatgatacttataggtgtcgaggatgatacatgtgaggtatctgtatattgacgataggaacccaaatgatacatggtatgtatcgtgatgatacctaagatgtatcagtgagtaatgatacttgtaaataccagggatgatacctttcagatagcaatgtatcgaagatttgtttttatgtacccaaatggtacctgacaggtatcgtgatgatacctatgaggtatcaatgattgatgatgattgtaggtatcagtgattaaaaatacttggaagtaaaatttcaaagttacactaaacgaaacaattgagatattaagcaaatttaactaaaaaggattaaaagaaaaaatgacgaaaaaatgcataggtggggccaacattgagtaggcagtgccatctgacagtcgtggacctcgtggtaaagcgaataaaagtcatgcatgcgcgtgtgcgtcgtacttgttgagagggatggtgcgaggaggatgatcccgttccgatcgctaccaacggaataccggtacctagcatttccgataatgtattcctaaacttttaaaattaaacacaaatgagatcctaaaacagtttggatgatggttttaactaacgtgacatccacatggttggtttaacttgatcctcgtctcgcgttatgtatcgtggtcatggccattagccgatggcaatgttgtcttcttgccttgctttcttctgcttggttagttggtcttaaacaatttaacatcattgctttgtgagatcaaagcttaagtcaaaccaatcatgtagacgttacatcagtagaaatcattatccaaaatgtcttgggaccttgtataaactgattttaaaagttaagagatcagttatatctggcattacggtttaaggtttaaggatgtgatttaaactcaactcaacctaaaataaatgtattcctttatccagcccaagacttaaaagtagtatccacatatatatatgggccctattaggggtaagtctaaatgggcttggctcaactacataagcgagttcaaccaaaagaatttttaggacgaccttatgccctgtgaacaaacaagtatactactctctatctatttttaaattataaacagctacaaatcctgtaatttggattaatattcgttcttctctggattgaactgcttccatcatgtttattattcatgttactaagatatcaaaaacatgtgatggatctaaatcatacacattattttagataaagatctaatctaattgtacggttagtacttaccaaattcatatagatgcggtcaagttacatgttcgttttattataatgtttgactccatataataaaaatgtatttcaggttctacgaattcttttttaccttatcactgttattgatagttcaagctttcaatgtctatatataacatgcaatttaactacaccctccgttttcctcatttttaaatatatggtgaggttgatttttttatacgtccatgctaaaatattatttgcttaaattatatttattgccaaaagaaatcataaataaaaaaatatttatttatatagtttttctaataagacaaataaccgaacgttgtgttcaaaagttaagcaacacatatattcttaagcatcacaaaaatagaggtagtattatttctacaacttcatatatgtccataataattttataatagtattagacattttttttaaaaaatattgtaataacatgtgtgtacacgatatgatatcaaataatggttcaggcccctcgcatgataatagcactaatccagtttatatttgattgatatgaaaaacctcagattaaatagagaacaatcaatcccgagattaccggcgagacccttgtcaagatggtttcgacgagatcttcttgcgagtaggcttcacgtcctccaaattgtaggctatgttggcggtgttgacgctatgatttgataccttggacccctcagggggtgtgtatttatactgtttattaccttaatctccaagaagaaatcggaaacaccaaatccagcacgatatagtacaatcccgattctctccgagtagtactctattattcgcttccccgtgagaattatttccataatctctgtcgattttcttatcatatatagagacgtgtcatacatatgaaggtatgccttattcataatcatgacaacatcttttatatagccaatccgcatgtatatattcttaaacgagatacattcagagaatactaaagtgttagtcaaacaataaaaagaaaaacgaatatgctactagcaccctttcagtcggcaatactccatttgtagagagaagaccaatgcacattaattaattatttaatttgtgaaactggtagtatcgtgccacgttctgagcaattaaggatcccataacgccagacattaagtcggccaacccttctcatgcaatgaaggttttgaagcatggagtagttatcatacttgtcatatcatatagatgttatatataaaaattatatatctaacagatgatgtttttaaattaaattctcatctattcatgaatcatcttttttctctctcttttttatccacatatccccttgtttcattctcgattattgtgtagagatggtttatggcatgagaaatgatttatccatctttttacttcttttctcgttagctttcttgtcgtatcaggtttttactcgtgtgacaatgtatttaatgctatgaacactatatacgagttggaaatgacctaaacctatctcacatctcaactctcagcctttaccaactttttcttagaaaaagtgttcctagtacgtaattttaaacacaacccaaccaataaacagacacttaagtccgtgtggagacattggggatgtttactttgaggcctaaatcaaccttattaaattttaaatttgctacaggacatctaaaatttgtgtaatttgccgatagacatcgtgaaaacgtgttatggctgaaagacagtaaaaaaaaaggtaatttgctggaggacacttccggctcaatcggagagaaatttttttcaaaaagacaagaatgaccctagggtcaaaagctttttgagccgagactaaagtgaaaataaaataatggtgtatgctagtgatgtactttgggctatggcaaatttagagttacataatttccaaatttttactctaacaccatgtttgaagcatgtggctagaggggcattctcgtcttttttaggaatccatctcttcaattgagccgaaagtgtcctctagcaaattaccagttttttagaatgtctttcagccatgacacgttttttcgatgtatatcagcaaattacacaaattttgggtgtcctatagcaaaatttaccattttagaaattctaaattttgacattattaatattttttgacacgacattattaatatttgattgaattgagatgtgtagattgtatttggtttgttacctttactaagtttttctttttttaaaatagattctatagttgccaaattttgatagtgtagatggtcaaaaatttggtaggttcattttggcaacagagtgaaaaaccctattttttgctactagtaatactggagaagtaatttaggcccgatttataggaaagcccataggtaatttagggcgtgttgagagaaaaggaaataaaaatattgagaagatatataaaacaagatgagacattaatatattattaattaatttttaattattaaactttaaaatggattaatatgatttttaaagtaacttttctaagatttttttgaaaaaaaaacaccgcatagcaatttgagaaggggacacgtaaaaaatgacacaaatcttctccttttcataaaaggcgaacgttgccttagagaacaattcgatagtattacaaaaatttctatgaaagcacttgaaataacttgatgggtatcttgatctttcaacatgaaaactggaggagagtcatgcaacgctgttaccatctcacttttggagaaatcatcttttgtgggttggaccaataatagtcccggtccaacaaaaaaacagggactaaaaaccatttgtagtcccggtttaaaagtgcaacgagattatatgatctttagtcctggttatatttatgtcagacgttgtcaggacgcctgggatctttagtcctggttgatatcaccaatcgggactaaatatctctctcacatcctacctcgggatgctttcccacgtccttatctctctcgagaccgagagacccacgtctttatctctcgatctctatatgttcgctagttctccctcgatcctctttctcttcactcactcactctctctctctctctagcaaaggctggccaagagaagtggtagctgggcggggtcggtggtggctgggcgggagaagcggcggcggctgagcgggagaagaagcatcggccgggcaggggaggtggcggcctcgccctccccttcgccagatccggcaggagggaggcggcggcggccgggcgggggcggcggcagtgaagtgacagcgactcgaccagaggagaatttgttttttttaggatttgtggtgaatttgtttttgagaatttgtgatgctttttttgaatttgcgatgattttttaaaaatttatgatgtatttgatctatgatttggggatgtagtgaaatcaatatgcaagcagttaaaaacaatgaaaaaaagaaaaaaaaactttagttcaggttgctaacaccaaccgagactaaaaatttgtggtcccgattatataactgggactacaggggttacgaaccgtgattgaagatactttctccagtagtgctagtgcctattgccatacgtgatcaacgtgattaattcacgattattcctcaaactaaacatgcaatgatcagaagcaccaatagtttccatcttttgtggatctccctcgatcttccatagcgcaaaattaaaaagagagtccggccgtgaaacgggacactgtttttatgatgttcattccaatgttccaaccttgataaataagacgctggagggagaacgtgtggcacttctagagcagtgcaggtgacgatcagaaggacaccgctaccccgctgactgccgacaatttatctagactcaagctagcgatgccaattgttcttctacacagacaatatgagaggtggttcaaggtgcgtctgcaacctctacttccactttgatttaggaggctacatcaacatccatggcttcgaggaaacggttagtcgtccataatttcatattagcatattcatggttttaagttaaacagttaaaagagtagattagataatctacactacttcctccgtttcacaatataagttattctactattttccacattaagttattctagtattttccacattcatattgatgttaatgaatctagatgcggaggaagtactaatttttttttttgaaattactatagaataaacattcatatagagatttttgaaggaaagttagtaatagcttcaacctcttggaaagtttttttttctatctctctcatctgatttgtgtgtttttcctgttggtgtattcaaataacaacttctacattttccttctattttaatttgcacccatgtatttttcacttacattgaaatcaaaattatgttttattatatttttatatttgtttaatcctacgtttcgaacaaaccttagttcttgccgagctaaaagcaaatcaactatagacgagtaaatgcatcttgtgcaccatcatcaaaatgtttcttaatgatgaaaatgcaacagtggatacatcatcgcttaaaagcagcgacaaatgaaaaggaacagcatcatcacaaattccatgagaacaagtttctcttctcatttctctgctgcctggtacttctcgaagtgtgtgtcaatctatgaaggctatagtatgactacttgtcttgatcatggccgtgatgcttatgctaggctgctttattagttcttgctttagagcaggtaaaatagcatgctattagccagctgtaaacatattttaatgagataaaagatgagagagaaaagcagcgggctacagatctccaagatataatgtgtgtatgataagtgggaccatatattaatagtatagtaagcaactattgtatgaattagctattagattagctatagatgaattggagctagtagtgagctatactattaaacttaaacctgctcttatgataaagtgaccttgacagaaaatatagctaattatttgtcgcgaacaaatggcctaattaacaatggtaatggaatgtttgattttgctaccttccgttgctaggaattcctttatgtcattttcgttattattgtttactgtaggtccgatctgatccattctctgtgatgatacgtgcaacatggaacgtagacggatgagcagaagctgcacgctactacaccatttccctatccttttcaaacttcaaggacatcttgaatcttcttattcttcttccctccctccctcccctctctctctctctctctctctctctctctctctctctctctctctcttctcttctttttgcacaacccattgttaatttgaaattgaatactgtaatactcaatttgttttggaaattaatttgtactaccgtaccgaacgcatactgacgtgcattgcatataccatatggtactaggaacaagtttagtactacctgaatactagagcatatatactaaaatactcgtgtagatcaccagatcttgaatcggtgctgaacagaatcgatatttttaaaagagaactatcaacggaatcttgtactcagatatttttaaaagataacatactgtaaaataatgccagattcaaatactcagatctttttgatcggcaagttggtttttgtccagtttcgctgagactatcaagttgaacatgctcaaacagttgatgacaaaagcatcgagtcatcatgctatgactacttcttggcgcttcaagggttcaaaagtggttttcagaacacattcgacagacaaagcaaattcacttcaaatttgancgaagcaaaggagaaacaatggtggtggcatcaatacttaacggtgctcctctgatctcttcgtttgattggacacccagtcctgccaagatgacaccttcatgctactacgggctgacagctgagtctctggatccagtttaccccatggatgacacacatcactgagaagtgagaagtctcatatgcctgggccacgttgaaacagacgttcgtattatctgagccatccatctgtcggcatgtgtgcaaattggtgttttccgtagcgctctgaattgtgtggctctctttgaaacagccagcatctaaccacaataatacgagtagcacaaggcaccggatcttctgcacgaaagaactgttttgcctcgtcccaagttgaaatgtcatcgtccctgtcattcgagtattaatcgactgtcaatgtaggcgttagcttacgttgcagttggttgcagcgaccattatgttgaaataaacgtgtttatgataaagtaataagggttcagaacacatttaagcaattttctttcacttttttggccctgaacaattcaatagccaatagtagagctctgctgtggttgtgcagccgcagccagcgctgagctgagcagcacctaaatttatataaacagcagataaatccacacctactccattcaaacaaagtactaaagtacaggtagtatagtacaatgttgtgagtacaagaggcgaagtccggtgaggtgccaccgtgccacatgcaggcgtggtaacctggtgtccactctgcatccccgcaaaatggaaaattcaaacacaactcgacgaaatgctatccagaccgtagatgtccctttgtttcaatgcttgctgctttctttctttcttaggggctgtttagttcgcgaaaagtaaatttttaagtatcacattgaatgtttgaccggatattggaagaagtttttggattcgaatgaaaaactaatttcataactcgtctggaaaccgcgagataaatcttttgagcctaattaaaccatcaatagcacacggggttactgtaacacttatagctaatcatggactaattatgctcaaaagattcatctcgcgatttgcaattagtttttatttatatctatatttaatgctccatgcatatgtccaaagttttgatgtgacgtttttgggaaaaaatttcgggaactaaaccaggtcttaggccttgttagttggcaaaagtttttgccctagcgtgtcacatcggatatacgaacacacatttaaagtattaaacgtagtctaataacaaaacaaaatacaaattccgctagaaaactacgagatgaattttaagccaaattaatccatcattagcaaatatttattgtagcaccatattatcaaatcatggcgtaattaggcttaaaagattcatctcgtaatttacacgtaaactgtgtaattagtttttttatctatatttgatactacatgcatatgtccaaacattcgatgtttttcttgtgggaactaaacaaccccttagttcaagggcgatgttacgaactccatcagtcccaaaataaaaaaactcaggatctgtttggctagtgactgtagtttagcacaacaaactttagacgtggcacaatttcttaggttagtatttggttgagtgccacaagttaagttaaaccatactttattagcatattggtccacatgtcatactctcattttctaggcagagtttaccatagttgtgactaacaaactgttggtcacactttgtgtgcttgtcatagttatgacaaatggagttgtggtaaagttagtctccatctaaacatccccttaatctagaagaggatgtgatttgttctagcacaacgaatttggacgatatggttgttacatccccacctaggttttgttttattatggaggaagtatagtattgtgagaagttactctggtgtatatttctttccaatcacgtactactaaccctnggtattgtgatttcgttg

SEQ ID NO: 10317 - DNA, 1672 bp, Oryza sativa
  unsure (1)..(1672): unsure at all n locations
atatcaggtatgtgtggcggatattttcttgtgggttcatgggtccgtgagaccaatttttttttttctaaccactgcacttttcacctggttatgaatgcaggttgtaaaggaatcgatgagatctacattatgtcgccattgctagccaggaaaacacttgaacaagtcgaaattgaaggatatgtcctccaaaaggtcctagatccacngatctatatataagtacatcaaggagatgctcgggtgcttcctactaataatattatactatctgtagaaatgatttcaacggttcgttattaatagtaaattagtaatgatttactaatataatgattggaggtaactttgttatttatgcttgactagattgatctatggtcatcaattgcactggcattgtttatattccatcgataaaagctaaaaaaagaaaaaaaaaggtttaatcactgctaaatgacaattatgccccttctcacctattttttttataataatacccctccatgtttatactgttgttaattgggtggtaatataaatagatataagccattcgatcaaataaaattaatgattcaaattattttctactaccagtagatagcactgtagtgggattcattcattaaagagcaaagtctatgtaggaatataatggattacaaatgcatttgtttttcagggaacgtgggtgtggttggcaccaggagtgctagcgaaggatcctaagaacttcccggagccagaaatattccggccggaacggttcgaccccaatggcgaggaggagaggaggaggcacccgtacgcgttcatcccgttcgggataggaccaagggtgtgcatcggccagaagttctccatccaggagatcaaactgtcaatgatccacctctaccgccattacgtgttccggcactcgcctagcatggagtcccctctcgagttctagttcgcgatcatctgtgacttcaagtatggcgtcaagcttcaggccatcaagaggcaccatgcgtaggcacatcagaactattagttactacttttgtcctaaatataaccatctataattaaatatgacatattctaatattataaattaccaattttagaatgaagagaatatcaattattcacttggatgtcaggtgaattcatgtcaccgtgcatgtctacctcaccatcgcggcctagaattgttccaccagtccgaagcccaatataggcatacgaccagctacgtttaatggggaataagtccactttacgcatctttctgacggatttaaatcatatttatgaactgcaatacggaaaatcttgatccccaacttacaaaacctggttaaattaggtctcatggcagtatgaaactatagatggccggtttcactgacgtgatgaattaactgcagtcaacatgggacccacatgtcaggctcttgctttcttcctctaacatgcttctctcctctcttcccatatctctccacatctcctcttggcggtgggcggcggggaatgagcaagcgcaggccgtgaccgactcgagagtagggaggggaaggccgaggcgcccctcccccacgagctcgagctcaagatacgcagctaccgtaggtgganantnnangggtagcagctagattctcaatngncacat

SEQ ID NO: 10318 - DNA, 5322 bp, Oryza sativa
  unsure (1)..(5322): unsure at all n locations
gcgttgttgnnnnnnnnnnnnnnnnnnnnnnnnnnnnnnnnnnnnnnnnnnnnnnnncaatgatcacgagcttcttaaaccggcacgcttgcttcagcatcacaaccatgcctccccagtgaagcgcgagcaactatcctaacacacagagcacttactcattgtggatcaccgctctcgtagcgcttcatttcgtgctccacgatgcaacgcgatcaccaagccatggggaaggcgcggtgacccattctcataccttgatggatctcagcgacgatggccatgagggaggcgctatagcaaagccacccaaacaggaggccaaagcatcactcactactgatacgatcgagctagaggccaaggccacccgaagcctcccaatcaccctgcccatggtgaaaccatggagtccactgattgtgctcctcctactgccatgatgtgatcgtcagctcttgcttcggcaaccacaggttcactgccaccatcgccctcggcagcggttgcgagtaaggacagcgtcagccatattgtgacatcctggcccaattaggatgaggcatgtatgacccatgagagctgtgtgtgcatgtttagtaccaccttgctagtttagtaagggtgaaaccaacttataaggcatcttccctccaaccatatctcactcccgggttaacctttttacacaaaacgaagacgaaagtataagtggagtggtatgtgtaagtgggcccgcccgtcggatggactggctacgcggttctggagggagggttgttacacatattctagccgcagtgaccctctccacaccgatggcgggttcccgagctccacccttgacggcggtcgccccctcggtccatccccttttcactgcgccatcttcttcttcaacctcccacgtagggctcgtcggtaaggatatgagccaccgccatcttgctcctctctcgccagccaccggccaccggccctctccttaccggcgagctcttgggggagagagaggttgaggtcgagggatgagaaaagagggtagttggggaagaagtgcaagctcacttacatgtgggccctatatgtttttttattttcttttcactgactttctttcgctgactagtatgtcatgccagtgaaaccagccctcaatactgctataggacctaatttaacccggttttgtaagttaggggttaagatttccaactcaacaaaaagtgagggatataaatggacttattccttaatgggcctcacatacaaaaacaaagggtttgttcagttcattgcaaaaaagaccttaccatttgttgaaaaggcaaaatttggtgatgctaaaattttagcaaagatcaagctgtgaagatggagtttagggcctgttcactttgatgtcattttcaaccttaccaaattttgataaagttgctaaaaaagtggctacatttagtttgctaccaaattttggtaactatataagaaatcatgccaaaattttggcatagttaccaaaattttggtaatgacaaattttgatagggttttttttggcatcaaagtgaacaggcctttagtttgacacctcaacaatttttgatatagttatatgagtagaagtttctagaatcccaaatgttggtagggattggcaaggttgtgatggtaaagtgtcatttagtttattgccttaccaaaatttggccaaaatttgacaatgccaaaatttagtatggttgattttagcaacaaactgaacaagccctaatgcctccttaagcccatctcatcccacgatggtcgaaatttgttgcccttgtttgctcttgccagcccattacaaggcctcatgttcagttgttttcacatttgtgacattaattttgagggaaagtataaaaagcgttaaaaaatttgcgagaaaaaaatgttttttctttttacgaaaccaaaaaaaagtcgcaaaactttattagcgttcgtatgaatgtgtagctagctataaaccacaaaatcagtagtattgctggatattgaattactgatgataaaggggagtagcggacgatttatggcatttcaacacacttgttaatccactttccattaatttctttccatcctaccagttaagtacacatggaatttgttaatatcatcagttactcaatacaacaactaaacaccacatggtcacacattagaattcagaaacatggggtcaaactataaactggtacaaatcgctctggtcagtcgtcacagctttgtggtttgtgtcacaacctggtgaggacgaccccaatctggacgctcttcacctcctccctctccatggacgcggtgacgagctcggtgtacttggcgaagagcgcgtcgacgatctccgggccgaagtggtggctgagcatggactcctggatggccctgatcgccatcgacaccgtcctgccgtccctcctcgcgtcgccgctgctgctcaggttgatctcgtacgtctgcacgtagtccatcctgaacgatccctcccgcctcacctcctcctcgatctcccctatcgacggcgcgtagaacggcacgttgtacgcgtccaccttgtcctcctcgaccagcccctgcacccacccattgcattgccgtcaggttcagattatcagttcagagttctgaatactgatgagtatcaggctatctgctcacctgtgcgaccagggaggcgaacgactccgagaggagctcccagaggaaggtggtacgcctgtcgatatagccgtcggcctgcctgccgagcatggcgaggaccatccggccgccggagaagacctccgccgcgcgcgacttgaggaacaggctgaagtctctctgaaactgcctcaggtaggccactggcacggccagggggctcgtgcttgatatgtacatctttcccttgttgatcggcctgttcatctcgtcaagaagcccagaaggaacctgaagtatttagaaaatttcccacttaaacaccggttaatcgttagatcaaacaatgcaacagtgtcagaggagttaagtacctgggagagccagtgcaggctggagcaggagcagacgaagtgaacgctcttggccgggaagagcctgccgtagaaggagcccgggacgccggagaggaacaccatggggcggccccactcgtcggacttggcggcggccttgagacggtcggtgaactccggcaggctgaagaagatggtgttgaagtcgttggtcgggaggtcgttgaggagcaccgagaactccggcggcggccgcgacgaccggcagcagatgcggccgatgctcccgatgatgtcctccgccaggcacagcgcgttcggccccgacgagcacccgaggtcggcgacggcgaacctctccggcatctgcgacaggtacacgtccgccgccgagttggtgatgaggctcttcagcgtgtccatgcccctcctctgcaagaatggccacgccatggctcagagccagaactcggaaaaaaatgcatgcacggatcaaaaagaatcaatggccatgagcggcaaggaagcaaggtgctcgcctgaagcgacgagttctgcgcgtagctggtctcgccgaggccttccttcatgtggaggacggtctccacgttcatgaacggcagcttgtcggagcagtggagcaacgaggacgccattgcctccaagaattcgaagtccctgtccctgtgatcacgcaatgcagtgcgtacatgttcaggactctgcttttgtacacccatttcgcacaagatattaaaaaaaaatacagtatctacctaggccactcgtgcagagaactgtagaacgtagcaagctactgacgaacaattgctacacgcgatgtgcaaaagagattcttcagaataatgtttgttttctgaacaaaaattcttcagaataatgtgatagtaatatgggcatctaagtttaggccgctttatgcaaacaaggcgcgatttgtctaactcggatctcctttttggctcagtttggtgtgaccgaccgagcaaccgggtttcagataaagtacaattctgtcagtctcttcaaggacatatgggctcggattcgatattatcatatcacgtacggcgaaagattgactcccgggagggagaaaaaacacaacgtgaaagtgcgtgaaatgctacaggagataaaagctggcgtaaaaccattggtccaaactttttcttcccacccaaaaaaaaatgaaggaaaaaaaaactttgagtcatgcatgcaacatgacctttgtgcttaattgataccctgtctactatggctcctaaacacaactgcaagttgcaaacgatctgcttcacacttgagagagcatggaaaatccatgtttgaacaggcaaaacagatgcagtaagatttttacaagtgaaagatggaaggttcctgatgcaatgggtgcaattggaaatgagtaggtaacacaacacaggctgctgcttggcctaactaaacagacgcataagctagctagcagtgatcatcctcttgattcttgaaagctacatgtgcactagtgactttatacaagtgatggcgaagaagacaatgccattcgcatgatagtatgcgaactgccatttcggagccgaaattaaccagccatttgagggaaaatacatacctaagggtttcagacaggatatctgccggcccgggctccccacccaagcagcccactagttagctagcagagaagaaaccttggcctctgccttggcatctgcagtgctcgctcctcggggtatttataggcaggccaacggaatcagaatcgctggctcgatcatgtggctccagccattggcaagcgtctcctcccaacttgcacgaactgtgcacgcacgcacacacataagaggaacatggctgctaggtcgggggagagagagagagataaatatcagctggctcgcattgcctatatgtccctatgaacttacgatgatttgctagtaagatattgtcatcgttattatatcatatgatacgatacgtgcatatggaatggacgggttgggtgcgatacgctgcacgcagctggtgtcacggcgcatccattcgtctcgtgccccttttttttttccccttttgttttgtgggaatacgtggtggcgtatcgcggccggacaggtagaaatcggaggaccataagcttaaggtggagccgcgtgcgttagcgcggggtagtggagcgagcttttnnnnnnnnnnnnnnnnnnnnnnnnnnnnnnnnnnnnnnnnnnnnattaagcgt

SEQ ID NO: 10319 - DNA, 4754 bp, Oryza sativa
  unsure (1)..(4754): unsure at all n locations
ccggttgttgatanattcctatnnnnnnnnnnnnnnnnnnnnnnnnnnnnnnnnnnnnnnccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttctttaatattcagagatacacggctgaacaaaatattcacagttttaaaattggacaaagagtccaacttacaagtattcagttgacagaagaacacgaaaccttcgaggagaaaagcaagcaagccactctggtacttagaagcagaacctctttttctgcatataatggatgaacacatatgaattggctagctcagtgttatgagatattctttacattttttttcctaatactatatgatgttgttgacttttagatatatggttgaccattcatcttattaagaaaactatgcaagtattatttattttgttatgatttatttttttattaaagatacttcaagcataacttatattttttatatttacactttttttaataaaacgaatggttaacgtatgttaaacattaatggcgtcatatatttaaaaacagagggagtacgatagaacagggatgtgtgcgaaccaaatcatgaagttccctttgactcaatctagtttaacttaaaaaaacacacacttagcaacaaagaataaattcatttttatataaactagcgggtcaataggtacttctgggtgaactcactcacatccataactaaagagtagttggcatcaagaacaagcatttctcaaaaggaaagagtaattcataggaaaaatccacaacttacccgaaattgaatattcttttgctggtcggcgtatgcaagcagttcgtccagcctcatcaatgcatcataaagcatctgctcatgggagaaacaaaggtcaatatggaaaatcgcaattttttgttcagttcttagttcttactatagcgaacaatcaagaaattcggtgaactgccaattcttgggtgtaatagtataacatatagaaacattacctcagaacagtagttatatccttgataccactaagcaataagctatctaacgagagtacatcttccttgtcacacatgcacacccacagagtgcatatgatatgtcaagactcaacagtaccttctttgtagatattagctcggcttccaatgcatcaacacggtgaatggctccattgagcaattcctctctatccggtggcatttgagattgctttgcttcaagctcctgtaatttctcctccaattcaccaagacgtctcaatacagacgaatgtgtactgttttctgtgaatccgggagaagatggaggtcaaaactcttccaaaaactcaatttcttgagggaactcagcactatagttaccacgggaaatggcctggcttgatagacttgcagtcactctgcttgggacagaacgaagcacggcaacaaagctcacgattaagactatcaaccacgcagtaattcgatttcgaagtcctcccagttccatcgttatgtttctcaacgagaacgaatctgtgtaaaacatgcaacaaactcagtcaaaatcactccaataaactcttggtgggcttaccggtcaccactcactacatactataatgtaatggcatgtttggtttgaggaatgagatgaccacttgatcttatacaggtcgcttggtttgaggaatggaatggatttgtccatcatctctaaaaagtacatactaaatgagaaactgagaaatggagtcattccactagatttgagagatggtcccatgatggatcacccattctagatagtttgattcctcaaaccaaacggccaacaaaattcccagtatctcacatttccctagttgcatatgggggtacgaatgtttgaaatcagcaagtagacaacttctcaataagaggtacaagtatgaaggtgtcatataaagacctgaattaaaagccattgagctggttgatggaccggcgcatgtgtccacagccttgtcaacaacagggatgtcctctactctgggaggggcaccagatgtggaagtatttcccggcaatttggactgcagaaatataaaaagatgcatttatgatcatatttaccaacataaagattgattaaggaggaagaaaattaagaatgccacatcattgtttagagcgagtactaatcagtaatctgagctcagccttgtgcagttgaaaagaccaatagaacgagtactaatcattaatatcagcctcgtgcagttgaaaaaaccaaaaggtacaagatcttgcctcgtcaacgggtgtcaaatgagggtttatgatggggttaactgaagctataggagatgaaacatcttccatttcagaactagactcagcagaggcatcgctgcattttttctgcgaggggatagaatcaagcttctaacggatagttgttattttaagatgatgtatgagtaatctccattcaaagcatgcttacagttaagtgtctagggttaatataacatattttcttcccatcaacgcttgatatagcaagaattttccgtccatagtttgcttcaccattaaggaccctctgaaaatcatagacacattattttagtgtacaggatttcttttcaaaaaaaaaaaggtgtacaggatgaataagaagaagggtagggttcaggaagagtggaagacctttattatgtcaggatccttccaaggacctttatctgattttatgcaacctccatgttcttcacacctgcatttgccacccagaaaatctggaagttcactgaaaacatgaattaaacaaaattattaggataggaaccaaactacagtatttgtgacagtagaaaagacctaacctctcatcaatagtttcaagtagcttattttggtatttgcttccaaggacctaggtgaaaaaagacagataaggctattatcacatactagaagtaaatattattctgaataacaattttcaatacttacatgaatcttcgaagcagtttgtggatcaagaaatgattttattgtaccccataacatcttgaagccttggccagcatttataatgtacaatcggtgcaaggtctgcacgagcactagaaaggtattagataagtcctttgttatgaccccagataaaaacaagttctatagaaatgtatatagtgacaaaaaacgaagtgaaagggcaatagtgaaaaataacattaaaacataatggaatcacctacctctggatagttgtcattgttgatcttctgaagtcgcatgattagctctcttgcatcttttgagaagttcttcaaacccttcacataaaaaacaagttaactactaatctacccagaaattttggcgatagcaagattggctataaaataacataccactccttgcacatccaagatagtactgcacgaatctatgtgcctttttgcagcaatggagcaagctggaaacctcatctgcaagcacttctcggactccttgacatgatactttacatatctgtcaatagttgtgacttgtactaatttgttgggatcaacttttccaattagttctatgtagacaggccttccctctttatccacaccatggtaaaattgtggatagcactccagaacatcatctaattcgctatagtcaaattcctaaatgatccagatgtcaaacttccagaagttacatgaagaaagactatcactacctacgtactggagcatatggtccagtctctgctttacctctatgttgtcagccccgaactccttcctccatctaagcatttccgaccacatatgttttgctttatcaatatcaaattttcgcgctttcaggaacctacatgtgtaacatgtcataggcacatgaagaaattttaaatcaaataagnnnnnnnnnnnnnnnnnnnnnnntaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttatttccagcactgatagctcggttcttgaaggagactgccttggcctttttgtcaccttctgagttgtcctcatcggatttccactctttcttatcatcatcatgcacaatgccttcaaaacctgcacctgctatatagtttcaacgaaatgcccctcctcctaatcaggttgaaatggtaacaactacattgaaaataatcaatacgagagcagagtacataggagttgcaattaactgaaagcagcgcaattacacgcacgttaaaaaaattagggaggtgtgattataatctctacaggtgctaaact

SEQ ID NO: 10320 - DNA, 735 bp, Oryza sativa
  unsure (1)..(735): unsure at all n locations
aacatccatttagcagcaaacccccaaaaagtcaaggttttttccacattctttgactgctgtactcaaatcatgggttacgaaaatttcctcaaatgttttaaaaggaaataaaagggagtacctctagaagtattgcatgcaaatcatatcatccacaaataacaaggttaagcacaagcaccaaaaaatagatcacttttctgacaggacaagggaatcctgtttgctggtttacaagttttgtggctagcgctcaaacagatagatgcatgttataatccccaacatgcaactaagtcacagcacttccaatattctgggattagcagccttaaaggaaatatggccagcactcagcaattaatcagaagcacagctgcacaggagatgaatgcacaccttacaccggaaagcaatgttgatggcatctgatggcttgagatctaagctaatagtctcctcttcattgccaatctggatatcatgacaccatacttcagacaaaagtaaaatagatactccctccgtactcgtaaagaaaatcgtttagaacaatgtttaagtcaaaccttaggaatataaatcatgaataactctcaagttgttgagtttgaaaatgtaaaaattatatgaatagatttgtcttgaaaaatactttcataaaagtatacatatannnnnnnnnnnnnnnnnnnnnnnnnnnnnnnnnnnaatgaagaaatcaaaccagcg

SEQ ID NO: 10321 - DNA, 2171 bp, Oryza sativa
  unsure (1)..(2171): unsure at all n locations
cgagcncncttgggcccccntttggaatttgtanaacnnnnnnnnnnnnnnnnnnnnnnnnnnnnnnnnnnnnnnnnnctaatttaatctgcaatcaaataaagaagaaatttctgtgtcaattttatttgttgtgtgtatgaaacgaggatggtctgtgccgcggtccttctgtgtcttggcttgaacaagggctcgtgcccaagtcccagcctcaaacggcgcgggtcggggctagtgcctggggagatgcacatgtcgagactggctaagccgggagcgcggtgaccgaaggttattgggacccgattgggggcctttgccgattcccccccggagttcaccacgccccggggcacggctcggttctgggcccccttttgcgatttccgccggcccgggccaccgagggcagggtcgagcaccagcgtgctaattcaagccaaaactcttcaaaaggaaacaatggcacagacacaatccttagaaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatattctatgggttaggcagctctgtgccgtcgcccgtggccagccgaacggagcccggccgggggacgccgatcactcgatacggaccctcccacattggtgagagcttgctcagtccagcacgcgtttggacgcggcgtaagacgaggtcgtcgacgcagagtgatcgggcccggacgtgacgctgatggtagcgccgcaggctctgctggtagcgcgcggctcgaagggccgcgcgccgccttcgttcttccaagaagtcgaggtcatctctgcgatgctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccatgcttcttgaggatgttgaaggtcttggttttgaggcccttgaggatttctgcgttggcgcgctccacttggccattgcttctagggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgaaagcgacatacagatactcgaacccgcccggggcccgtctaaacggacccaggatatcgagcccccagacagcaaacggccatgaaagaggtatggtctgcagggcctgggccggctgatgggtttgcttggcatggaactggcacgccctgcaccgccagaccaggtcgatcgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttgaagatgcgctggacgcgttcactcccttcgcggtcctcgggtagagtcttatctgcgaggtacgcctggatctcagcgatccaagcaatcaatctaagggagctgggagcgcccccctcgggtcccgaggcctggactccgacgggcctcgggggccgttcaggctcgtccgtctcccctagggggtcgggtcgcgccgacggctgggcaagcctttcttcaaaggcgcccggtggggtctgggctcgcgagaaagcgagccttgagagttcgtcggcgaccgcgttatcccgtctgggcacgtgccgaagctctatcccgtcaaaatggcgctnnnnnnnnnnnnnnnnnnnnnnnnnnnnnnnnnnnnnnnnnnnnnnnnnntgcacgcgg

SEQ ID NO: 10322 - DNA, 748 bp, Oryza sativa
  unsure (1)..(748): unsure at all n locations
ggctgtgnntttganaaccnattgatatatcnnnnnnnnnnnnnnnnnnnnnnnnnnnnnnnnnnnnnnnnnttgaatctcagacagcggagatggttggagctgatcaaggattatgatatgggaatacattatcatcccggcgaggctaatgtgggtgcagatgccttgagcaggaagagtcactgcaacgtcccatgggtagaggaactatgctgtgaggttcaacgtgattcggaacatttgaaccttggtatagatgagcacggattcgaggctgccctagaagcacaagccacactggtggagcaggttcgcatagctcaagcaagtgatcctgaaatagcatagctcaaaaagaacatgagggtcggaaaagcccgatgttttgttgaggacgaacaaggaacaatctggatgggagaaagattgtgtgtacccgaaaacaaggaattaaaagacctgatactaaccgaggctcatcaaactcaatattccattcatcccggcagtaccaaaatgtaccaagaccttaaagaaaaagtctggggggtcaacatgagaagggaaatagctgaattcgagcactatgtgacgtccgtcaacgagttaaggccgaacaccaaaggccagcaaggttgctacaagcactttagattccacaattgaaaggggaataaaatcgaattgatttcaatcaccggtttggcccggaaatcattggggcatgattcttttgggtaggccc

SEQ ID NO: 10323 - DNA, 737 bp, Oryza sativa
  unsure (1)..(737): unsure at all n locations
ctctgcgtttggannccnnaatgatanatcactatnnnnnnnnnnnnnnnnnnnnnnnnnnnnnnnnnnnncaagttttggttcgttgtgcccgataacaagacaccatcgagatcgacacggtaaatcaaaatgtgagctagttttaccgatgaagtagccggtgtggatggcgtggttgatggcccaaccgccgaccgccgccacgatgacgtacatgctgaagttgagaaccaggataaggccggccaccggcttcagccccgcgttagccatggatatcaccaccgagagctagcaaaaactctctgcactctttcagaacgtcttggcaagctatctacgtgctgatctacgttacttgcgtagtagtactatttctacttgattcaggaggcgcaccgattcagcgttagcatccgggccttatatatatacacgcgatcgattgagaacgcganataatatgaactattttactgacaggacatagctggttttgtgccttgcttccatgggatgcatatggacagacgaaatacggtaaggtttttgtgacaaacgtgagcgtaatgcattgaagaaaaaaggaaacctacgtacccggcttggggttcgggggtttggttcaaaacatttacaagtttcaaaaaatcttgtccgctggaaggttaaaaggacgtttgttgaaaagtcagactttcttttattgaaggcatgtggttctttcagtcaag

SEQ ID NO: 10324 - DNA, 7046 bp, Oryza sativa
  unsure (1)..(7046): unsure at all n locations
atgtgcattgttatcgagctggtaccctattagcaacttataaaacttttatacttgtatccttaatgattaaaaaaatattgtaataataaattacgatgaaaaaactatgtaaatacttaagtatttttgttaaataaacgatacacaattttgttaaatagtggttttgttaattttgtgaaataaactacaatgaaaaaactatgtaagttttagaaggagttattaattaaaataaatatttatgtagtgttacatatgtgatatccttatcttcatatttgaatataattctatatgatattaatatcataggagtaatattaatggtcaaaattatctattgaagactgtcaaaaacttgcgtcttatatattttttttggttgaagatatataaattgcagaaaaaaaaactccactctttacaggaaccaatctgagttgctacctaccttgtgaagcacaggcctttctgattaataagagaattggcaatggctgagggcatgcttcggttaggaatgctcttgaatttctttacgcccacttccttgcacagctcggcatccgccaccatgaccaatggttgtcttcccatgtgaaatctacgagcaaattaaactagatccagttaaccgggtagtagaccctggtattcccagttctgagctctgcgttcgagacagagaagcaccagtaagcagaggtgccagtcacctgaagacaggaccgtacttccttgcgagcacggtgaacacgtccggcccgtgcatggcgagcaggtggaggtggccgatgaacggcaggggcacggggcccggcacgtgccgcactttccagtatggctcgtacaagtagcccaacagcaggagccccacagccatggccaccaaggtgaccgcgtactccgccgttgagcccagcactgtgctgatgatctccatctcacccttgcgtctctgccttcccctctttgcctcactgtcgcagttcgtggtgtgccaagcgttgctggttaaataggcttgcgattttgtgaacagtccaacggagcagatgaagaatcaatgaggcatccttgagagaggcatatggttttggctgtattagtttctccttaatgaagtaataaaacaagcataattaaatcgcgtgcaaccaattagtacatcgtgacaaattttttgttttcttcgggagggtagctgtcagatgctaatggtggttgtcctgacgtgttacgtgtatgcaccagatgaccagaaaccccatcgttgcatgagttcatcgccgtcagatggtgaaatgagtgcctgtgtcttcgttggcactcgtaaaatattgagccaacgacttcagagaatagaacggcgatggcccaccatcccacgaaaggtaccaaaaggtgctggactgcaaattcgaaattaacaattttcttaaacaaatgcataacgtagtacgatatttcgtattgagagagcataaaaattataaatgtacagttctaagagaatatagcgaaaaaaaaaacaccccataacagtggctaggggtggacgttcggtcagacagaaaaatttggtctcggtttttggtttttcggtcatttcggtctttgcaaactcaggatcgaatttcatccaaaaaatctcaggaccggcaaactcggtctcggtttcggtctgaccgaattatgcactagattcgaatcagaggagtagatcaaacaataagcataatacttacagtacatcgcaagaagccaaaatccacagatgtagccgctcgctgccttcccgtcgtccccgatggagacgaatgcggccggtaagattgaagccgaggcggctcctgcaatggatgctganggctgatgcggcgcggatgctatcacgcggtaccacggaggcggcgcgatggatgcccacggcggcggtggcgccggcgcgattgaagccgagggaggaggcggtgccggtgaacttgaagccgaaagtgggggtggcaccggcgcaatgcaagcggaggcggagtcgtgaccggctgacggcgtgatgcggcgaggattggataaaattggaggcggcgcgggcgtgactcccttcctgatgccctctaaggttttgtttttaccgggcttattgggcctcgtaggtctattgggccacaatttggttaaccgaaagccaataaccgaattgcccggaaaaagtcggtcttttgatggctgagactgaattactaaaagtcggtctcggtcttttcgatttggttcttcggttcggtcttattctgcccacccctaacagtgacgtagctaggatttaaagtaaaggtggtccatcctattaactaacacatctctatctctactacttaaaaggttgaatatgtttccgtcgttcgtccgtgataaaataaagggcgaaaaaaaattgaatccgattatatgcgatgcaggaaaaaaaacgtccatcgacaatccaatttggttagcaaaatgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaataaatagaggacttatttaccttaacttaggttgcagctcaggcagcccgagaatacaaccgacgacacggacgaggcgaacaccaacaacaacagcggcagcagaaccaacggtctaacacccaacaccacaggcgacggctgggaaccaggacgaaaccctaatcttcacttcactttgtcttctcttcacggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttggggcgaaaagagacttgcgtctcgattcgactttaagagatgtttttcaacagctcatttagtaatgtaccgacctcccgggtcagatcattacttctcggctcccagagccatttcacttgattaatcggctcccagagtccagctgcccagcagcacaacaatccgcttccactcgggaagcctagtctatgatgcccgcagacatcccgaatcacacagattcgtttctgaccactcagttcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattagcatgcgaggtttccctgaacagactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagagcacaaataccgaggtaccacgagggtggagcgacaaggaatcagggtagtacgacctacggaaattagtgcgactactgggtaggtccgtcgatttggcacgcaaaccgaggccaagcaagttaagtgtgtgattctaataatgcaagttgcaaacaaaataataatgacttttcaattataggggcaatttgatcaaagggtgacttgccttgctcaaggtcttcacgaagcttcacgaatcttcgagaaaacccgcgatcgacgaaaatccgataaccgcaactatacgcaaaaaatcgaaaacctaaacaaaggaccaaaagaaggatcctatttagactaattagtagtgccattaaatagatctcaattttacggaattactggaagtataacggagtcaatcggagttacggatcgggagatatgaatttgaagtttatttggaatttctggaataagaggaatggtttatggaatttatagaaataatattctcaagaatattattgacagtcacagacacgcgggaccaaaggaaatgatttgtggaattttgggaataaggaattgatttatgaaaaagggaaaaggatttattaatcctttggataagaaaaggaaggagggatgggatttagacttctttgggcggctcgggtacggcccaagggataagcacggcgcggccgagccaatgggccgggcgcgggcgcaaggaggcggcccatggccgggcaaggcgcggcccaagcgggcggggcgcgcgggaggagaaagggggatgggtccgggtggaccggatccatcgtgctgggtctcgggacaggcccacgagttagcgactcggcgcatgggggaagggttcatgcggcgcagggcgctagggttttgcggacgcggctcacggcgcggcgcgcgggtggaccaaaaggtggagggcccacgcgcagccagttggcgcaccgtggaccgcgcgcgcgagggtggggaaggaagaaggcggctgaccggctcggcgcggtcaaagccgaggtggcgccgacgtggtgccttcgtggctgccacgctggctggcggagggaagaagaaggaggccggccgagaggaggaagaagggggcgcggccgaatggacggcggacggcggccgagttcaccggagcaagcgtgacggatttggtcttcggggagcacaccggagtgacgagggcatcgagaaggagcgagccaacggctcggattcgccggaggaagttcgacggcggtggaattcgacagcggctgccggcggcgagagaaaggggaaatcaccgaggggcgacgaggactcaattaaaggcggcgggagcatctccggtgttcaaggaactcatttccggggtcggatgggtctgagcggcgccgtggaggtccggcgacgagaggcggcctccgggggtgggcggcaatggcggtggggccatgccgggtggcgtcggtccttgggacggcgtctacgcgcgttcggcagggttaccgagctaccacgcaagctagaggggacgagggtgagcagggaaggggaactggagggaggcactaccgagccgggacggcgcggtgacgagcagccaacggcgcggaagcgagttctccgtcgtcgggccggggaaggggaagaagatgggcgcccagagtcccgcgtcacgcgtccacgcacgcaccggctcccccggtgctcggcgacggacgacggtggcgcgagcagggcggaggcgacattggcgcggtggcggcgagagcgaaaacgagagagattgggagatggggcgcctcgggttttatagaggtgggggatgtcggttttgggagggaggaaaccgacctcgtgggcggtcaaggaggggcggtcaaggaggacctggcggcagggcgcccgtggtccaggcagtggcaggcggtgacgccgatggtggtcgggcaaaaggaaaaaggaggggggagaaagggagctctgctccttgctgtttcgggaaaagttgaaggagggagagggagtgagagagaggctgcctctctcggctttggaagctagcggcgtggagcggcagcgcacgacgcaggcgacgctagggcttgacgtggcggcaaccgggcggctgcgcggcgcaggcgcggcagggttgacggcggcaatgaccggccggtcggccacgcgcgagcgcgggaaagagcgaagacggtggcgggttttgggcggcgacggcgggaatggtgccggtcggggaaaaagcaaaaggggagggaggaaaagggggccctgcccatgccattcaggaagaaagaggagggacagagggctctgcctcgggagttggacgcacgcggcttggagtggccgggcacgcgtcgcagggggggtgtcggaacccgaccggcgcaagccggcgcaggcgcgccaggtcggcatggcggcttgcgtggcgcagactgccagggctgacgcggcggcgaccaggcagtcggccacgcacgggcgagtgcgcgcgcgacgcagggagtgcggctggatttcgaaggcggcggcgagagttttggcgtcggggggagttcgtcgggagagagagagaaacagagagggagagagggagaagagaggtgctgcctctctctcccggcgcatgcagcgcgcgtgcggggaggaggaggaccggccgagagaagagaaccgggctgagaggagatgggccgaaggagggaatcggcccacaaaaatccgagggacgcaaaatagactttgccagagagattgaatttggagagaattggggcttggaaatggaatttggatatctttgaagtcgggcgaatatttggcaaggttttgagatttggaatttgaatttcgaatttgattacttggactcagggaaacagggaggagtcaccaacgggattcaaaaagggaatttgataattctaggacggggacaattatttggcggggattnnnnnnnnnnnnnnnnnnnnnnnnnnnnnnnnnnnnnatacgatttgcatcaccag

SEQ ID NO: 10325 - DNA, 10234 bp, Oryza sativa
  unsure (1)..(10234): unsure at all n locations
ccggttgattgcanatcatanaacnnnnnnnnnnnnnnnnnnnnnnnnnnnnnnnnnnnnnnnnntgtgtaacatgtcataggcacatgaagaaattttaaatcaaataagnnnnnnnnnnnnnnnnnnnnnnntaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttatttccagcactgatagctcggttcttgaaggagactgccttggcctttttgtcaccttctgagttgtcctcatcggatttccactctttcttatcatcatcatgcacaatgccttcaaaacctgcacctgctatatagtttcaacgaaatgcccctcctcctaatcaggttgaaatggtaacaactacattgaaaataatcaatacgagagcagagtacataggagttgcaattaactgaaagcagcgcaattacacgcacgttaaaaaaattagggaggtgtgattataatctctacaggtgctaaactactactattaaaatttcaatcccactcgaacatgaactatttgtctatttccgagtgatttgccatgttctccacttgccccaatgaaccccctcacagaatcaatctctctgcaaccgcaattttccggtgttcgcgaatgacaagcaggtaagcattgcataaacgagaacgggcaacgcatggcggcatggagaaacaacgaatcatcagggaacacgcagtcgaaggaagaagggaaacagttcgcactcacagggccgatcgatggaccccgccatcttcgccttccccacccgcggtccgacctcgattcctcgcagggtaatcgagtccccgagcctcgccgctcgccgatgaaccagggtttccggcggaggaatgcgcggagacaggaggggcacgagaatggagagagatggctcgtttgaaattgattgtttttcttttgatttaggaggaatattttgatgcttttgttttgggggagaggggaagagaagcttctgttttcttttcatcggtggaggaaggggacagggcaagaggggagggggtgttacacgtatcctctcgtggaccgggtccataggctcgcaacaaccgcgacgctgcatcagcctgcacgtaggcgtgccacgtgggcggctcacatcggctctggtccgtcgacctggcgagcgcgtgccacgcgtcgcgcatgggcgcacggtacgcccgtaatatgaggagatcgagccggtgtagagcggctagagcccactatggtgaaccagctccgtttgatctgcagatgccgatgcttatgagccgttgatttctccttggaggttctgattggcctgatcgggacacgctcgcaggctcgcagcagtggacggcgctggtgatttttttttccctttttttgagattcgctggtggggtttcacgtctatggagtatggacaaggttcaccgaaatttattctggacgtgacggttcgaggcttttgggccgggctggaacttgagagtacagttgttggttcgggccgaaacttagttcggagcaaaacaggtattcaccgcaaactaaataggcatacaaattcaaatcagaagcacgaggattcgtgtaaagcaatttgcttaacgttttgctaaaatcaatcgtgagtgacaaacatgggcaccttttgagtcaattttactaccaacgccaccacgaattgaaagcacccaaaatcatgttctagtatgtatatgtatctatgtataggttcttctgtaagtatttacaaagttcttcttgatgtttggctttatgcacttcaggcgggactagtatgtacacctcccttcaggaactgatcaagaaaagtgaattgtcatcctgtcagtttgatcgagctagtgtacgtgaaagttgacaaagaaattgactatatgaagatttcaagaatggcatgggcgactgttacctgttaaatcatgttctttttctttgcccggaacatgaaaagctgatctctgtattgagctgaaacagatgataccagatattagnnnnnnnnnnnnnnnnnnnncatatatttgtgagtcgggaggcggataaaaaaaaacaaagacttcccatttagggcccattttgaacgcaggaattttgtacgaattagttgcaatttccacaaaagaaaaactataaaatttatctgttccagaggaggcaaaataatgcaatgcaacactgtcacaatgtatgactattttactatatgcattttaagccaacaagagcttaccagcatctttgtagcgttcctcaacagcagcgaccagcatattgcggaccaaatcaaactcttgggcctcaaagcaaggttgatcgtcaggccttcaaatggtacgggatgcattagcagtgctttaaaataaacctttctttactgaaacctatgaagctacttttgttacaaacctgtcaagtcttgtgtattggaattggtctgagcttacatagctctcagatggtgttggttgtacaactttcaatccattgttatacgctatacgcctattcacttgtataggaacctatgtaaagttagaataaattggaatgagtatcataaacatccatttagcagcaaaacaccaagaagatcaggatttttccacattctttgactgctgtactcaaatcattggttacgaaaatttcctcaaatgatttaaaaggaaataaaaaggagtacctctagaagtattgcatgcaaatcatatcatccacaaataacaaggttaagcaacagcaccaaaaaatagatcacttttctgacaggacaagggaatcctgtttgctggttttacagttttgtggctagcgctcaaacagatagatgcatgttataatccccaacatgcaactaagtcacagcacttccaatattctgggattagcagccttaaaggaaatatggccagcactcagcaattaatcagaagcacagctgcacaggagatgaatgcacaccttacaccggaaagcaatgttgatggcatctgatggcttgagatctaagctaatagtctcctcttcattgccaatctggatatcatgacaccatacttcagacaaaagtaaaatagatactccctccgtactcgtaaagaaaatcgtttagaacaatgtttaagtcaaaccttaggaatataaatcatgaataactctcaagttgttgagtttgaaaatgtaaaaattatatgaatagatttgtcttgaaaaatactttcataaaagtatacatatatcacttttcaataaatatttttatagaaacaagaagtcaaagttgtgttttggagaccgtgttgctgtccaaaacgacttcctttacgagtatggagggagtagttcatgtgaagtcattttaccttagcaagatacaatcgagaatagtatgcatcatggaccatttctgtaatccgcaccaaacgtacctaaagggaacagatctgaagtaatcaagtaactgataaatgaacatattatatgacatttaagagaacagatctgcagaccgtgaactctggaaaacagctttccactaggacactttagaaaagatgtatgtattgtccgagtgcatgataaccagcatacattaagtaataaaactaaaatagtaacacacataagcacacccatgaaacactaaacagaaaacctaaaccatgaagccacacgaaagttgcaaaagaaagtctgcttataagatctcatcttaaactcaccgcatatcccatcctttcggtcatctcctttaccacattataaatagttggccttggctggaaagacagaatagtcatgcaaatcagatatagtacatgaaaacaatttaaaaccagaatcatgtggatgcttaacatctaacatatatttattaaagctacatccaactcttacaattcgaatgttccgaagggcagccagcaacataatacttggtgtttccactggaaaaaagtaatgtgagtatatcacacaattagaaaagcatctgcataagtggaaagcatgcccaagcaagaattaatacgtactgacgataattggaagcaaaagatcacttccatcttccatcttcagaacaatagcatggtgaggtgcagaatcccgcaatcttaatacccgcgggttgttttggacacatctaaggtttttgccatcacgcattttaatcacaaatccatcagatacacttctgagctcaactgcaaggacagataaaaccacaagtttaatctcagaaatgtacaatggttgtttggcaatcggcataaatgatatactagtgatatgtaactaatactgcaacagtagcttggcataaacggtatgtagctgatcaaacaacagcaactgtttcaaaggctcacagcgaacttcccaactcccaacaaacagtgggccggacccggacattgctcgaacgactatgcatcaaaacccaatgaagttacaagttacagtgtaccagaagtaagcaattacaagcctccatcacgcttgagttgacgaactcctcgccgctggcagcattatccggggcagcggcgccgtccccgtcggaagacgagccgtaactgcacaaaacaggccagacccagccgcttcgcgcatgccgctcggacgggaaaccgaagaacctgcgcgccgcccggtagtggtctccctgcaacccacaggctcgtctcctcaggtgcacgcgcctaagcagctgcccgctgatcttcgcgtcggaggtcagggcgccggtcgccggagcagcatagcgcgggagaaccggcccgttgatgatctccatccttgaatttttaccataaaccaaaccgtcataaacgaactcaaaggcaacagaaacatcagaactcaacttggagaaaggaatcgatgcgattttcaccgaacgagaggtccaattagcgaaatgagaccacagcgaattggcagaaaccaccaaattgaagagttggacgttctagagattgagggatgaactagcttaccaccgatcctggcggggagaagggcctgaatgcctgatccgagctgaaagacgcaggaatttcggaggattttggtaaagtttttggctcgaaaattttttagccaaatgttaaaacccttatcgctaaacccgacggcttttatggcggatgcggttgnnnnnnnnnnnnnnnnnnnnnnnccttagatatttatggcagcagcggacgctttttaagggtgttttggggaatacggatgaccggatggagtggccatttctgtccgtttgactgtaatggagagatcgctccatcaggatattttttctttggatagaaagcgtaagcgtgatgtggaaaggcggaagatatttcatactatacgaagaatatacttcctccgtttcatgatgtaagagtttctagcattacttatattcatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatctagcattacttatatttatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatgtgggtcttacatgtcattgagataccgataacatatctcaaactttacaaagttataatggcatggtaaagtttatttcggtccttgaatttggctcaaagttcatttttcaccctaggtgctaaaaaataattgattttatatatacgtggtgcaatcgatcgcccaaccaccaaaaaaaaaagatggcatgtagatcatcacatgtaattgtgacaagtttgtggtgtttgagttcaacaaacaaaatttacttatattctagtatcaagatattttcagtgaaaagtactctctccatctcaatttgatcatcccctaaggtttctaagatcttcctaaaatgatcatcatttaactagtgtcttttcgtttatttatgaaatgagtaaatgtacatcattgcatgtgttgcatgtaactaaaattgattaatttctattagtgcaatatcataatatttaaaataagagcagttcacgggatacgaagcgatggaacaccttagcattaatttaagaatgatggatatgttggtgtccttggtcttggtacgctttgcttagaggatggtcaaactgggatggatggatggaaggagcattgaggacattaaaacaaatggatatatactatctatatagttactgaaaggtgaagatgtagcttagagggtgtagacccccgattttggaaatcggaaatcttctgtgtttatccgtaccaatctctggatcagtagttggtacacacatacatagttggatcacaacatatcacgaatgaattcaggctaaaagagttaaatacttacattagggccaggtaggccaacaactatcagagaacatcagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaacagcaagggtgagtaccaaccatactcagcaagccaccacagcaacgatgcatatgatagagggtatttcaaggaatggcttcaggttcctttgcgcaaagcaagttttacaaatcttttcacaagcctaagacctagcatagactgatcaagttttaataccagtgttcacattaaacaacgatggttctgtccaccatccattgtaatcccaaggatagcttcccgccattgagtggtcatggttttctgaggacgtccaccttccctcctctcaggaagtggctccatcagcataaaattcatcatgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacggggggtcgtttcatacttaacttcatggctcggtccttaattgaccagggacggcactagccttttccggacaccacccaaatcctccagccgccccagtcgaaaacagttgtttcactttattttcctttcacaaatcatgtcatcaatatcatggcaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatccatgctctatatgttaaattcgggaggtttataatattatagttacagattatctcttaatgaacaatccggagttacaattgaactatgaacatatgaggtcaagatttataattagtacttatctactatgcatgtttgttatatactccccagtttaatatatgaaaaagataaattaattgtataactataatgggatgtccaatatatgtgtgcaacaacgtataatgttttggtcgcctactgtacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattcctccacatttagctctattattattctcctaaacagattcatctatgtgtgtttatattttagttacataatcataaggctacacttgatttaaataacctataagccatggatttaattatatggccatcgaatattaaataagtactagtattttccaatacatccattcatttgagacatcacataaaattagtttgtgtggttgttacagtggcaagacatgttagagacaaatattattacatctactctaccgtacaatactaattttatttattaacatatttttaagttgactattatgcatcatcttgatattaattatttaatatttataaatatattttatcaaatagtgaattatatatcattggaaagcttatgaatttagatgaatttaggttcaagtttcactcaaatcggagctaaaatgaataagttatgctagtgtaaagattcaaatttgaataaatccgagaaattgtaaaaaggcactgttcctaattcatttatttataatacaaccttatccacaagctatagtgactgacaggtggggtcttccaattttctttttcttttcttttatttttcttcctaaaggaatttataggagcaaatggggatcctctagagtcaacctccaggcacgcgcgcctgacgattcgatcaacatcgc

SEQ ID NO: 10326 - DNA, 1972 bp, Oryza sativa
  unsure (1)..(1972): unsure at all n locations
ccggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaaaagaggagggagggggagtgagaggggttctggagcctgaactctctggctctccggctctctgtaaatccttcacacacagatccaccagaacacaggactagggtattacgcttctcagcggcccgaacctgtctacatcgcccgtgtctcgtgcacttgctctctcgcgaacattctccagatagatcgagggcgaagaacctcacttagcgcccccggccgaaccggcaaaggggggcctgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaatctctctccgagcgctagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggtgatggcagcacgccccagggcgcgctccaggctgcgggcgcgctcctgcgtcacccgcccgtcatccctgatccagagactccaacccgacgttggctagatgacgtggccaatttggtcatgacggcgcagcagcgcctaggcgccggctggtggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggtgcaatgatcgccgtgctgcccacgcatcggagggcgcttcctcgtccggagcgccacttcggtccgggcacgggggccagccccctgtgtccccagttggcggtgccggctgtcgagcctttgtggcgagccttcggaacgtccgttggcccccaaggttccggcccaccatcaccgaaaaatacgacggaagcatcaacccctccgagtttctccagatctacacgactgggatcgaggccaccgggggtgacgacagggtcatggcgaatttcttccccatggccctgaaaggacaggcgcggggttggctaatgaacttgccacccgcgtcggtccactcttgggaggatttgtgccagcagttcactatgaacttccagggcacatatccgcgcccaggtgaagaagcggacttgcacgcggtacagcgaggggacgatgagtctcttcgctcatacattcagcggttttgtcaagtccgcaacaccataccgtgcatccctgcacacgcggtgatctacgcgttcagggggggcgtgcgccacaaccgcatgctcgagaagatcgcctccaaggagccccagaccaccgcggagctttttcagctcgcggaccgtgtggctcgcaaggaggaggcctggacctggaactcctccggttccggtgtggcagcttcggccgcccccggatccgccgctcggtcagggcgacgggacaggaggaggaagaagagctcggcctattaagacgaccagcctcaggtcntngnngtngagggggatataagggtaagttgaaaggggaggcgtgggagtgacaaaaagaaggaggccggagctntggtataatntnnntnnnntnngtncannaatccgcttaccgggtgt

SEQ ID NO: 10327 - DNA, 1092 bp, Oryza sativa
  unsure (1)..(1092): unsure at all n locations
ctacgcatatctccagatgaagatgcccgggcccggttggccccatcaccgtccatgncgacntcaaagtcgcgcttgcttgcatgaagcagcgcgcggaccactcggcgtggcaatccaagcccgcgggtggcgacgagaggctcagcacctccgtcccagccgccccgaggcagcggatgatcacgtgcgacgaggtcccgatcaagcaggttgccttgggcgacggcccgtccaagaccacacgaatcggtggtcttctggacgacaaataggaagacgcgctcgtctccttcctgcgggcaaacgccgacgtcttcgcctggagaccagcggacatgcccggggtccccagggaggtgattgagcaccgtctcaccgtacggccgggcgcaaggccggtccggcagaaagtgcggcggcaggccccggaacgtcaagccttcatccgcgaggaggtggcgcgacttctggaggccggattcatccgagaggtcatccatccgaagtggctggcgaacccggtcgtcgttcccaaggcgaacggcaagcttcggatgtgcatcgactacaccgaccttaacaaggcatgtcctaaggacccttaccccctgccacgcataaatcagattgtcgactccaccgcggggtgcgaccttttgtgttttctagatgcatactctggttatcatcagattcgcatggctagggaggatgaggaaaaaactgcattcattacccccataggaacttattgttatacgacaatgcattttgggttaaagaatgcaggtcctacttttcaacgtactactcgaatttctttgggtagccaaataggacgtaatgttgaggcctatgttgatgacttggttgtgaaaacacgcaaccaggagaccttactcggatctagcggaaactttcgaaagtctccgcaccgcccgcataaagctgaaccccgacaagtgcgtgttcggcgtgcctgcgggcaagcttctcgggttcttgatctctgcccgaggnnnnnnnnnnnnnnnnnnnnnnnnnnnnnnnnnnnnnnnnngttntatcaatngtcaatccatggcacat

SEQ ID NO: 10328 - DNA, 716 bp, Oryza sativa
  unsure (1)..(716): unsure at all n locations
gtggttgtnncctnnnnnnnnnnnnnnnnnnnnnnnnnnnnnnnnnnnnnnnnnnnnnnnnnttcagctatttcccttctcatgctgacccaccagaacttttctttgaggtcttggtacattttggtactgccgggatgaatggaatattgagtttgatgagcctcggttagtatcaagtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcatctgcaaccacattagccttgccgggatgataatgtattcccatatcataatccttgatcagctccaaccatctncgctgtctgagattcaaatcaggttgagtgaagatgtactttaaacttttgtgatccggatatacctcacaacggttaccgatgagatagtgccgncaaatctttaaagcatgaacaacttgcngncaattncagatcatgcgtcgggtaagtgccttcatgag

SEQ ID NO: 10329 - DNA, 4217 bp, Oryza sativa
  unsure (1)..(4217): unsure at all n locations
agagtttgacgtangcanncggttcccnncannacannacggcacggngcatgcacacaccgacacgcttaagaatgacaatatgacatgatctcatgcatgtatgacgctccggcgtcgatgttaggagtattaaactggcacttgatgatactttggtagtggtaaatggaaacagaatgcccaacggctggttaccactgcgttcgtggttttgggtttcgtcatccatcttccactacatctgtcgtacacccctagatgaagtatcagtacgtcattagggaaagcaaccaaatgattgagcaccactttaatttataagaaaaatatagaaattttagaggatttcaatcttatcgaaaattttcctatgaaaacctttaaaataaaagattaaataatattttatccttcaaaaatttctatggaactgataatcccatagagattttgaagaaaacttagtaagagtttcaacttcttggaaaatttcctccgatactatctctctcatctgattcctacattttttagttcaattaaacagttattcctatgtttttttctatgttttgtaattctctgttttacatttgtatttctatcaaaatcatatgttttttcctttgtttttccattcctatcattcaaaggggcatacatatgcaatcatacatccattctctcccaaaagataacactcatatatccattctagatttctagatgtctatgccaataatgtcatgtggatggcttaaaaatgttcatggcaggcataacaacggaaaactgtgaccccaggtaggcaatccaaggcgccgcaagcagtacgcaaatgcactcttttttcttctttttttagaagatggaaatgcgtttttttttcccttctcccaggtcaagcacagcgtgctgatgtgctgtggaaaacaaatccgataccaatacaccatatccaggccgattttttcagagcatcgtcaagaggattacagcgtcggttccttccgtcccatttcgtattgtatgtttagagcacgctcacagttaagcatgttccagatttatagtccagtccacctatagtcatttccggatggcacaactgcacaaaattgaaatgggaacgcacgttcctttttaggatttccacactagcatgtgtccacaaattccttgtgcgttctaagctgtagatcgatctgggatattacccaactttttgggaggatgagcaacaatgatttttttttggggtggaaaagagagggatgcacggtcaattggccacaaatattcaacacaagagagatatgaatggtatagtacacccacatgtttcagactggttgacatttcaccggcccggagaaaaaaatcgagggtgttaattaggtggcttaaccgcctaggtaccaagtgcacagtcaaagctgcaactggaagagcagttcgccataagaaaaccgtgtctggtttttaaattcaacaggttgcctatgaaatgattaatcacgggaaccctatccgattttgaatcttggaatggttttgcgtcttttattccagtgctgcagatattttaacggactcatatcgtcgacatgcagctcaaaaacgtttttttatgagagaatgaagcgcgatatgactcttcaacagacaggcaaatgtttacgtgctggaggaatgagagaggtgcatgagttgacgaagtaccaatccaaagtatccaatgaatcttttttaggcgcaagtgtgaaccttggagagcgacagcgatatggttggtacgatggtagcaatagaattgtcaacatatttttattgcctgtttcagcagacgcaaggagatatgcacggggcgaaaatgacatactagaactttcgtacatttttttgtcagcgagaagaaggaagggcgggtgaaacggccttgattttggatagctttttgtgtagtggttgacctgagagacctctcgtagggaacgggtccctttggaaattccaacagccaagtgagaccgcagtagagcagggggccaagtgcagtaacgcttggtcaactgccgggctcctgcctccggctgctggctgctgttgttagagcagatacaatagcaggctataagccagttataaatatattttaaagagataaaagaagagagagaagagcagcgggctacaattctgtagccagctgcagaacgaactacaaaatgtaatgtgtgtatgacaggttggaccagtattaatagtatagtaaggaactattgtatgaattggctattacattggctatagatgatttagagctagtagtggagggcgctgatacgcgatcatccgcgcgcgcacggttagtcgcccccctctagtctcttctcttctctgtatatattatacttatgtatatactatatatacacacacgtatatacgtgtatatatatatatatgaatattttttattgcataaaaatatatatacatatacaaagtttatatatgatgtatacaaagtttatataggacatatacaaactttgtatacgatgtatacgaactttgtatacgatatatataaactttatatacatacgtattaaaaaaataaaaaaacaagaaattgcatcacgtatacaaagtttgcatacacttatacaaactttgcatacgtgtatacaaactttgcatacttacgaatacaaactttgtattcatacatctaaaaaaccgaaaaaaaaaaacagaagagaaaccgaaaaaaaaaaggaaaaccaatctgaacagaaaccaaaacaagggaaaaaaacagccaaccgaacagaaacggaaaacatggaaaaagaaaaaaaaagggaaaagtcagtctcccgcgcggtgcgtccgccgccctctctccacacgcgacacgtgtccagtcacgcgtcgcgcggagaggagcgcgcgcgactgatcgcccaatagccttctcggctagtagtgggctatactattaaacttgctcgtagagcaggtaaaatagcagactataagccagctgtaaacatattttaagaagataaatgaggagagagaaaagcaacgggctacagatttgtagcctgctgtagcacgaactccaagacgtagtgtgtgtatgacaggtgggaccaggtattaatagtgtagtatgtaactattgtatgaatgagctattagattggttatagataaattggagttagtggtgggctatactattagacgtccattgatcagctgattacctcactgcatccgtatgattcgacttttttttcacgttgattttatattcacaacatggctcgtgggctcgtggctttccggtgcagtgaatatatttctcccgatgaaacgaagtcgacgaatggggaaaggaagtccatcccaaagggaaaagtgaagggaaaaagaggagtcacttacggcacgcatagcctaagcttatccaccacggacacaagattagcgtgcagttaatcttcgaagcagattccgtgctcacctgaaccgctgaacgaatatgcgcataggagtaagccaattggacgatccgtgacgcatcgatcggtcggtcggtcagtccgcgcgtccgaaacggagggtgatcctgcccatctaccgcgcccgccgtggcgccaggatttgaccaatcctacgggcgcaggcgcagcagcggctgcgatctcgtcaagccgtcgcctaggcgttgacgggcgcgagcgagcggcctttctactgcgcgcgcgattaccacgcgacgcgctcgctcgctctcttcccgcacgtgttgcacgagacgcgggtggaggcagaggcagcagccaccaatacaaatacctgataacctccaagaccttcgaaagctcgaacacagcaagtgagatcgatggatgcggctgcggtgatgcaaaagcagctcaggcggctccgcacgctcggccgcggcgcgtcgggcgccgtggtgtggctcgcgtcggacgacgcgtcgggggagctgctggcggtcaagtcggcggccggcgagggcggggcggagaatctgcggcgcgaggggcgcgtcatgtcggggttttgctccccgcaaatagtcccttgcttggggtcacgcgccgcggggggggggagtaccagttgttcctcagttcgcgcctggcgggtcgctcgtcgaccaggcc

SEQ ID NO: 10330 - DNA, 2342 bp, Oryza sativa
agcggtggcctcgaaatccacctcggtaccccgccgtccaccggatcgggtacacggacgctgtgccagagattcccgaatggctctccccggaggcgaagaatttcctatccagatgcttcacaaggaacccaagcgaccgccccactgccgcgcagctactggagcacccatttctcgcatccgcctccagcgacatcgacgaaacggcgccgaagcacggctgggtgtcccccaagagcacgctgaacgccgaatgctgggaatctgatgaagacgacgaagtagaagaaggcatgtcacagagcgcaaccaagaggatcagcgcattggcgatcacctgctcggcgttgccggactgggactccgaggatggctggatcgacttgcaaagcgacccatctgaagtttcggaaacaccggcgcccatggtggtgactactgcagatttcggtctttggtgggaggaagcattggacgcggagattgatctccatttcgttgacgtggacggcgatggctatgttacgcgaactgtacgcgcgcgtggtttcattgagtacgacagacaactgagtgtgagagttcgcggtgatatgccgttgtgcccggttgattgccaccggagcgacactgtaaaattcggttgtcattgtaacgggaacagagtaataaatttcgagtctgcacaaatttgcctgttgttaccattcatcttgcaatcaagggctcatagattgcatagcgttgagctcccggtaaaaacttccgttttaaaaaaaaaggccccggcaaaaaccgttcaaagaattggtttaaggctgattctcactgttttgactagaatgagcaatttttaaccgagttgacatctttccaccaaaactttagaagtttagagcatggtcattcggcctaaaataatatccactaaatttcttttggaatctttaatcagaatttatggactataaaatatatactacttctttgcaaaagatatcctaaacttaacaccctaaaaaatagggccacctcaaatctctcccctcctcctgtgttttcgcgactcctctctcgtgatctcgcacccctccttccgtgctattaagaattggtagcaagcacattcccacaaaaaatagataacaagaagtccagtataagggcaactagtaagcaaacccgtgcaaatgcacacgacacttatttatttttctataagaacaacactgtaaaactaaaatagctcatgaacttttattacaaattaccttgctataagcatcgggaaaaaaagagaaaggagttgaatcttctgaatgacaaagtttagaaattgcctttctacaagcatagaaaaaagaggaaggatttcaatcttccaaacaacaaaaatgcacatggattcaaacataaatcactgccagtactgctccctcctcaaaatatagcacatattaactttttttcacggtctttaacattatagttgaatattattgtaaatgtattgtaaaaataccacttctatggttctaccacttaaccggataatgccgacatgatcctgcacccagtgaagtagactgcaattgccaaatctttcttctctcgtgcggtgaagccctagtttgagcattgacacactccttgagatatactcatgtgctcactcaagttcctcgtaaacacacccatcaggcccttcacattggctcgcttcaatcttctccgatgatatgaagtccaagctgatccaccatcgatatggcagttgcccttgaaacctacacatgctagcttcgctatcaacagacttcccgagatttttatttatacaccaattcaatctccaaaaagacacatcaatctgattcgttgtattggcttgcctaagtgagattttgacataattcttcacatctagcgcatagtttcttgtagtcccaccctagaggactgcattgtaaaatgtccaattggctttgccgctaccgcaggcctcccattgggctcacctcagcccgactattcacacacctgcgatacctacgtaagctatccaagttgtgttgtacatgcgtcaatggggaccattggggacggacaaagagaagagtctgagagacatagggaagatatggaagatcaagaattgagaatatgcagtggtatcactacgtggaagttttgagtctatatgtgatttagtagagacacaaatttgtactacgtaaatagtaccactcaaactatcaaattttgttagtataggtacatttttttctttaaatatgagtgtacttattattgggtaccgagctcgaataacaacactt

SEQ ID NO: 10331 - DNA, 948 bp, Oryza sativa
tggttccagagtagaacacatgatctaaaccgcataatacctcctcacccgccaggatgaggaaaaaactgcattcattacccccatatgaacttattgttatacgacattgtattttgggttaaagaatgcaggtcctacgtttcaacgtactactcgaatgtctttgggtagccaaataggacgtaatgttgaggcctatgttgatgacttggttgtgaaaacacgcaaccaggagaccttactcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctggacggaggaggctgaacgggccctcactcagttgaaggcgtacctcagttctcccccagtcctggtcgccccggagccagatgagcccgtgctactctacctggcggcaactccgcaggtggtcagcgcggcgttggtcatggagcgcgacgaggacgacccttcgctccgcgcatccccaccctgtgtcgactcgacccgggagagagcagggaggagaggcccccgagccgaacgggcggcccgaggccccccgacgaccggagctggcccctctgccccgctttgtcccgacctggtgtggggccccccacccaggcgcccccgacccccaggatgcccccgggccactgctggaaggcccgggcttgtcgccttccgaccccgaggtcgtcgacacagaagct

SEQ ID NO: 10332 - DNA, 738 bp, Oryza sativa
  unsure (1)..(738): unsure at all n locations
gatgggccttggattgcattatanaacctcattnnnnnnnnnnnnnnnnnnnnnnnnnnnnnnnnnnnccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaattccataaacaccttattcatcaaattcatgaagaaggcaggtgcattagtgagttcgaaagacataactgtgcattcgaacaacccgtaccgagtgatgaatgctgtctttggaatatcctttcgcggatcctcaactggtgataagctgatcgtaggtctatcttagagaacacaatagcttctttccactgatcaaacaggatcattcaaaatttcccccccttcttggccaaggatacttgttcttgatggtgacctcattgagtgcgcggtagtcaacgcacaatcctttggttttgctttcttcttcacaaa

SEQ ID NO: 10333 - DNA, 1342 bp, Oryza sativa
  unsure (1)..(1342): unsure at all n locations
tccacccctatactcgtaaaggggactaccgtctccccaattctaaaactgacatcgctaccgtccgcctcctctccccccccccnccccgccggnatgaatgcaatccctagccgncgcgacttagaggaccccagacatctgcggtcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcgtcccggaaggcctcactaacaaagtagacgggccgctgcaccttttgtcggggccgatcctcttcgccaggggccgcatctatagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccgtcggacaagcgggcagagggccagctccggtcgtcgggggcctcgggccgccgttcggctcgggggcctctcctccctgctctctcccgggtcgagtcgacacagggtggggatgcgcggagcgagggtcgtcctcgtcgcgctccatgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttgggctcaatgccctcggcagagatcaagaacccgagaaagctttgccgcaagcacgcccgacacgcacttgtcggggtttagctttatgcgggcggtgcggagactttcgaaagtttccgctgaan

SEQ ID NO: 10334 - DNA, 775 bp, Oryza sativa
  unsure (1)..(775): unsure at all n locations
aacacaattattcaatttactgccagatttcacatgggaaggcaaccactgatcattgtgcgaatccggagctgtgcaagaaagtgggcgtgaagaaatcaagagcattccaattcgaagcatgccctcccccattgccaattctcctatccataagaaagggttgttcttcataaggtagcatcgagagtggattctaaactctaagaggggacattactccgtggtttacatgtcatccaaatagttatgaaaaaattgaaaagatttaagaagatagatcattgcacaacacatgcaagttaaaattcaatttctacgagttgcagcagaaaaagcaaattaaactttctagttaacgtatattcgcagttaaatttattttttcattacatcttgtataagttaaatgtgatcttgcatgtttgtaaagtgatttatcacatattaatctatcttattgatttttttctaagtttttcataattatttagataacatgtaaccaataaaggattgtctcctccatagtttagagtgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaatnnnnnnnnnnnnnnnnnnnnnnnnnnnnnnnnnnnnnnnnnnnngtatcacttcaacgcgg

SEQ ID NO: 10335 - DNA, 736 bp, Oryza sativa
  unsure (1)..(736): unsure at all n locations
gcgggtggaatgatatnnnnnnnnnnnnnnnnnnnnnnnnnnnnnnnnnnnnnnnnnnnnnaaaatactcgatgattcctcatcaattatccctttgctttcctttccttacttatgccttagtttttagatgtcaaagggggagaagtatattaaagggtataaagaattattataaagggtgagataattgtgagaaattatcaaaatgcatgctttgaaagatgccaaagggtaaatgagaaagggagagagaatatttgaaaatgtttatcaattagcgtgcgcatggtgtgatggattcaatgcgtattatttgatcaccatgccacatgcaaatgaaacccatcaatagagcgacgagtaacagcatttcttctgttagaattgttgctgccggtctctgcggctttcaattttagaaagcatgaatcacacacacgatgtggcttgcctggagttggtgctagagcagccttcaacacttttcttgaactgcaagcatgacaatgaaccagcccacagttgtagcaatcatgtctctttctagtgaaaccaaatgcttgcctgcaacccgtgcagacagattgatctgcacctgatacccacttatgtatgcaaatacatgttgtgaaatttgaaccacatgatatactcttgacatgccgatctttaagtgcttcaacaagacatggcttcttcctgtccttgagatcgccatgaccaaggtcttcat

SEQ ID NO: 10336 - DNA, 733 bp, Oryza sativa
  unsure (1)..(733): unsure at all n locations
agcgtgatgatgtagactcttcnnnnnnnnnnnnnnnnnnnnnnnnnnnnnnnnnnnnnncagactgaggtccgccacatcgaagttcacccgctccgtgcggaagttggcggaaccaccgaaggtgaccgggaggtcgatatggcctagcggccaagtgtgccccggcgtcacaccgatgattggctgggacgaccggagcaccatccccggggccttgatggcgtcaaaggcagcgggggaaaggatgttgagggctgcacccccgtcaacgaggacacgccccaacttcacattgcaaacggtgggggaaaccaccatcgcgatctgtcctccccgggcaacgcacggtgggtggtcggtctggtcgaaggtgagggcaaccttcgaccaccgcgcccgccgcgtngnctcatgggtaggggccacggccagaagctctcgcttcatggccttgaggctccggcgagaagcgtgagcacacgctcccccatcaacggtggcgacagtggcctcaggctcctggaaccctaggtcatcgtcgccatcgttgatgtcctcggcggggccttctgcttggcctcacctcgccggntggccgcgggagccgcncgggtattgccctcacggngctcctgcctncctttcttcttccacttcctgtncgctcagcaaacttttgaccgcgcgggaatccgcgaggtcctggaaggaggtgttgtgcaacgtgcac

SEQ ID NO: 10337 - DNA, 738 bp, Oryza sativa
  unsure (1)..(738): unsure at all n locations
ctaatttttatttagggtctaaaggtttacttagcctccattctgtctcaccctgtgtatcgtctatataggcttatatctattcccccccgtgggngnctttatacatctgtagccccnnanacaggaaaaacagattgggagaagttgccatcacgtaatataccttaactttggtaccacacggggttacagcgttttgcatttattcctgactcgatatattattctatatgaatcataaccgaaagccttactctttggaacttgtcgcctgcgaacaaaaacaatataatcataccagagaggggaaaatcctatcctaataaaccctatgtcaatcgtatttccaataaaatttggtatagataagagcaactcgtgattccactcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggc

SEQ ID NO: 10338 - DNA, 915 bp, Oryza sativa
  unsure (1)..(915): unsure at all n locations
gcattttccacccagctagaggcccatacggtttacaacttcgctacattgataaaaaataaacaggggcataaacaagagcacactcttaagattgtgctacaaatacaactattcatccttgctacaaaatactagcaatagccccctcatataagttactcataggacagatanaacagtagataatctagccataagttaacacaacagcaaggcatgaagatgcatcacacttatccatgcccctcatccaaaaaacatgtccaagtccaaatccatgttatcctctttatcatccatacttgttccagaattttgttgatctccacctttccaagagggattagacagcaccacacgggtctgcttcttgtgagaaggcgcggtcaacacaaccccttgtcgtttcaggttaccctttaaacctgcagccagcaaaatattaagtgaaaaccggctcaatgacaactaaacagtagctctcatatatatatatatatatatatatatatatatatatatatatatatatatatatatatatatatatttcataaataatttaaaagatgaacatttaaagacagttgatttgatactttatattaatcttgtttaaactgtgcatatacatggatatatgcggagtaataaattttattttataatatagaaaattctactttaaaaccgctgttctattagcatacagcatagtatgttttttttctggctttatagctgtagatacgtatgtttgtttggttttttgaagtgaacaatacatatgggtaatatccaattatagtgtacgttaacttttctcgtgaaaatttctcttctatatatcggacatnnnnnnnnnnnnnnnnnnnnnnnnnnnnnnnnnnnnnnnnnnnnngaatcgaaaca

SEQ ID NO: 10339 - DNA, 779 bp, Oryza sativa
  unsure (1)..(779): unsure at all n locations
tatcgccttgctgctactagccactaccccacgaagaagaagacacgggatcccatcggcctctttacgttgccatagtaaggagaggagagaaagaaagagacaagagaagagggagaggaaggtggctggcaagtgggccccaattttttttactttttccctagtcacttacatgtgagccccacttctaatttgcgacaaggctgccatgtcagcacaaatgaaccaagtcaacctgccacgtcagtggaaaccactcttataaccgctgagagtcaaattgcaccattttaaatagttggggaggagggggggggggtcaaaatatccgatattgcggttgagggatacgaatcatattagaactatattgagggagtcaaagtggacttattctagtttacaatgcatttgtgcaattgtgcaagcgtgctaaaaatatatccaatggatcttaagtcctaggtgctgggatatggcccaggtttcttagggcctagtccacccttggtccttatgacataagtcataatttcttccaccatcttttggaggcgaagtggattccagttgcgaagtctctgacgagccgcaaaagacaatgagctgaaagaactaattgtttgagtatgcattctggcaaaaattttatttaaaactttttgagctttaggccttagcngcaaacatgattcataaatgggtttggtatgcctgttttttttcggtttttggattcacaattctactcttgtggacataattctctatttttg

SEQ ID NO: 10340 - DNA, 799 bp, Oryza sativa
  unsure (1)..(799): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcagaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10341 - DNA, 1478 bp, Oryza sativa
  unsure (1)..(1478): unsure at all n locations
tctagcgccantatncgagctcggtaccctgatgtttatcacagctgcaccaagtttgggtagtgtacggcgtacctatatcgatattaatcaacagtggtgtggttctataaaagcttgaataattatgttcggctatttgaacttttcacgtccctttctcgctttagattaatcatgcttcttaagtactctttacaatgtgaaataatgaatccccttttcatccaatacaggggaattgcaaggcactgcaattatcttggggatatactgctagctctttcatttagcttaccctgtggaaccaggtgatgatgatcgttcgacacaactctcttattcaatttgattctcataaaccctaaatcataaacccttttggtgcagttcggtgatcccatacttctacccaacatacctgttcattttgctgatatggagggaacgaagggacgaagcaaggtgctcagagaagtacaaggagatctgggtagaatattgcaagcttgtgccttggaggatctttccttacgtgtattaaatccaaatattttgcctagcagttgcatcgttgtagaaccaagagcgttgttgtgctatttgaacatgtaaaattcaccaagattcctgttgtttatttgtagctgacatccgtgttgaatatcaattaacatagattttgttgaaaaagaaaggaactatgtcttgctagctagtttgatctttctttttccctaccagtctagctggtgaatactgaccgcattgagggcggtgagtgaacctgcaaagagctgaggcaatggcggcgactgtaatattcacgttggtttggaaaaaagtgcttgttttttacatctccgcacccgtacgacggattcagaaatctccggttgatcattctgttattcaaaatatacttatatagttattattaattttactgagatttaatttatcattaaagttttatttaaatatattttttatatttatatatttttttaataaaataaatgatcaaacgtttatgaaaagttaatagcatcatagaattcagagcttttgtgttcttagagagtttttttattgctgggaaaagacagaggcagcagctctgccgtttgttttatcctctcttcacttatatttagagacgaagggagtactgcgtatcatatataagaacccttaattgactatagctctagtccaactttggtccgttgattatgaaaccatttattttttccccaactcttaaagtcgttaattttgatccttgatgtcaaactaagatgttttctgagatgatgtggtgccatgtagcatcttagttagcaatttaaaatgatcaatttctaggattaagcagaggcagaggaaaaaaattagtttcatgtaggttgtaggnnnnnnnnnnnnnnnnnnnnnnnnnnnnnnnnnnnnnnnnnnttcaatgnnntcaatcacac

SEQ ID NO: 10342 - DNA, 627 bp, Oryza sativa
  unsure (1)..(627): unsure at all n locations
tgtgggctannattgattgcgatcctgctcccnaccctaaaatttgagaggggtccagggcccccactgctaatacgctaaatccgtctctgcccgggcacagccgtgaccgtggccggaaaggggagatggggagatggggagaggggagaagaatatgtaggggggtgtgacatgtggagcccacgtggacccccaccattttttttattactttgtgtctaaaactgacatgggggtcccacggggtttaatatttttcatattgagttgccacgtcaccgccacgtcaatgccacgtgggatgaagacatagtcaaaagagccatgtaggcgccacatcggccaaaaccaccctccatactgtcgagggatctcgtttgtctggttttcgtaagttgagggacgggtcgtatccggttttacggttaagggatgaaaatcggactgaccgacaaatagagggacctaaagtgaacttattccaaagagaaaagcccaagtaaatcactgcgcagtccgagtccgagcccaactaaaccacgttctaatctctcctcctccgagtcttttcggtttggctcgatccgctttgccgcaacactaaaaaagaaagaaattccttan

SEQ ID NO: 10343 - DNA, 612 bp, Oryza sativa
  unsure (1)..(612): unsure at all n locations
aaggtgctnctgntattcgagctcggtaccccgaagtactaaacatagataaaaagaaaaactaattgcacagtttgtatggaaatcgcataacgaatcttttgagcctaattagtccatgattagccataagtactacagtaaccccacatgtgctaatgataaattaattaggcttaataaattcgtctcgtggtttataggcgagctatgaaattagttttttttcattcgtgtccgaaaatgtcttccgacatccggtaaaccatgcgatgtgacacccaaaaattttcttttcacgaactaaacagggccttagttttgtttttgtccaaatggctgtgtacatctggtttgaataggagagggccgtgttcttaattatttttagaaaagaaatcattttttctaagtcaattttgttaaacattgaccgatcgagtttatgacagcatgcaccaacatctacaagatcagaataattttattattaaattacccatcaaagatattttgttaatgatatatattgttataggtgttgggtatattttccataaacccggtaaacgttagataagtttaacttaagataaagctaaaataatttaa

SEQ ID NO: 10344 - DNA, 612 bp, Oryza sativa
  unsure (1)..(612): unsure at all n locations
tgtgtggntcantatacgagctcggtaccccggggcccggcatcttcatctggaggtaggcgtagtggaccgccgccatgaacttcaccaacgcgggcctccccaggaccgcgttgtagggcagactgaggtccgccacatcgaagttcacccgctctgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctcccctggcaacgcacggcgggtggtcggtctggtcaaaagtgagggcaacttccgaccaccgcgcccggcgcgtcgcctcatgagtaggggccgcggccagaagctctcgcttcatagccttgaggctccggcgagaaacgtgagcacacgctcctccatcgacggtggcaatggtggccccaggctcttgggaaacccagtcatcatcgccatcac

SEQ ID NO: 10345 - DNA, 37870 bp, Oryza sativa
  unsure (1)..(37870): unsure at all n locations
tcaagggctgccccatttggttactttttgccccagggcggcatcaatggcattccccgccatgggcctctttatctttaccgatggcttttccttcgcgggcctcgtatcagagacaatcgaaggcatggtggtggacggtaggcgcaagatcgtggacatgctatgcgattgccataccatgccggccgccagccgcgccgctccctgttgcacgtcgttttcccttcaatcnccggtggtcctctctccctcggtcaaaacacgcaagcaacaaaggagaaaagagaaaaaaaaaagagaagaaagaaaagaaaaaggggggaagagaagaggctgacatgtggggtccacgtgggtctgatgtttactcagctgccacgtcggaaccggagttaaaactgcctaaagtgattcggttttgtaagattagggatgccatatattagttttgtatttggaggacgattttataatccgatgacaacataaaggaccttcgatatactttttccctttggattagctcggttggacctggcccgtggaatatttaatttgctaaattcttgatattttgcaaatgaattttgaccacatttacctatacacatgcacatcctacccctatgaacacatataaaagacgattaaggaagtcaccatcggtgagcacctccgacaaattgtgctagaatattttaagattgacgaaatcactataggtgcctccctaactacacgtgtatcacctactagctactactagaaaaataattacccgtaaatataagcacccatatcaggtgaaatggttttcatcacaagaaacctaaccggttaagctagcatagtctatttgtaacattagcttttagactactactccatgaattaaagttgtatccatgatttgttcagttgtctacggctaccaatcgggaactctaacctagcatagttgatttttgagtaaattgcaccaacggtctttaaacttgtaagtgggttttacctagttccatgaacttacaaatcacgcattgagatcctttaacttagtttattgtatcattcaggtccaaagacttatttgaccatggtcttacccacgtggtatgccacgtggacaataacatagcaaaattttcccttttcacctttttttttccttcccctccttttatcttcttcctccttcgttccccttcctttcttatctgctctaccgatggcgacggcgaccatttgcctccagcacacaaccaccgtcacccgttagccagtgtctgcacaagagggcacaccacctcctgttgccgcagccgggtccgccactgagaccgctcgtgacagcggccttgctcatcgggagccagtggcgggaggagctcaccggcctaccggagaggaggggaagagaggatccccagctgcttgaggagcctcctgagctcagcctcctcccaagccccacccttccgcttgtcatcgtcgtgggggaccgcagccgacgaggccatggcgcggccgtccccatcgatccgctatctccgcagaggaacacggctgcattcctattcgctcacatcaccaatctcggccagtgtcagcagcttgggatgcccacggcctcctcgatggcctccatggtgcgggaagaggggagaggaagccggcggtgaggatctcgaggccacgctgccgctccacctcaagaggctagcccgccacggttccatctggtcctcatcgctagccccacacctcgaacgagcgctgatgccacttgagtagatttgaagtgggggccgtcggatttgaagaagcaacggcgacggcagcctccttgaccgccgacacggtctcgtcaacaacgatgggagagagcagggagctcgcggttgtcatcgtcagctccagcctcgagccttcactccgctgtcgggccaaccccgccaccggtggtggctagcgccatctctctcgctgctgcttgcctgccatcgccgctgatatatccagtggtggaggagtggtggaagaagagaaaagaatggggaaaggggatattttgccaagtcatcgtccacgtggcatgacacgcatgggcaagaccacggtcaaacgaggttttagaccggaatgatacatacaatgaaccaagttagaggatctcaatgcgcgatttttaagttcatggacctaggtgaaacatgcttacaagtttaaggaccgttagtgcaatttactcttgatttttcttctattattttcaaaggttaattggatctatggcattataaaattgcaggtttggaaaaataccattactattcataaaattgaatgcatgtcattacaatttaacatacctttgagatgtaccattgcttaccccttcgttgaaatttccattttctgactaaattgccctcatcttcttcctacatcatcttcttctcctttctctctctctcctatcaccacgttgtctcgcacggcatcagggcgtgtgacggcagtgcaggcaatgtgcatcgcaccgtcgttggccacggcgaactcaacctcctcaccggagggtgttgggtggagggcggcaggctaggatccaaaagagagacgcgcggggagaacgtgaaagagaagcaatgactggagtgagttgaggttcctcggctcgagctgaactccagggcaccagcaacggggctggtcttcgaaggggatgtgcaccacgagtccacgatgactccgtcccctggtctctcgatgacattccatcggctccgtgctagtcaatgttgtcgtcgccctccatggttgctcctcccatgggatgactcatctttgatgtcaccgtcgctagggcaccatctcccacggttccttccccgttgtcatccacctctgcctctccacggatcccgttgccctccatcggtcctcatcactcgaatcccaggctacctcgaagaccgaatatcgggtcccaaaactaatgacttggatccgactgagattaatgtatcaatccctggatcagtaaatattgatacatacaatatagctggttcttcattgcatacgttaaagtttacaatactaagggttttacaataataggtactcacataattaaacataagtaagactattacacagcggaagtttttatacattctaactagggaggtataacctctcgggattttctaagttatcagggtcatcatagtaataatcataggggtcctcctcttgacccaaatctgaaaaaggggttataagagaagggtgagtattcacaatacccagcaagttaccatggaaacatgttatgcattggtatagagtagagttctttgcaaaaggcaataataaacaatctggaagtattaaagcaaaagtttgtaaatatgtagactttaggtttctaaccagggtaccatatgagtcccggtactcaattccgcgagtacagctattcgaatagtttcataaatattctactgcagcagatgtacgctttacccgcagtccacgacttgccaatattcattagcttagtcatggcccagtattaggttattaacaattgtggtacctgttccatgaacttatatcctcatacgctctgaatgtgacgttaacagcagcgagaggagttctggcgttcccggggtatttaaggggaactgatcatatgacaccacgtcatctcgatcagggtttagaattaacattatacttataattatactcgagtatcacaaaccatttacatgtacatggtaatggtgaaattttcccttcgcggctatagttgcctcctgctcgaggacttaaaaataaaaataagaaccactatatagaggtaccgcattgctaaataacataataactaggtctgttcccattctagaaactgcggtcgtacccgttcgtttgacataagtacctggtagtaactatatcgatcgagatagtactatccacctggaaatcatccaattctaacgtattgtcccaatctaagtgtaagatattttaactagattgtaagcaaaataagcaatactaaattatctgggtttctataattaaattatgcatataaaatagagtgttgaatagaagagctataaataaataatttgtaaaatacaggcttaaatgatcaaaaggtaaatagtaacttgacttgcttgatgtcttgagattgactggtattatctagtgtgtcagaagaatcctcaacacctagggttagacatataaaattcaaattcaaaatggattcaaataaaatccaaaaataggaaaaataaaataaaatagaaaaataacaaaagtgtctcaaaagataaagaatgattttagaagaattttggtccaagtttcattggaattggatctatattttaaaagatatggacttctaaagtttgaaaatcaaactaaatatgaaatggcactgtgagcgggtcccacatgtcagtctctctctctcttctcttcttcaacctccagccgttccccaaatacagccggttgcgctagggttagggatttcggcggtgatagagggggaaaggggttgcggccgaggaggggaggtagctagggttctccggcgacggcgagtagcggtggaggggttattttgatgtgtgggtgggctagcggctagggcggcggtgacatagataggccgtgaaggtgatcggggtggtaagagttaagcatagctcaaggttggttcctagagcatctaatatgtacttggaagggtttaggtagcttgccgaccttcggcaaggtgtggaatgcatctgccgacgagcgcctccattggcggcggtcgagctcacgttggcagccaagagggaagtatggcagtgcaaaccgattgcaaaaatggactctagggagtatgtagatggttaaaacggaagaactcaccgagatcggttgaaacaacggattacggtcgaaaaaacttcttggcggcgaagaatagagcagagcaggggcggcggtgctcggctcagtgcgacgaggtgaaactcgatgcaaagcttcggttagggtttagtatgctagaacatgattgaatataggtgttctatgaattagttagggtggagggtggatggaggggcatgaagtcgatcgcgcacaaggtgttcaccgacgagcggaagtggttgatggtatggattggcaaagtagagcttcggggttgtggggttatggttgatgatgatcgatgatggacaagaaagggattggggtcctatttatagggccaggggaagcggatgagctcgggcgccatcaacgccattaatgagctcagaaattaggcatggcaggggtggcagagggctgtgagagggagggcaagattaatttgagtggcgggaggccatgttcgaattcttactggcgaaggattgacttgaccgcgggtgaaaacggctggcgacgtgttggcgccaatccgagctcgacgcgcggcggcggcgagggttaaaatggtcggcacggcgatggttggtttgaattgtgataggggaagccgtcgtttatcttcaatctaaccgtgcggcaagacttggcgcgattcaccccgggtagaagcaaactcggactcggcggcggctttggacgggcgtgcacggcgtcgagcggcggtaacttgcggcggaggtcgtcctaacttcgtcttcatcacgattggtgcggcggcggtggtctgagggcgtcgaacggctagcggcgcgccaaggcggtcaggcacgcgcgaacggccccgaagccgacgcgcggcggctcggcatgcggcgaagtcggatgccagggtagcgcaatcaaaggagaggagaaggcaaagtgaaccatggtttttgagtgggttgtggtccccaaggaccaaatctagactttgcaaaggatttgtgaacagtgtttttaagaaattttgaatatttctcctagaagagaatgaatttaatcataagtttggaagggtttcactagggttttagagtatagcaaactctcactaatacaagggtaaactaaagaaataatctaaagtttgaaatttgagaaaatttgctcaaattcaccaaggtctaggataaggggaattaattagggtaagttaatagggttctaaagaagtaatacttgaaccaaaataaagatcaaaagaaattcaaataaacttttaaattttactaatctagtcaaaagccagcatgatgctgtcaaattttagtttaaaatttaaggatgttacaccgaatctatggggctcatcgatggggaactcgagcgagagaaatgtttccatctccgtcccccaatggtgctcgtcggtggagaggatagtgcaaccattccagtggaagagagaggaggggtgagatgaaaagagaaatgggtaggaggaagaaaagaggggaggaagaagacgatgtcaatttgatttgaaaaatttagaaattacggtgaaggggaaatcgatggtatatctcgaagacctgttaaattataatggcattgtataattttgtaaatagtattgatttttttcaaacctgtaaatttatgattatgatgacacaattaaccgtaatttctaaaccaaataatcgcctatgattgggcgcctatctttccttacctcggacgcatagccggtttggcctttttttttttttacccccgctccccaacggctagtttggacgcgctgtccagtgtccacgctagaagaggcagcccccactgacgcggcaatcatctaaccgtccatcccgtgatcgagcgcatccccccccccccccccccccgggcatccggtttcaaattattttgaatcccaacgggcaaaccaatcatcgcatctgcatcctactacaagccaccgcgcggccgcctcctcgccgtggtctcctctcctctcacttgtctccttcctcttcttcgatctctctctctcccctcaaccattttgatttcgatctcgccgtgaagcagcagaggagcaatggagatgctgaggcggaacctgaagcggcaggcgtcgcggtcactctccgccttcgccgtgtcctcgccgcgggcaggcgctgtcgccgccgccgacgccgaccaggagaacctccacccaaacctggccgccgcctcgccgccgatgtcccccgccgccaagaactcctcggcggcgccgggcgcgtcgccgcggtcgtcgaagcccgtcccgaccagcgctgctcctccctcgaaggccgccgccgagggggagcaggcttctgcgcccgccaacgaggcacccgccgtgaaggtaaagttcgccggctcgccggaaatccctttcctaccaagttgtgagcctctcctgatgcgcgagaggtcgtgtgcaggtggtggtccgggtgcggccgacggtgagccggccggtggacggcaaggatctgttcttcgtccgcaagacctccccctgctccgtcgccgtcggcgatcggtcgttcgccgtcgatggcttcctcgacgacagagcctctcaggtttgcattattcccattcctccaattccaggtgctcttgaacgaatcctgtgatgaatcttggtgttccctggcaggcggatgctttcgatctgattggcgtgcccatgatcgagagcgccctcgctggattcaactcctccctcgtgtgctacggccaggtacctcctctgattcatccttcctgttcagtttggagttatgttttttttttcttctttctgcgttactgcttctgaaactttgcttttgtgtgttggaattgtggttagagcggcacagggaagacgtacaccatgttcggtgccctcgcggccatggttgacagcagctcagaccacgccgacaggggcgtcgttcctcgcgtcttccagaacctcttcgctcaaatccaaggcgtaaggcattttctgccgtctggttttgtagaaatttgattaaacctgtgatttccttgtggtctcaatgctgttctttcctggtgcagaggcaagagagctcaccggagaagcagacaagctaccaatgccggtgctcatttcttgaggtgagtagtgactcatctgctcgttctcaattgaactgaaaaatgcatctatagatgcgtgtttttgttttccctgaagttcagcttttaaactatgtttccagatctgacatggtgcaaattttgctctatgctttccaggtacataatgagcagattaatgacctgttggatccatctcagcgtaaccttcaggtatattctaatcttgagcaagaaactaactctgcatttggcgtatgcttatggattgcagtaaacttatccaactccgttattttagataagagagaatgctggcaatggtatccatgttgagaacttgaccgatgagtatgtgtcaacggttgaggacgtcaatcagatcttgatgaaggtatgatcaaaatgacttccacctcactgcattatctgtctacttgtagactgtgatgctttacagatttgttcaggaagttgctgcactaatttgcagatttctgtcagaaaacatagctagggatttgtagcttgaagtcagcattatgtgaaaaaatgttggaagttatttacagctatttacatgattgtttcgttaagatccaaaacattttgcttagctggtgctaacttatgggcactggtcaagttgttccgaaaatcatctttattcttttatggcacggagttatccaataaaaccaacccaagaaattgcttctactatacttcaaatcagtgggacaattttgatctatgttgcttcacatcagcagcagaaagaaattgtccattctattttgcttttaaaattagggtttctttgcttttcatttcacctctgcatagatgagtatcacaaccaggacttctgcttgagcttgtttagatcgcatatattagtacttgtatcatgctcactcaaaactatttgtttcatgttgtacttctaacaactgaaccccactaccttctcctccagaattattgattgcttgtctgagcttgcttttctttacagggcctttcaaacagaaaagttggtactacgagtatgaacttgaagagttcacgttctcatgtgatattcagttgtgtcattgaagcatggagcaaggtaaattaaacctctcttatttcttctgttatttggagacctcatagccagctatatttaacttctattattgcaataataatgtcagtattatagcatttagaaaatcagtctgctctttggtctattctattctgttttttaagttcactaattgatcagcaaatatacatgttgtcattatattgggaatttactttgttcaaccaaattacagggtttctcaaatggcttcagcagctcacggaccagcagaattaccttcgttgatcttgctggtcctgataatgatgaacttgatggtggcaacaagcactgtacaagagaagaaagatatgttaagaagtccttgtcaaagcttgggtatgtaaatttataagatggcttgtttggcaggaattttgatgtctcatgaaaattcatcagtaaaatttcttcaatgtttctttttcatgttcaccgatttctccctcataatctgtttgcatatagtgataattgctttctttggagaaatatattataaacatatagtgataagaataaaaacatgtagtaaagcagaagactgacttacattgttacttcaggaaactcgtcaatattctatcagaagcaccagagacccagaaagatgactctccccacaagcaatcctgtttgacgcatgtgctgaaggatacactaggtggaaattcaagggttacattcttgtgttccatttcttcagaacacaggtattttctgttcattaccttatgtacttcactatgccatttacattctcttaagttgacatagagtcctgtgactggcaaatgcaggtgcagaactacaactttaagcacgctacggttcggtgagagagcgaagctcatgtcaaacaaggctgtagtaaatgagatatcagaagatgatgttaatggtttgagcgatcaaatacgtcagttgaaggtatttcctcagcagcagataaaagtggcaacaatttacagacacttgctaattgttctatcacttgcaggacgagctcatacgaacaaaatctggagacactgaaccctgcaagaatgggtatttcagtgcacagaatgcccgtgaaagcctgcataatttgcgagtcagtctcaatcgctctctaatcttgcctcacatagaagttgattcagaggaagagatggatgtggatgaagaggatgtacaagaactgcgtgaccaaataagaaagcttcattcctcatctgaagacactttcgatgacttcatggatgcagagagtggtgatgacactccttgctctaaggggaatccaaaaacaagtgaggaagatgatcagcctgtaatagatgattgtgaagacccgattcaggaagagcatgaagtgttgtccagtacaaaagttgatcaagaccttgtgtctgacaggaaatcttttctatcagttagtgcctccccgcacctgtcaccaatgcaagaccctacgttatgttcttctccaaagattcacaacaaggctagaaaaagcattacctcaccagggctgtcaccaagcaaacttagtgtatctgattgtcccggtgatgaagtgtccagaaaaagtgcagttcgttcttctttacagtcaagcaagcttagcccaactgattcactggctgcaagtctccaacggggcttgcacattatggagtaccatgaacagaaccaaggcccaagaaaatcatttgttggcctttcatttgatcattttgcactgaacccccgtcaatcagttgcaaaagtcagttcaggagttctggcatcaccagagaggaaaggagcaacatcttctgctctttgttcatcctgcaaaaaagcgatcgacactgatgggaaccaaaaagataatataaatgcagaaaagcagattgtaatagccaccagtgtggtaccagaagttaaggtatattacgtgatggcaaacttctacccatattcttgtttttccatgtactaaaacattttcttcatccaggacgacatcaccgcatcaacaattgcttcaaagagacagactgaacttgaagctttatgtgaagaacaggccgataagatcaaggagctgagcaatttggtacgaagcatggtgaactaaggaatagtatgcttcaggcatgataccatttcctgacattttcaatgttacattgcaggttgaccaatataagaagtgttcagaagatgctcaaaattcagatggtacggaacctacaaaagaactagtggatgaagccaaggttggtgaacaacatggtgagctgaatgtgaatgacagggaagaacttcttagtgaaattcagaggttgaaggatcaactgaaacaacaagcaggtgaatccacaaatgtcagccttctggaacatttgaggaatggcagcacagaccaagaatatgagctagacagagaaagggagaaatggatggagtctgaaagcaaatggatatgcctaactgaagagctgagagttgatcttgaatcaaatcggatgcttgcagagaaaacagagatggagcttagcaatgaaaagaagtgcactgcagaactggatgatgccctccaacgagccatctacggccacgccaggataattgaacattacgccgagctccaggagatgtacaatgatcttcttgagaggcaccgccgtgtgatggaaggtatctcagaggtgaagagggcagctgccaaggcaggcaggaagggctgcgggacggctttcgctgctgcccttgcagcagagctgtccacagtgaggattgaccgtgaaaaggaaagagcgcagctgaaagagcagaacagaaggctccgcattcagcttcgcgacacagctgaagctgtccatgctgctggagaacttcttgtaagattgagagaggcagaggaggcatccacacaagaaaaggtttgttcaaagacacagataacaattcaatttgcttgcttaaactatgttctgctgaacactacaagtacacagataacaatttgatttgctcgctttggatttgcaggagaggagtgcagcgatgcagcaggagaacgacaagctcaagaagcagctggagaagatgaagaagaagcacgagatggagatggagacgatgaagcacttccttgcggacagccggctgccggagtcagcactggggggattctaccggcaggagagcgaggatgtaccggagtacaacaaccatgccacttctacatgcgacgatgatcaatcttggcgtgctgcgtttacatctgcatatgaatgagtctgaatgattgcttcgctcgaggatctgtcaattgagcctggttgacaattaggaaacgcgcttttctttggtctatttcttatgtttgttcaggtacaccaatacgaatatatgattgttattcaaatgcccttctggttgggtaatatttgaaccaataactgttgtatgagaattgtactttttttgtcatttgtatctcattgagtttgcatacttgttgattctcttatggttgcatacgttgtgtgttgtgccctgtgagataacaaacacttgtgtagcaggttaaggattatattgtagaaagtgctgagcaagagaagaaataaaacttcttgagaaccaatatgagatttgaattcactgagtaactgaaactttgattgcatcatccttgatgttcatcagatattcagactgaaattcaactgtacaagtttatttcaagaactggggtgaaaaggttgtactccctctgttttttgtatttgacgtttgctaattcaatttaaaatggtagggggtactacaatgatcaactaaacggaataagtttgctccaagatttcttgagaaaaacctgaatcgtcaacttgtggcctatgaagttgcctgctgcttcaactgtggtgatatgcagtaatttctttcagcaagaggtacattgtagaactgtgccaggtactccaaagcttcatgattcccattgcaaaccttccaaagagatgctacttctcccggagcaacggttccccactcctcgcagtcattcagaaagtccaatagtttggagtagtaagaatcataattgaggagcaagaatgggactggaagcgtggaaccgatccgctccagttgaattagcgccatcatctcgaaaagctcatccagcgtccctatcccaccaggtaatgcaatgatggcagttctatcggtagggcagttccgcaccgcggcatcaactaacccatgcttccttgcagagaagaacctgaaatccaggagaatagcccaaattgattcccatgcatgatgcatcgatgacacacactcaaatcaatctgaagttaagcgaccgcgatccagctacctgcaggtgagatatgactctgatggcaggtaaggatgaaaattggaggttgtccattcacccgcctccttgccaatcttgaagccaccgaccggtttgcccgcctcaagagcgccttgggtggcagcatccatgaaacctggaccagctccggaccatgtggtgcagtccagcagcctagctatctgttgtaatgtgatgaaagttcagcatcacttagacatacagatggtcatagcaatcgcacgaaatctagtgcagcgtgatgtttatctaccagtttgttgaccaatttacattagtgtgtttctggcgaaaaggccgtgaaaatatgcatgaataagataagatgtaacacaagcttaatgtgtgagctgaaaagattagggtggtgtaacttgcaagagacagtaaaggaagaggaacagctagcaaagtgcttgcctcccttgagagctcggcggcatggaggtaatggggatgggtgggcggcaccctggaggagccgaggtagacggcgccacggccgaggcggcgcacgagatcgaagcacctcgctatctcctccctcacctgcacgggaccaaccaatcaatcaatcgccaaaccaaggagaaagaaaggacggtgacctcatggggactgctcctctccggctccatggccgccgctgccacagcctcctcatgctcatgctctcctagctgctgctgctgccgcggagaatttgcggcggcggcggcggcggccacggctctctccctggggggccgggctccgctgctcctacagacgagccgcggggccgcgggccatggcggatgcaggggcgagagggaaggagagcggccgtcgctgggcgttaacgaggagcgcgccagccctagcccggacacgagtccggctaccaccgaactcggcgccgcagccgccatggccccttgaagaaaccgtacgcctgatccccaacgctggcaactttgcctccctttgcttggctgttggtactgccaacatctagtgaaaagtgagcaattgtaaccaatgctacagagctactagcatccattgccagtttgccacacagctaagcatcttcctcttgcaaccgtcaactggatccactgccacagaggtatacgatccttcattcttcctagttgcaaccgaattccaatatttcccatcaagagtacttagttagcatccttcgttcttacaagttgcaaccaaattccattatttcccaattcccatcaagactaggatcggtaggatcatactactgtgctacttcctacatcccaaaatataaaaaactgaacaaaataaaacatttcctaatactacgaatttaatactacgaatttggacatgctaccttgttatagccaggatttttttgaaacacatttgtttatacacatgcccctggttataactgataatattattttggaacatcttccacataatgtgcataggagacgaaatcatgggggaaatgcacattgcacaatccatctgaacattcggttcaaaattctgattaagctacttcgaatcttcgatgcactagtttccgaagtaacaccggatagtagtgccaaaaaaaaaaaagtttcaaacaatacaatgccatactgcgtccaaaacttttccgcaacaggcatgctgtttatgcagaaccactagaaagaaaatttgccccaataaaattggcagggcgatcttatattcttattctacttcatgttgaggaatatgttgttcaacttgtatctcccaattctttgatgaattgatccttcagatagctgtttgatcctgccattcttcgtgccatcagatcaaactccccaccactcctacaagccagaatggaacaaacaattaataatagatactcacgctgcctgattctactatgacattgactaaacagtgtaacttacggatcaaaaacaaaaccaccagcttcccgaagaatcagagctccagcggccacatccctagagtgaagaattgacaataaaatatgtttagatagtttatatttttcataagacactgcatttgtagtaattaaattaatcataccaggggccaccaaatccaatctcataacacaaatcaagcctaccacaggcaactccacacatgttcaaggccaacgagccacacatccgtatagatctaatctgaaataatgaaatataccattttagtgcaccgatctgttgaactataattgtatgtcatgaaaatattggtgtataacttataaggcttaccttgaatagtaacttgttgattctgtttgttgtatcatccagagtggccttatctcttttggttccaacctgctcaattggcacaaggttattgatcaaatattttcactaatattatgatgtaaaacttttatatgaaaatgattcaagaaatagaaactagaactctcatttccattgtaagtaaatcaagtttcagaatcaatgaagtttgtcactgatgattgatcaagtacgaaagaggctcacaagaaactaattgcatccagtgtagcatgtgttatacattcatattgatatatcaatatgaattggacagccccaggaaaaaaaagaatatcacactccaacaggaagcccgaaatgggcaacttagccaatgtttaagaatcaattaatatgttaccataaatatttcaactattgttttaagagataatgtggtattccacaaaatccagttgacatgattagattagtatttaatcgataaggttatggtcatctcaaccaacataattacttgagtgtggaatattgaattaaatcaagttggaatggatcacaaatcccaaaaacattgagtcacatggagttaacttttggttagattgtgtccaaactctttaaagttcagaaaataataatattttcaagaatttctttcgggtctgtatgcaggtgtgggggttccaaatatctagatgaaatctccatgctagttcaaaagagtgtatgcatggtcatgtacatgctgtcagtatttgcatcagtaaagcataagctatacatctgctagaaaagtagttgtgaaatatcaccattcaacaagcaaagtgcacgttaacacgatcaaacattgttcgatgatgttttctaggaaagacagtagcggccaaatcttaagctattcagaagacggcttatactgattagtgaaatgaagcaacaaaataatttagaacaacatggttgagatgaaatcctattgatttttctacgcatatgcatcatcaatacaaattaaatttctttacatgtaataaaattgactcttgatggtatcacttacctctgttaccagaagagccttcaccagctcgttttgagatgaagctgctcagcagagaaggaaactgtctaagttcaatatgttgcttctattgaatgtcaacacatcaggacccaattaaccaaaatatagcacttacttttgattggagaaccattgaggaaggcaccttttccacgaacagctgtgaaaagctaaatgaaaaggtaacatgaaattagactacaaaactaagtcggcatatgaacaataagaatataaatcctatagagacaaataagctgtgatttttacatattggtacatagaaggaaatagcctatgtccttcaatccaattgcgatgtaaatgcttcacatgtcacttttacctcattcatgatggggttgtacacaactccaacagtaggaattttcccgacggtgagaccgatcgagacgcaaacaaaagggaagctgcaatgtgattgacatacccaatgttcattaaaaaaaagaaagaaggtggtataatggggatagaaacagaagctaataattacccatggacgaaattggtggtgccatcgagggggtcgacgatccaggtcgggtcgtcggtgaggtccgcggtggcgccgagcgccgcggacgtctcctcgccgatgaacttgtggtccgggtagtgcttccggaggtggttgaagatgaggtcctcgcaggccttgtccgtctccgtcaccaaatccacctgcagttgcaatgcagccacggtcaccaagaaaccccaaattccaatccagggcaaaccaaactccatcagctatggggaaaaggaatgcgatgagatcggtggaaccgtggaagaaggaagagagacctggcccttgtgctccacgttcttggtctggtagaagcccttgcggatgatctgcggagaagcaccaggaaatcaagaacggacaaggaaaaagaaaaacacgaggaatcgtgcacagggaggagggggcaagggaggaatcgagtggttcaggagagggcatacctcgccggcgttcttggcggcgtccaccgcgacggcgaggaactgctcctccgccatacgcgctcactcccaatctatcccccgccgcggcgattagagagaggaaattggttggtccttcgccaacgctccacctttcggttgtgtagagaagaaaattgagcttggggtatttctggaagagaaagctctttccagcctatttttcagttctcttggaatcaaaatctggaaaggaatagacgattatgccctcatcatagttccaacaaaaaccgataaaatttgaacaaaatcttatctaaaattttagtttgatttttttatttgaccgataaaccaaacggtttataaaccaaacggtttatgttttcaatccagtgtaatccagaccgaatttcatcaaaattataaatattgttccccgcttcctctctctctcgccaccttcccattgtcacgactgacctcatcggttggctccttggactgtagcatgagatgatagaaaagcttatgctgataagcatcagcctggttgtgctgatatgcaacagcatatgccaaccaatggtggcccacacctttttcaatgagtctctattccgtgcctacaccgataacttagaagttccttgattgtattgatgtgtgcactaatccattcttgctgcatcgtcggtttagcgtagtctcattgcttgcccatatagggcatgaagccaaggttgaaagagtcgcaattaagaaagctctactgcaggcagtggcaacagacgatgaaggatataatggcctctattcctttctggattttcattaaataatagaaaatagcagtcgcatgataaaaacaagttatacgcccatgattgatgtgaactatgtggtgtctcgagttaaaaacataaattcttttacattcgaaatatcggtgatagagctggtgatgatgacaatgtcgagaataagagtggtcaatttatgctgagttcgtttatcagtgttcccaacccatctccctcattttccgcacgcatgcttttcaaactgctaaatgatgcgttttttttgaaaaaaaatttctatatgaaagttgcttaaagaaaatcatattgatccatttttttttaaaaaaagctaatacttatattaattacgcgttaatggactgctccgttttccgtgcggaggacatgtgttcccaactatacgaaacgaacacaacattagtgatgtgtagactacgatagcatatatgggtaattttagtcatgtgtaggctcgagactcaccatcatcgtttatcttaaattttatcttaagttagagatttttggtacaccaaaaaaagtttttattttggtaccaaaccggtaattcctggagttcaccatctaaaacatttctggaaactaaaactgccaaaaagaaagaaaaaagaaaaggagaaaaggtttggcgctgcgctttatttcacggattgtgctttgcataggtatcttcttgcgaatcttccctcaaagcaggaatccttctacacacctgacactaggcatattctcttgttccttcagtactccctccattccatgatgttactttaccagtttaactttagaatgggcatcgcatgcggttctcttctacttgctccatcgataaatcatcgcttttctcaagacatccacaatggtatggatatggcacaaactaaatctatgctgaagagatgccatttggtattttgggcgacattgtgaaaataagcaagatggatgagatacagattaattatcatgcgaagttcagtacagtcaacctcctatcctattattactatttttgtggacccaagtttcaaaactccatgcaaaaaactatggtagatttgcacatggatgaataaaattagtcttctatcattgtacatcagctgaaagaacggacatataaaaacacataactgaggtttcatttccataagccacagaagaagagaccagaacagggccagtcaagacgaaattgatccactcctgagctaattatctgttcagtctcacagcgatctgtttccaatctataaaagtcgaatgacagtatctccattggccatattgcaccagtttgaagtgcacgatgttcctatcacaagcatcgtttggatatatctcttcactatctttgcgataagcacgggctatcacggttaagggttaacaccccaagtcatcagctctggtattctgatgcactcaagtactccccgttctcctcaaagtactcaaccaagcgtttcaagaatttgtcgttgcttacggtctctacatcgcacactaggcagcactgccttctggctcgtgttacagcaacattcattcgtctatgatcacttaagaatccgacctgaaatttgcaaatagataaggtttccttagtatccaggtaatataattgtgaattcttatttcagtagttcaatcagacagtccttttattttaaaaatgatatttcgtccttatgtcaataatgagatattttgcatggcatgcacatatatctacagatcgttcacatcatatcgatactgattcgctctattctattaaacatttttctaaaataagttgaagtctccccagatgctaatttgatggatcaactgtgcagcagcaatcaaatcctcatccatgtataatattcatgtttgtaaagctgaatattttacataggatatccactcaccaaggaggatcatggaagggagcttacctctttctttgagttggatctgaccattgaaatgatgatggcttctttctccctaccctggaacccatcaactgtcgatatctccaagtccttcagtttagtatctttgtttctcatcatcttcagacaggttacctacgggattacaccattcaatgagtcagtcctataaacttcaacatcatgaaggagccaacccataagtcctataaacgtttattttgttttgttttattaagctcatcactgtatattgatttgataatattcagagcatataggagcaaacctgtgcagcataaggtgtaattattccaatatcagatgcacggacaccactctcaacaagcagcttggcatgagcaatggatactgcagcctcaccctcattcatagtgctctcctcctcatcttttacttcttccatgtcacacctaaatgattacttgagactgttagaagtgtatctaacaaacattgatgttggtcatcacatcatttcttttaaaaaaacagatatcttttattcatcagtcaaatgatggctacaaatttgaagtattacttctgcccaattattgtcttcaagtatgagataaccctttgaagtgaattcggtagtcctatcttttatagaggaagccaacactcttttatagaggaagccaacactattgagtgagggaaatatagaggaagccgacactcttttatagaggaagccaacactattgagtgagggaaagaaagcaacgagggaagcaaaattgccaaggttcaagttcaacccataaatgactaaaagaatgaacacattgaataggccaagcattggagaatactaacccagtagtgtcaattagtatgatagtcggctctgtggaagaagatcttttcacttcttcaatgtcatagagcatatgatcagcaacactagaatgagctttgatctaagtacaagaaacaaagaaataacaacatgagaaaagttatgagctttgatctaagtacaagaaacaaagaaataacaacatgaggaaagttatggactaaagagagaggctgaaaacaagttactaataggtggctagtgaaaacaagttactaataggtggctagtgtaaaaacaccaatgggaagtgcaccttgttattataaagttctttagatgaccaattcattatgagctcatgcattctgtactggatagtgagcatggatgtaatttgatctccataagcttcagtaaggcgttcaaagagtgtctttcccatccccttcttttcagcctcagcactttggatagtcggaggaagttgaagatggtctccagcaagcacacatcttggaccctgcatacaaaaacaaaagaactgaggagccctatgacagatctcaataagtacagtatgatgaccatttaacctacgcgctgtgcatgctgaatcatgacaaacacaagcaatcaaataggtgatgaaattgttcactggcataatcagagaagccaacttgtggagtgtgaaggagccccacaggggtcatgagaacttgttagagtttacatacatccatacaagattgatagaatgaattcaagtacgtgtaaccacctattgaaattaagtttagctatcttccaaggaaatcatttagttttcccaacttctctcataatccttccttttgctctaaaatggacacctaatgcagcatctcgttctcattataccatgcacttttaaaattgaacccgtgtgatcatgctcaactgctggcttggttaagacatattttaagcttaaagttaaaggtgggagtttgtgaaacagtacatgctatctttattgtgctactcaaaaaagcataaataatacgagaacctttgatgactgtttacagcaatcatcattctcaaaacgtgcagcaacatgaaaaaaaaaactagtcataagttagtattaaccttcaataaggctatccaacatgccatctcaagtgcctgagcagcttcatcaataatgaccaaatcaaatgtaataccatctagctttttggaagatgcaccagtcaaagtcgacagtacaacatctgcattttttatcacatcagcaacagcaagctgttgtcgttttctctcttctttggcaagggttctgagctctttcctgatgtccctttttgtattcttatccttagctttcagcaatttgctattaagcacctaaaagatgaaaagagaacaaatcaagaaacatttaactacaatggaaaacattattgaaattgcagtttcattactatcatctaaacatgacagcttctaattagatggttcctgaaatgccaaaataatatgccatgtaaagcagggtcttgccatttaataataggaacctaagaattatgtagtaaatgattaccttcatttctttgcgaatatctcctgctaagctgctgttatctgctcgcaatacctggttcattagaaatagtaagcagattaagtacagttaagttatgtgaatgcatgaatggatcatagataatacaggtggaactgtaattcataagaaaatctatcccattttaacttgggcataaagagaatgtcatgcagatgttacagatgtcacataaggcgtaggcgggtacactttaacaaggtatttgaataaatataacagttgaaaattgaaagagacaaagcaactctgatgaaataattatggaacataaccttcatgaatatttatcctaataatcctcagtagaggagaaaaggaagcactcagagtaagctatacctgtgcgtcaagagcactgtccaacacttggggtagtaatcgagcaggatggcctaacctcaccaatttggttctagaaaaatgtcaataacaacatgtcacattaaccaatatcacatcttttattttgacaggatagggagaattttctcagttattattggttgaatgaggtaaatggtcaacattaccaagatagatgggggaatagaaagttcgagttaaaaaggtatttcaaaattttgttagcaacctatatcgggagagtcgctcaacaatgttatccacggcgatgttagaagcagcacaagcaagaatctttgatccacgtttcacctcctgcaatattatctcaatgatagttgttgtcttcccagtgccaggaggtccatgaagcaagaaaacatcccttgacctgagggccttcgagatagcatctttctgcagaacaaagatatgggccccacaaaaaggaaatttatttcatttgaatacatattgaaactggtatttgaaggcgatacaaaaaagaacataacaagtagatatacatggtaaagacaaaaggcatcaattgtaatttttttatttttattaaacaatcaatttctagcaaagaaaataaaaaatgtggaggccaaacaccagtgccagcataattagctgtggagttcaccgaagcaaaagcaacaccattaacagaagtattgcaaatatatgctactactcaggatgaggtcttccaaagccagtattagcaggtgcaagaattatatgtaatcgatgacggtgttgacacatttggttgtaagttgtaatgccaaaagtgatggaatgtccacagtctgaaactgcaggtgctggtgttagcgttatttgcctagttccatatgttcttttattttcttaaaatcatgagtgtctgccattcaataaatttcagatcttcctctggtacttaataagttaaaaatacaaattctactgatacttgaaatagtatcagcagaacaaagtgattgcactggaaaattctattgtagatcatactgttctgataaatttctccaggccccaagtacttatggcttctcttctccttatttagataagaacttaactgaaacataattatgcaacaagccaaaaaaaagcagttgaaaaaaataaatcaaattgtaacctgtgactcatccaaattcttgttaaatggactgaacttcgcaacatccttggaactcataggtgggttttctccaaacaaaacaggaataaggtttgctgaagggcctgtttgaatgcccttactaagttgaactagtgcatccttcatcctgcggtatgtcacctagaagagcattaagatgcaaaatttagggtccaatgaattgtaaggcaatgctggaggacaaggggcaataatgaagatatatagaaatacatacatggagataaaaaaaaagcaaagaggaattatgatacaattatactattatggttacttggaggctataaaatttctaatcagaaagttgtaagagagagcatggaaaatatagtagagaagaaaacagtaatggaatgtcatttgcaaatagtaatgaaaacagcatggaaaatatacctcatttgcaagcttttcaaggcggagagggctatttaatccatcttcaggaatgtcatcaaaggcaacagtaatggaagaatcctgtttgttcaaattacagtcatttctcctaattcagaagcaaagactttaaatagtcaacagcccttagatgatagttaggtaccttcaagcgataaactacaccttgcccaagagcagcagatccagcatctgccttatttggcttcagagcaaccacatcgtgtgttccaaactagagaagaaaaacataagtgggcattagcaatggtgaagtaaaatacaaatttctttgaatcagtgtccggtaaattaagaaacatgcatgagcttttcatgtatcaactcctgccaatctcaacaaaatcaataatacacgtgatgcaattcataatgaactttacaaacgaatctaatatttcactgaaactatcagttaacaacaacattacttgttcacaattactaaacaaatggcagaaatactgcaagtgtgagtttcgacggcaatacctgaagcgacaattgttctgaaacaaaccgctctcacataccacaaataaattcctaaccagaattttatcacagcgagcaataacaacaatacgacaggagggcaaaggtaacctcaccttgtgaggtggaagcacgtcgcccttgttgggttggaactccaggagcgtcttccccatcagccccgtctactctacgcaccaagcaggtccaacaaggccagaacaagattagcaccacgcctcgatgacacattggcaccgatgggcaagcaagcaagcagcaaaatggaagcaaatcaacctgggcgtcggtgcacttgaggttggccatgacgcaacccctcctctcgagggtcttcgagctcgtcgccgactccgccgatatctccgccgcctgcgcaaccacaccacagacgcgtcaccacccaccaccactaccatccgttccaccttccgaaccaaacagcgaaagaaaagcgatgggggatcggagtacggaaccttctccaggtctatgagaggcgccatggacgagacgaactcctgcagcgacaccatcctccccgtcccgctcttcccggagctcccgccgccgccgccgccactccgccccgccatggccgctctcctcctctcactcgtctcgtccacggcgtaatcgccttgcgattcgcccaagcaaagcgcatttcatgggccaggcccgcgtagtctaatccaggcccatttaaagcaggtttcgtgggcctagtccatgtgagaaagtgagaatccagggctttttattccgtgacgtcgcggcggcggcggcggcagcgtcgcctaaccctagctaaaccccccttctcccttgcgcctccgcttcgcgagcctcatctcctcgatctctttcgattcagtggaaaacctaggagaccggcgcggcatggcggagtcgggctcgtcgggcctggaggagaagctggcgggtctctccgcgggctgcggcgaggagccgcagcagctctcgaagaagtgcgctttctcatcgcgcacgcagccggcatttcttcttattgtttttttttcctccgtagtgtggcttttgtttaatatgagttttgtggcgggtgcagtgccaagaagagggaggagaaaaggaagaagcaggaggaggagcgccggttgaaggaggaagagaagaagaagaaggtgaagcagtttgaacttcttaacctttgccgatttttttccagtgttgtttttatggagcgagttttggatgcgttcatttgtagatgatgccaatgtgacaagcaacactctttgctcttgttagatacggatatacctctgcagctagggtgtgagaaagagttttccatatcatgattgctaagctctaaatatatatacacccttttttaaaaaaaattttgtaggccgctgcaacagcagctgctagtggagagcccccgaaggaatctgccgccgacgatgaggaaatggatcccactgtatgtgatattgatgcccctttggtgctgctgtgctatttgttgtattgaattcttttgtttaggaaaattcagacatgtgtttcttgctgcagcaatattatgagaatcgcctcaaggcacttgattcactcaaggccacgggtgtaaacccctatccccataagttcctggctaatattaccgtagccgattatattgagaaatacaagagcatgaatgttggggataagcttgttgacgtcaccgagtgcctagcaggtatttttcgttctctttgactagatatgatagtgtagttgattagagatacatttgggtgggatttgtatttattattattttttattaaagggaggatcatgaccaagagagcgcaatcttccaagctcttattttatgatctttatggtggtggtgagaaagttcaagtttttgctgatgccaggtaaaactttgtctgttcaactgtattgcttaccttttatgccatttagctggtttgttcccagacactttcagcatttcactaaaatctcactatgtgcagatatgcctgactaaaatgcatcctttggttaattttcatatcagttaaatctattttttaatgttggtgaatttcataaagtttgtatcagttaaatatatttttcaacattggtgaatttcataaagtttattgccaaagaattctcactgcaactttataaacatatgctaggccatggattgtgatgaatgtcatagatttagagcaaggtttctgtagcttattatcttcctgcaaatgtgtcaatagtacgccgggtgctactcatgcttggcatagctggctacttatgtgtggtccgtattggcaataatcacattatgcacaaaaccccccttcttttacatagttgggttttcttcttgttttgtacatgttaatgcttagaatttttcttcttgttatttttgcatgctttcccaacttgggtaatatgcttcatgattatgcacataacagtatgtatgcttgtacatagtaaaagtgtaaaatacacgaggttgcatacaatccatatctcataaagtctgggggcttgctgacttgcaattttctattagttataatgtttaaacaaacaaaaaggtgcattcttttttgttattttgactaacggttctgtggctatcgttgttatctagtggctatcatttcgctcatgtttaagtactacgccggttactgcctactgttgtcggtctcataaaaagtaaactaatgatttaactgattttacctgatataggacctcagagttggaagataatgaattcattaagtttcactctactctgaaacgaggtgatattgttggtgtatgtggttatccaggtttgtaagcatctattcaagttcattttgaaattattacatagtcagatgttccaacatcaaaattaagtaggtacttatattctttcagttggaatgccaataggacattttgagtacatggatccttatctgattgagtttgtaattttatttaataaataacttaaactttatttgtagcttatgcccatacttgattgtacagtttgtttgttttaaaacaattaggagtataaatagtttgatggttactggaaattcttatattgttttactgtgtctgataatgacgacttctcaattttgatgaataccaggaaagagcaagagaggggagctcagtatattcccaaagaaaattgttgtgctctccccatgccttcatatgatgcctcgacaggtgagaatcagatttttttaggaagagatgtttccagatgatatacctaatatctcagagcaatttacttcatattaatctgaacttttatatttaaatctgtacatactaacatagagaccataaaataactagagttaagtctgatttacccccatcccccctctctctctctaactatagaaccggacatttgacacccctaaaattttggaaccgtacgaattaccttcctaaacataatctaggtggttttgtcctatgtggcagacaggtggcaataatctgaccatgtggcaacccagtcagaaaaacaatcaattgtttttaggaaaaaatatgttagcccacattgtcatccacctagttgtcttcttccgcccattctcccatttctcacattaggcatgggctgcaaactgccagatcctttgcctcgttagtctcagtgctccttgcttcggaggaagtccatggacaagcgcctcaaagcagtgctccggcctgcttgagacggccgagcttgagtgctcgacgggacatagcagcgctggcaccgcctcgcctccatcagtgtgcccgtgcaacagttcgtggtggttgtggggagcatatgtttgcccctgccggagtatgccaccatggcagctgcacagcagcaggtgcagctagccgccactgccagggagctgaagcaccagcaaggacggagacactctggctccgaaggccgtggagcggggacgccggggacggcagcttgtcctccccggctgtctcatggtcgtcacagaccacctccgcttcattacatgtgcgaatgagagagcagctttgatttcttggagtttttttttttcaaagagtgatttttcagaactatctagcttgattacatgtacgtatgacaacaaccgtcttgtggatcttgagggctgcaggtgagctagtgcttacacaggcttgggtagagattggaacagaaaggatagaggaagaagtgcatgccactgattgctgggtcccatggagagggagaagcatgttgctgatgatgcacctcctccctcatattggactgtcatgtgtgatagctttagatcgaaaccacctaaaaaagagccccaggggggttaagtatccggattgaatagtttaggggtgtccaatatctggtttcgtagttaaggggggtaagtcgtacttctgtgatagttgagggggtaaatcggacttgacccaaataattatgactgaaactaaagacattttgcgtagcgatgccttctctttttctgggtgtcacatacacattagcagcacaagaaagcacaacagccattattctggtttgcagaccccagacaggtcatttgattaaacccacaaatgcacctcatatttgcctagcttcttttctcaagtgcaatgcaatacagacactcactcacacctgtttatgcatttgttacgtgctacgcattctaggactagtagaggcatagataaatgcataatttgtccatcacctcatggagtatgggcgtgtcctgcacttgcatgtgtgtagtatatagtgagccatgcttgcttgacttgatgctaggattgaacgttggcattttgcatgcacgattgaactgcaaaacacccaactgctgagtccagcatgccaagcttctgagatatcaaaatatttcgtgtacacccaaccattgaccctttgctttccttccaagttcttatgctaattatatttgttgaaatgtagtctacatgatcatttacatgtattgtatacatctttacagaagagtgagggaagtgctgttcccactccatgggctccaggaatgggtaggaacatcgaaaagtatgttttgagggaccaggtttgttcattctccgtataattattgattgacctctcttgtctatgtaaatgctaattactgtgagttctttgtcagcaagtaaatacattgtcggtagtgtgattaatcataattaacaaatatctaggcggattttaaggttctggatgtgcatatgtgatccgctttgttgtatgcacaacaaaatcatttaaatttagattgaggcagctatgcaatttagtgcaaagttagattcaggtggatgaactaatcatgggatcagattctatctgaacaagtggataggtggcgcatgtctagtccattaagagagatttgcaatgttcttaaaattagtgaactcatttgctgacatgaatgccatatttggcatgctaatagaaatctgtccaattttattgactatctcatgcattcattctatttaaaaatctgcatttctaatttacatgagcaaatcataaatttggtgcaggttgctttaagtagcttgatcactcagtgattatcaattatatatctgtcttgttgcctttggtgcttagtagcgatttgattatcaattgtttgtcttgtgatatcaggaaacccgatatcgtcaacgatatcttgatctcatggtaaaccatgaagtgaggcatattttcaagacaagatcaaaagttgtctcttttattcggaaatttcttgatggtcttgactttttagaggtgggcctgtgcaatctattctgttattcttcttttgtatattcttccagtccttcaaatctgaatattctatgtcttttctaggtggagactccaatgatgaacatgattgcaggtggagcagctgcaaggccttttgtcacacatcataatgagttaaacatgaggctttatatgcgtattgctcctgagctctatctgaaggaattggttgttggggggctggatcgtgtttatgaaattgggaagcagttcaggaatgaaggaattgacctgacgcacaatcctgaattcacaacatgtgaattttatatggcatatgcagattacaatgacttgatagagcttactgaaaccatgttatctggtgattatctcttgatgtctctgaaacatcttttttttctttttattttaggaagtaatagtatcttcatgtcaattttgtatgcaactgcaaaatgacctaaatgcattttccttgttccgtaggcaattcatgatttgctattgttctgtcatatcatttttttgccgtcctatcttgtttttactgaaatcaacatgaagcagcctgttcattttatctaatgatctgattttatggttgacaggtatggttaaggagttgacaggtggctacaagattaaatatcatgctaacggagttgagaaaccaccaatagagattgatttcacacctcccttcaggtagagacattgggatgtatttggattacatgtattgctctatatgcacttttaactggtaatgttcagttgctacaatgttactttgcctttaccttgctgcagaaagatagacatgattgaagaattagaggctatggctaaactcaatatacctaaagatctctcaagtgatgaagcaaacaagtatttgatagatgcctgtgccaaatatgatgtcaaatgcccacctccccagactacaacacggttgcttgataaggttgtttctttacccactacacattctttttacactgtattttgatatgattttcgttaggtgattttgctatcttataatatcttatttacatatatgataagctagccactttgatatgaagaagaatgtccggtgtaatcctttttgttgcttccataatgtacagtacatttctgaacattttcacattagctcacaaacaaataaaagatctggggtatattgcaaaatccaacctgaagctatttgcttaaattttaatataccttttgcttttgtttcccttttggtattccttagccaaattaataaggtatatgctctgctctaacagctagttggccatttcttggaggagacatgtgtgaatcccacgtttattatcaaccatccagagataatgagtccattggcaaagtggcataggtctcgacctggattgactgagaggtttgagctctttgttaacaagcatgaggtatatactaagtcttcattgatactttcatacttgtcctcctttctgtttccttacagtgttatgaaatccattttttaggtgtgcaatgcatatacagagttaaatgatcctgttgttcagaggcaacggtttgaggaacaactaaaggtacttgttagattttgtgaacatttgcaaattgtatatttttctttggtaccagcctgctcccaagcttcgagttatttttggtattttggaacatctaaatagctttgcatagtatataattgttggaaaccaacctactcccatatgtggtatattttggtccatcattttaaccagcgtactcattatgcttgggagttttggatccatcatatatatacacacacttgtgtttgcattgttaaaagtagtggtaagtcattggaagggtgggatatgaagtgtcaaacagacaaacagagtatggacccttacaccagtggcagatttattgttgcatggtgtttccctagcttcctatgtggcttgctgaaaaactgtacatgttcttacgtatattatgtgccaggatcgtcaatctggtgatgatgaagctatggcattggatgaaacattctgcacagcccttgagtatggcctaccaccgactggtggttggggattgggaattgatcgccttacaatgttgctgactgattctcagaatatcaaggtctaattatttcttcatttgtacttttgttcctggcattttttatttggtctttattcagttgaggtatttaaaatgctcttttgatgcaaattcaggaagttcttctattcccggctatgaagcctcaagattagatatgtccacaaagcaggaacctgtcagaagggtacgtccatatacttctatatcacaaagtaattctttatgttttttgcccttttaagcatttatgaattttcatattgtacatgttctctaaaatgttaaatatccaggacaataataaaaaccatgcacttttttagggctagtagcaatgtagcattatgcgtataacagaactttgtaaagctcagggtttcatgcgcttattcaatcagcactgattcaattgtgtcgaactatggtcataaatgaatgaaatgtgcctcactattttcaacataccattatgtcaatgtttggttgggggttgtgtcgaactatggtcataaatgaatgaaatgtgcctcactatttcaacataccattatgtcaatgtttggttgggagaaactatatttgcattggacatgatttaggatgcaagtttgtctattgaatggtatgtgaaacatttcacagtatctcgttccaaaagaacaagtactgtaaagtttttttgtcatgcatctgtagattttggaaggaaaagactggaatatccctcaactgtagaattttgcccgccctttgtcaaatgccattgtgctaactgtacttctatgctgcagattaaagcagactgaatgctgactgagaggatttcaattggccctcgagatggaggatttgaaggaaacttataattttgttttaattgtgcatgtgaggtttccatgtcctattgtactttatttttggagaacattggtggtcagttaagcaaacagttaatctcgctgcaaagatatcaagcgtaacttataagatgacttaagtttgtgcaatttctgtggccttacttgaaaatgatagcgcgttatttgcggtcttgaattttgattgattttggaatgggtggagctggaaagatgatgctacgttgttggaattttgacgcacaattccctgttcagtaaattaatgtttatttctgcaaaaccaattgatttggttggagaacattggttggccgactgaagaatgtcgaacgtctgctccggtcagggaatgtgcaaattaatcgatgtgatgctgatagcagcgacctgtagtattgcagcctctcatctttttcttatgcttatcagctaaaatttaaatttttaatcttaaatttggagttgattttgaggttgtttttatcgaagtttattttttaagcctttgcttttagacattacgaacacatataattacaaatatgttgtttagcttatttcccaaataagtggaacgtttggggctgttgatcttgccagcttctcacgtagtacactacaacatatcacgcgccaataaaaggcttaggccctgtttagatgggactaaaacttttaagtccctatcatatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattatgcttaaaaaatttgtctcgtgaattagcttttatttatgtaattagttttgtaagtagtctatatttaatactctaaattagtgtctaaagatagggactaaagttaagtccctggatgtaaacaccaccttattaaggagaatgagaaatcatattggataaaagacccctttttaaaagattcgtgtatttattcaatatagatgtatccatgagtcgttgggttcattactgtaagataaactagattgataccccacgcattgttacaggattttatggtggtgataaacaactttgcaaatatatgcttacaaacagaattgaagaatggaaatatcaaaagtagacattcaaaaataataaagtgtaaagttggcatttgagtagtagatggtcaagggacatagcagtggcttaaaccactcacataccatgtataaaatgctaattgaagaggttctattaaagagaatgaagttagtatataacactgtgggagcttgtagcagttgcacctttaagagatgtgaataccacaaatgtactatgtataaaagatctgttaagaagaataaagttaggtatatagccctgtttgagagagtttctatcagctatagcttcttcaagaatctacatctcctcaaaccatccagatttttattcgaaacttgagaatatggagcctcaacaagacattaatttgtttttgctaatttcgaaaaagaaccccacaaaattctgaacaaaaacatttgaaatgaacctcaagatctcattccaaacttgcttgagatgctcgaaatatgtaaaatttgagtgagatctcatgaaattgtgaacgcctgatgggatgttggagagatagatgagtgcttgggtacgtggacagggaggggaaaaaaagagaggaatagttggtagttcatatggatgcgcacatcctcacccttgttgaggtggaattcacttctatgtacaattgcaattaagctctatatcctttccaattaaagatgtccaattccaatattcttaatctaaatgttctaccttttgttgagtggaacatagatgcttcatcggcagagaacaaatgctaatcttcgtatgtccaactagcaatcttttgtaatagcacctatacatggttgttgtaatttatgtcagtgatgatatactgatctccactattacaatattctagtatatatgcaaatcaggatcagtcttaatcagagtgttctaattaattaatactaggcctttttgagttaagtgaccaccctataaaaggccctcaaaccaaccaattattttactaacacatttggtttagccataaaaagtgttaactgtttagggcacccgcaatgattatctataggctctctacaagagatccatgtcagcatatttttctacttggaagagattaaatgaagagagagagcaaaactatctactaacctggagatagtctatagagaaaaacgagacaatggattagagagctatagataccgttgtagacataccattgaagtggtttactattaatctagtctattgctgagatgtacatgttttatagatagcaacttactttaccattgcgggtgctcttaggataggttattaatcataacaaattattcgtgcacattgattaccccaaagtctataattgttaatacagggaaggacttgcacttgcttttctgggcgtggggacaggagaaaggtgccaactgccaagtgtagtggccggagaagtggagatctcatttgtcggtgcagaacttgtggtgcaagctccatccgtagctagggccatagaaaaagcgttcttgtccataattcgatcccagtggcctctctgacacgcagcacattgcggattcgcggttggctctttccttcacggttacgaaggctgtctcatctcctcgtggaaaaacattattcagcgtgtgttttttggtcctattattgatcgatcatgcagctcgcatcacggtccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtnccgagtngnntngcagtgcaatcaacactct

SEQ ID NO: 10346 - DNA, 623 bp, Oryza sativa
  unsure (1)..(623): unsure at all n locations
tggcntgannattganacctgtacatcngtgctcggtaccctattattgattttgttgagattggcaggagttgatacatgaaaagctcatgcatgtttcttaatttaccggacactgattcaaagaaatttgtattttacttcaccattgctaatgcccacttatgtttttcttctctagtttggaacacacgatgtggttgctctgaagccaaataaggcagatgctggatctgctgctcttgggcaaggtgtagtttatcgcttgaaggtacctaactatcatctaagggctgttgactatttaaagtctttgcttctgaattaggagaaatgactgtaatttgaacaaacaggattcttccattactgttgcctttgatgacattcctgaagatggattaaatagccctctccgccttgaaaagcttgcaaatgaggtatattttccatgctgttttcattactatttgcaaatgacattccattactgttttcttctctactatattttccatgctctctcttacaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10347 - DNA, 10997 bp, Oryza sativa
  unsure (1)..(10997): unsure at all n locations
gggatatcgccctatttttgcagcattgggaaaccggattaagcaggggggagcaagaaacaattccaaaaaagtaattgataccaaaagttggtttccttcgcgttgagcacaaagcgccagaaaggtcattgaagcacaccttgaatccccagtaaaaagttgctatgcaggggatcaattccactctaacattttcgcagggacaagcgcagaaggggaaagaactttttatttatagagcaacgggtaccattaagaaaaaagaaatctttatctggttctttaagcacatcctcaatgtttaaggacattagaaccaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcaagtccttctttgctgcttactggtgtcatttttcttgagccataattgttaccactactgtctaggacacgagtagaccagcaactaagggcaagtgacttgggatttttattcagcattactatatgtcattggattgtgtaccactcatatacatatatttggccttcctagctccacatattacttctggacagtacgtacaggttcttgatccctacaatcgctgactacgccttctaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacaaaggtgagaagagtccccaggattttgctgattgtgtcagccaagagcaactacgaacactccaacaaaatactcaaaaggacatcacggaggccgttgcaaagtctgtccaagataccttcactaaaatcggcttcctgaaccacatggagaggttggacaagcggatatccacgctaactgatcgggtcgccgcgttggagacaccttccaatgaggaagtggtgagtggtgacaacgatgctcatcctgaagacacggtgtatgattccaatggctatattgacgcaccggctacaaggcaagcacggctatgacgtcgcctacgcacaaaccacacaggtatgggtggcactcgccaccaacaaggtaataataataatcgtgtgcccgatgatccttatgctaaggttaagtttaaaataccatctttttcgggatattatgatgctgagaaataccttgattgggagatgacagtagaacaaaagtttaatgcccaccttgtacccgagcaatatagagttagacaagccagtagtgagttcaaggattttgctattatgtggtgggctaggttatctgatgagggggtactacctactacttgggaagaacttaaggtagctatgcacgataggtttgttcctccatcttatcatagagatttacgcaagaaactgatgcgtttggaacaaggggataaatctgtacaggattactatgtgagctacaaaagggtgtgagacgctgtggcatagtggagggggtcgaggattctatttgtcgtttttattctggtttgagggagaaaattcagaacattgttgattataaggaatttaactctgtcaaccagttgtttcggtttgctatgcttgcagagaaggaattacaggggcgtgagcatcaaggcaagagcaaggcgagcacatacactccgcacacgatgccatctgcgggactgcccaaggccgtctcttttcgggcgtcctcccagccagtgggcaagcaaccagctgcatccggagcttctgcggcaccaaaaccatctccaccaccacgaccagcagagtcaggtaaaggttcctcgtaggtacccgccaagagtgcctcatctgtcgcctcgacgggacgcattcagtgctaccattgccaagggtttgggcatgtgtagaaagattgccctagtcaacgggcctatgttgctacagaagatggctacatcaccacctccgacgtggaagaggaagagggggaagaagaagaagttgaggatgaggatggcgaagtttttggtcgtgatgacacaacggactacaggaccatcattgtgcagcgggtgctcagcgcgcaggtacagcagcatgacaggttgcaatgccataatttgtttgagattttcttcgtcatcaacaaccgtcgtgcacgtgtgatcattgatggaggaagctgcaacaacttggtgagttctgatttggtcaagaagcttggcttgactacacgtacgcatccacacccttaccatattcagtggttaaacgattccggaagagcaaaggtaacacaggtttgtagggtttcgttttccattggctcatatgcagattctgttgattgcgatgtggtttctatgcaagcttgttcacttttactgggccgtctttgggaacatgataatgatgctacacaccatggtaggagtaataaatacacttttgtgcataatgggaagaaaattactttgctacctttgacccctgctgaaattgtagaagctgataaagagcgagctgctagtttgaaacttgatgaatctgaaaatcaacaagtggctaaatctgtttttccacctaaaaaggataagctttcacctagttctaaggctgagggaattaagttgaagggtggtgttatgcttgcaacgaaatgtgacattgctgaaatttcagatgatgatatgtgctatttcttgatatgcaaacaagccttggtttctttagatgatattgctagttcgatacctttcggaagatcgggaaccctagtacacatcatatagttatgaatatcttttaatgtgtaaaaatatatacacatatacaaagtttatatacgatgtatacaaagcttatataggacatatatgaactttgtatatgatgtatatgaactttgtatctcatatacatacgtatttaaaaaataaaaaaaaagaaattgcatcacatatacaaagtttgcatacgcatatacaaactttgcatatgtacgaatacaaactttgtattcatatatctaaaaaaacccaaaaaaacagaagagaaaccaaaaaaaaaggaaaaccaatcttaacagaaacaaaaaaaaaggaaaaaaaacagccaaccgaacagaaacagaaaacacggaaaagcaaaataaaaaaaaagaagggaaaagtctgtctcccgcgcggcgcgtccgccgccccctctccgcgccatagtataaaaactcggaccggagcttgacccggcggacctttcggttcaccggtccgccggtctgaccgatgaaccggcggttcaaccgcgattttttacgtataggtatagtgcatgtttgctagtagtcacaagtgatatacaacctcaacccccagacctgaggtcgattcccaagtatgcacccatttttgccaaaaagttcgaggtaccaatatgatatggaccatactgggcctctcattggcccattacaaaccttcactggtccaaccgtaggcggtttaatctccggttcaacacaaaaccgcccggttcagccggttcacagcggttcgaatgcatgtcggttccggttttttggttcaaccgccggaccggtccggttttttccactatgctccgcgcgcgacacgtgtccagtcgtgcggggaggaacgtgcgctgatcacccaatagccttctcgcagcaatggatcggaggctcggagcggcggaggcaacggcgtcggttgggttgggtgttcgcagatcccgactagcagtaaaattcagcgttccatggtgtatagcgcgtttcacaggggttccccttgggaacttccactgccgctcgatcaggcctttacggcccagatctcgcactcacacatggtaatccgcttccgcaggttcggagttcacggttcacgatgatcattgggaaatgggaagtttatgagcgctcacaatcctgcttagtttatactactatgactctcgcaggcttctatttgggctatcttctgatcttgattttctcctaacttgaaagagaaacaatgtgtagtaaactaaccagtgattgctagtatatggatcatgcggcttatggaaatccgagtgttttttactccatttctctgtttcctccgaaagatattcagttagtcctacacacgcggatcggattgtgtaaagaaaagaaaaaaaaaagaaagaaataaagaactagagctaatccgagtcagatacgctgtgcaagtatacaacatgtatatgcaactgaatacttaaatgatggtgatgtggaggggagaagagaagagagagaagcagtcatcacacctcatacaagactacaagaggcaacatccacacaaactctaagaaataaaaaaaaagaaaagaagaggggttgattggtggcaagtgtattagaccctgtttagatgggactaaaacttttaagtccctatcacatcggatgtttggacactaattataaatattaaatgtagactattaataaaacccatccataatcttggactaattcgcgagacgaatccattgagcctaattaatccataattagcctatgtgatgctacagtaaacattctctaattatgaattaattaggcttaaaaattttgtctcgtaaattagccaatgtgatactacagtatattaaatgcaatgcatttatataaattagttttaattttatggatggatgatgtaggtaaaattggggttaccatcccccattaaacttgccctaactagccggcctatatatagccaatggtcggtgaagccagacgtacgtaggcgtggcacagccatgccctcatttccgaggcaggtatgcagacggcacggcagcaacagcatcatcacggcggcggctctgtattctctgccccctgtcctgtgaagtggtcagtggagtacagtaaatttcttcctccctcgcccgcccacactattcggtcaatcgctcgactcgattgccgatttccatccattgcatgcattggccgcgcgcgtatcgtcttatccactcgatcgtcgcgcgcggcgcgggagacccggcattttgcaggccggccggcagttcatttacaactatggaagcttttatttgtggccatcgttctgtcggttcatttacaactcacttcttctccacctccaaacgagaacaactcgttagcagcagatcaacacaagtgcatacaactgctgctgcactgtacgcaccacagttgtagaaaagaaagaatgaccttgcctgggagaaaacggacgagacacttgacaatatgtactcctatgtgccagtagttggctgctacctccgtttcatattaagtttatttttatcacctcccatttagcttaaataagttcttttaagtaatcattgcgtcagattttataaaaatagagaataattatattgggagtagataaagtgagtagtaattgcattagagcaagtttaacattatagcccactatcagctccaaatcatttatagccaatgtaatagctaatttatacaatagttgtttactatattattaatatatggtcccacatgtcatacacacattacgtcttggagttcgtgctgcagctggctacagatctatagcccgctgctcttctccctcttcctttatctctttaaaatatgtttatagctggcttatagcctgctattgtacctactcttaggattggataaagtagagatattctagtcttttagtgtttgtattggtatgtgtaggagtattttggaatggaggtagtagctaattgttgaggttttattacatctgcagtggtgaatgcagcgcagtagtagacgagctctactcctatctaaaaaaaattgattgtatagccaactttttttataatgtcgaagataccattatagaacatacaagattgataaagtatatccagttaagatccaaaagattatgaaaaaatgtgtttaggtcttctttatttagacttataagccgaaaagtttaagcttaaacaaacaagcggttttttgtttggcttttttaagccataaaccactcttacactattaagctattaagccaaaagctaggttagagaaactattttggcttatttaagatagatatatgactttacctttaaatttagggctttaaatccactagcttataaatcatataagtcaaaaatctgacttaaaaggcaaagcctaatcaaagaggcccttagcctcctaactttgcgtgccagttttaagatttgttttttatgcttttagggtgtatttgagagggaaggttggaacttctctcacgcgcacgcaaaataggtgactcgttagtgcatgctataaaaaaatttaaaaatagattgatatgctttttaaaatcaacttttttatagattttttttttcaaaaaacacattgtttaacagttcagaagaagctcgcacgcacgaaaaatgagggagtggaagtatttcctgaggtatttttgtgtagttcatgagagaggaatcacttaaaaaagataaaggggaaatattcaatgaaaacccatgaaaatcatacctaaaagttctctaaattcatgaaaagttactggatagaagtataggcatgaaatacatttataccaaatctcaaatccaaactcaactttatctgagagaaacaaaaaggacaaatttgaggtaatagtatcatgttactattcacatgaagctttcattttttacttcaaaataaagttgagtttgaacttgaatatattttaagtccacatctatctctggtaatttgttttcataaatttaaaaactttttggcccgattttcacgagttttcactgaatatctccctaaagataatagcacaaaaatatttggtgtatcatatgaaagattacttacataaataaaaacaataacacaatttatgtaccatataatatgtaagttttattttcaaaagttagttaataatgcagaaatatagaaacttacacaatctactatgatgtgctaggaggatagacaaaatttttcataattctcttaatcttctgacaagataaatcaattgtcagccttatatttccttaggcattttgggaattctttacaaagtatatggcccaatggcatattgtatagacaattgataaaaatagtggtatatttgttaacaacgaaaatttgcatcagattcggagaaggaagaaaatcgaagcggatttggtgttgaatcgagttggattcagaatcagactacggatcggctggataccgcatcggctggaaacagaggttgaagactgaacaagttgagaagattgatggccgatacagctgatatggcatgacttaggctcagcatgggcttagattgggataaccgtcattgccaattagagatggagctcaattaaggcaattatatctattaattaggatattgagtcggtttttattagatttggtaagagaccgccgtatatggtcttatttttatcttaactttagaaaggtttgagtcgtgtccacaacggactaatatgtacttggggtataaatatgaaccccatagcattgtaatacgggagccaatccaatacaacttcggtgcatcgccacccttttacttttctcgtttccggcgagttcttcacaagaggtaacccgtctcaatggccagcgctatcggggctaacatgtcgctttagacatgttaggctcgatattgcgagtcattgctatcatatgtctttgctaatctattcttagcttttcaatttagttttatcggttgctgctcgctttagggtttatgctggtttcggttaaattgtcttgctagattagattagctaaggcatctatcatcttgaagtgtctaattgcttgattgtctagattgcatgtttcttttcatactttgagatgcatcatccctagtcgtgcttagaaccatgcaaactagcttgcaatcgaacataataaggataatatcagggtttcaaccgatcttacctaatatgcatgtttcaatacatgtttcatgtatattcgacacttatatagatagatcgttttatgtaagcatatcaagctttagtcagtatcggctagattcccgcaccttcatacctgatttctgtttgatatgtttatatggatcaatctgtttatataggtttgtactaaagtattagctagtacgttatctttcctgctataaatactgtcacatcggctactttcataatattgtcttaaactaatctattaaactcgataaacagtattacagccgattaggcgtgtttagggtttattattctttgatatatccagtccatagccggtttggttgaagcatctaggcccccgttgataattttggtaattaatgacaagcactaattgtggactaaccattctattgagttatatattttaagttaggttcacataatgtgtgctcatggatgattatcatgagctaaaattgatggcgcaaagcaaaaggaaaagaagacggtaaactagtgttttaatgttaaattgatcgagaagatgggcgatcaaaatttgctagtttatttttagcttcgccgtactattaagaggggtaatgacctagacaaagagatgatcaaaatgccacattaggtcatttgcatttggacttgttttagattcaatttgatttgattgtctgtccagggccggtctgaccgatggcctcaagccggtatgaccggcatgccttggctagtctgaccgtcgggttaaccccggtctgactggcctcctggatgccggtggctgtgctctgggatggtgatctagagccgccagagtcgcagccggtctgaccacccacactactgcggtctgaccagccctccttgtgtcagtgcattaaatgcactgcaacaacaactagttttctagccgttgcatagtagttcggtctgactggctacacaacggcggtctgatcggcagtgcactgagttgggggattttgaccccccaacggctagttttggttggtgggagtataaatacatccccaccagcagcaagggacctctcttggtactttcttcacttgcatacaccccttgcatatctcccacacccacttgagctttgtgtttatccatttagtgtgtttgcgggattgttgagccaagagtcaagtgcattgcttcattgtagagctagtgcggcacttgatcatctccgagctgtgtcattgcttgttactcttggaggttgccgcctcatagacggcttgtggaggtgttgcccggtgacctctccgaggagattgtggaggagacccagcgctggtttgtgagtggtttggagttcaccactttcggagtgaaggaataactaccatagtgatcgaggcttgggtagtcctctccgtgggccggctcccaccttgcccaccccttgacgaagggggcgtgcggtggcttcgtggttgagcggtggagttgggctcgcctcaacggggattaggaaaccggcgagtttccggacctcagtgaaaaatttcttgtctcttgtctcatttatttgttgcatttacatttgtgtaatttacattcatagagacatatttgaccccatatcaccctaggattgcaaaacttaacttatgtgtgtgatttactttcctagagatacatttgagcccatatcaccctaggtttgcaaaacttaacttagttgcttagttaaccttgtacatctccctgcctagcaacttaggttagttttgattaagtgccatttagttttaaatagactattcaccccccatctagtcgacatctcgatcctatattggtctaactccatcggctgagaccatcaacgatacgctatcggtctatcgtccgatcggctatgggtcgactaattttgcttttattctttcttgctaattgcaggatcaaatcagctggcacgcccttgacacactcaagtctagccttggacctgcactggagttaagcagatctcccaggccaccatgttttcacatcaacaatattatagaaaggataagatcaattgcaaattgttgaatcagtataaacatagtggcatggattctcacattttaataaatctcactaggaacatgcactttacatcattttttgattcataaaattcaaattcatatggttttttttctacatgtccatttaattcatagggaagaaaggaaactatccataggattatattcctatgcttcacatttcatatgaaaaataacaagatgttgtgtgacctttttgttattttttttgtctttctcatggcactatcaaaggactcttattgtatttcttctggtttttattcttgttgtatttgagaaacatactatttcaatttgtggtttttcctatcccatgaatcaaaggaatcctagtgtgcagcccaaatccactaatcgtgggccaccaagatcacattgagtctactccaccacaggcccaattggagctacatctttagatcctgtgtctacataacctaaaagacaagtttgatagatgagaaatatctccaccttttaagtcgtactctcccatcatcaattaccgatataagaataaacctaacaacaatgttgttcaacaataacgaaggaattgaccatttaccatttgaaggcatcatatacagtgtcttccatagagttataacaaaaatgataataaaaacaaaacagaccgcttcctcaccccatttacaatggggattgnnnnnnnnnnnnnnnnnnnnnnnnnnnnnnnnnnnnnttcaagcncttttaancnnttaanannccca

SEQ ID NO: 10348 - DNA, 18368 bp, Oryza sativa
  unsure (1)..(18368): unsure at all n locations
gtaatgaggaccgatggagggcaacgggatccgtgaagaggcagaggtggatgacaacggggaaggaaccgtggaagatggtgccctagcgacggtgacatcaaagatgagtcatcccatggaaggagcaaccatggagggcgacgacaacattgactagcacggagccgatggaatgtcatcgagagaccaggggacggagtcatcgtggactcgtggtgcacatccccttcgaagaccagccccgttgctggtgccctggagttcagctcgagccgaggaacctcaactcactccagtcattgcttctctttcacgttctccccgcgcgtctctccttgcatcagctgtactgcagaggatctgcatccccccatttttccattatcctacatcaccctccaagctacctttaggctgtgtttgacagccatcttttccaactcatctccatcgttttccgcacgcacgcttttcaaattgctaaccgttgtgtttttagcaaaatttttcgatagaaaagttgctttaaaaataataatattgatctatttttataaaataaataaataaatcacgtactaatggaccgttccgtttttcatgctgggagtaaaggttcctaacccactccagaactcagcctaattctacatcatctccattggctacctatacattctgatataccctcccatgggtctatgagcttccctacatttcagtcatcccttcccattcctcctttcatatctcatcatcaatgcaatttggcaaaatttgctacaggacactcaaaaaatatgtaattagctgtgggacactgtaaaaacgtgaattttcccgaggacactctaaaagtgtggtaatttgctgtaggacactgaacgcattaaaatataatttctactcaattgatgagagagaaaccatatataatgacacttttacccttatcttcttctttgttccaatgttcttcaaacgctcctcagttgtcgctcccatttgctggagttgccaggccataatgtaatacatgtgtaaggtgttgcccccatccatccatccaccctgctaccgcatgcggctacaaccaagcaaacaaatgctttgctgtgcgtataatggccctcttacattgctgttgtcttgtttttttttgactgaaagtagtgccaggtctttgcccagcagtgtgattttcatttattgaaagaataattacagtaaatatttacaagaagaaacaaaataaaatgaaaatgatcctataaagtttgtaaccaattataaacagattgcttcagtggatccttcattctgcagagatgttgttgtcttgttagtccttgacatcattgtagcactcatgtacctcgtactgcttccagatgtgaataggagtaataggcctgagaggtgggaggacaacgatggttggcagaggctgccgccatagccgcggaggctcccgctgctcagatacctccacctactcagcgcgccgctgcaccaggcattccatcccttaccacggcacatggcctggtgctactactctagctcgaacgcatgccggtggtggttgtcgtcgttcgccgcgacgagccggcccaagagcgctatggccgagcagctgctctacggctgtgacgtcgcgttcgcgccctacggtgagtactagagctaggagtgccgcatttgcgtgctcttcttccgctgcatcagggaggaggaggtcgccgtgttggtcaaacacgtccgtcatccctgccgtggccgctgggtgcgcgctcgacgttgaagaagatggggaaaagggacaacggagaagataagggcaaaactgtcattttacatggagatattatattttaatgcgaccagtgtcttgcagcaaattaccactttttttgagtgtcttcaggcaaattcacatctttgcgatgtcccacagctaattacatattttttgggtgtcctttagcaaattttgccatgcaatttcctcattggcggtgtgagtggctccctcccattcgggagagaaggcataggcaaaggatatgatactttcttatacatttccatgcagtagggaacacactagcacacttcatacgtggcatattgtgtccgcatgctatccatccttaggtctttatttacttctcctccgtcctaaaaataagtttatttttcactcatcccacacatataaaaaaaccaaaaagattattattttttttttgaaagtaaagagagatttcattaatgagaaaacagagggttacattcttggttcaggaggtcaagaatttctgcaggggagcataatctccagaccgcattagttcctgattctattaccagttgggctaaggcatgagctatcttattagaatctctctttatcttgtgcacttgcacctgaactaaacataacattgccgctttaacatctaaaattatgccactccaatctgctcttgagacattggtcgcgtttaactcagcgacgacacttgcattatctgattctaagataagtggcatattcacccattcagtagctagctggataccttccaaacatgccaaggcttcagcttgcattgtcgaactaagattagaatacccccactttatcaaatcccaatataattattcttcactttatactcccaatgcatttactcctactttcacaaactccgctctaatgatagctagaaaataaacttagtttaggacaaaagagaggagaaaaaaatgagcttattgagtacgcagtaggagaacttttatactgcctctacatagtatgcacgcttattaaaaattggccgtgacttgatcgcttgatgcgatagagcaagcctggctagcacaatttatcgtactgtagttcatccgacaaaagtaacggcagcttgggggtttgtttctacaatgctcagggactggctggtcatttcgcaggtctgacctcttgttgtcggtgagattgattgtcttgaagtcccacaactatctggaccctgcatccgcaactagctaacatatgtactgatgtacagttcagacaccgtagtcttcagttccattaagaccctgtttagttcccacacaaaaacttttcaccctgtcacatcgaatggttggacatatgtatggagtattaaatatagaaaaaaactaattacagattatgtgtaaattgagagacaaatcttttaagcctaattgctccatgatttcataatatggtgctacagtaaacatttgctaatgacggattaattaggcttaataaattcgtcacgtagtttataggcggaatctgtaatttgttttgttattagtctacgtttaatacttcaaatgtgtctctgtatatctgatgtgacacgccaaaacttttcgtctcgcgaactaatcagggcctaatttttcccacagcatgtggcagtcaaagaagaaccggtgacagatcatcattcattctaagagatatatcacattctctagcatttacctattcataccttctaggtatcagaaatcaaacgctacagatttagtatttcttggtactttctcaagtaccgtaaaattgctatcattctaaacattctcccacaaagtaatttacagacaaacagataaaattaaagataaacaactaagaaacttatttaaggtttgaattcaagttgccagcttgaatcatgtacaacaacggtgcatctgcatgctacaaccaaaagagttattgcagccaagctggagaagtaacaaattactgcaaaattatgaaagtgcactttctttcttttttctgttcatccaatccattcatcactctagtcaatccaccacagcagcagcatcaccacaacttaattacgacgaggttgtggaccaaaggggtgataaggattgtagtgaccaaaatatggaggagggactggaaaatatacaggaggacctggtatggtttggttttcccaacgaggcatagcctgattgctcctgtgcctcttgttcttgtgctcatgtgaacttgaggtggaaccaaaagataaactccgtttcttcttctcataagatctcatcaacttgtggacttcttgcattatagtgtagcggtagtcagatccactgtcatgcgcttcaattgcttccttagcagatctcagagcagcaacatcctcttgcatagcgcgatcctgatggcatacagtacattataccaatttagaaattaccaaatatctggaaaagagattaattttctttcatgaaacatgatgaattaatcattttctgttcatgacaatacagctgtatgtatcatgattatattactcctttgcaatgtaaaaggatttcctggctgcaaaagagtaacacaattcatatctatactccttgtaaaagaatgcaacagttgtgttggttgtagtgaatcttatttgttctcaaatatatgtttatcacataaaggtcttatgatgaaattgtcacatatataaatgctaaatctataattagagtaatgtaaaagtcaccaagtgctacctgtaacaaaaattaacaaaatactgaagatgtgttgaatgaaaaaaaaaagaaaaatcatttgattcaaagaacattagagcatgtggaattcttttttgtctatagcaaacatgtgtgcatatatctagcataattaaatctagatggcataattagttaaagaagtaaattaggaaacaaatcccccattgtcccagttaaccagatgaaaggtataccaatgcctgcagtgaaactgcgtccttgctaaccatgtcttgagcagcctcttttactttttcaacatatgctttgataacagaaactggagggaacttatcaatcaaattgaaagcacgagccactttgacagcatcgatgtgttcccttctcttcatcagacgattaattgactctgcaaataagacagtgaacatcgtaaagtatcagcaatgccaccagtcacttcctgaaaaatagagaataatgctcaacagagtagagatgtgaattcaaaaaacgaaaaaaaaacaggcatagcaaaccatttatgaatcatgtttgctgcttatgtcctaaagctcaaaatgatttaaaatagaaattctgacagaatgcatactcaaacaattagttctttcagctcattgtcttttgcggctcgtcagagacttcgcaactggaatccacttcgcctccaaaagatggtggaagaaattatgacttatgtcataaggaccaagggtggactaggccctaagaaacctgggccatatcccagcacctaggacttaagatccattggatatatttttagcacgcttgcacaattgcacaaatgcattgtaaactagaataagtccactttgactccctcaatatagttctaatatgattcgtatccctcaaccgcaatatcggatattttgaccccccccccctcctccccaactatttaaaatggtgcaatttgactctcagcggttataagagtggtttccactgacgtggcaggttgacttggttcatttgtgctgacatggcagccttgtcgcaaattagaagtggggctcacatgtaagtgactagggaaaaagtaaaaaaaattggggcccacttgccagccaccttcctctccctcttctcttctctctttctttctctcctctccttactatggcagcgtagagaggccgatgggatcccgtgtcttcttctcggtgggtagtggctagtagcagcaaggcgatagtagcgaagaatctacaataccaaggcaaggcaacggggcagacgagctcgagggagctaggcgacattaggggtcctcgcatgatgcccccgcagtagcttcccgatagtgtggtagtgagatcttgctcctgcaccttagtcttgatggcggtgacacacacattgggctcgtggctgacagctccttggacatcctctcggccacagttttgtctggcggcactattgcggcagttgccagcacaatgttcagtagcctcgttgccgcgatgttgtctggtggtggccgccatgacccatggaagctacccccttcttcctactcccacttcgaccagagctcagtgccctcttcttgaacccgtctgcactcgcgtgcctccactctccttctatgtgtcatcgttgtctccatccgttttcaccagccaaccccatcatccgtcccgttgcagacccttccactcctctagctgcggcgatgccagggcgaggctgttggggccaaacttgagcttggggaaaagatagagagggaagaagggggctgacaagtgggctctacattttttttattttttccccctagtcacttacatgtgggcctcactactaatttgtgattgagctgccacgtcagcacagctggaccaagtcaacgtgccatgtcagtgaaaactagtctcaaaaccactaaaggggtcaaattgcatcagtattgatagttgggggagggggtaaaagatatctggtattgcggtcaagggatacaaattagattggacctatatttgaggacttattcctcctatactagggtgggatggctcaggccttggctcagtcctgggtacccccttagtatgagaactaggtggccctaacaaatcacaccccttacaccatgtcattggctaagtcaatggattttctttttgtagttgcaaatgaaaccttgtatgcgaacaaagcatctaggtgatccaatcttcatggacaccattcatactgtaggggatattccttgccattaacccatcttggataatcacctaacatacagtggatttgacgggacattcacatcgataaattgacatttcagttacaaattgtattgcacctccatagagtgcaatgctaatgctaccatttctcctatgtagggaactttcatggtcttactcctagaagagcaaatggacatatgcattaggttttttttttgtagctaaagattccttcaatgatttgttttaccaactagaacaacatgattaaagaaggaccaaaacttggccaggagaaggcatgaatgggaatcaggaagcatttgcttcatcgaggctgggctatagagggaggccttgggaggtggcaggttggtggtgagagtagtacggtgaagcaatggtggcaccaccagagctgtgggtgatgaggagttgaagacctatggtgctggtcttagcaggtggtgagtggtgactggtgccagtggatctgggacaagggagctcttcgataagatgaatcaggtagaagatagaaactgtggcagaaagtgctagagacagaagaaatgtattcttcgtcaattggattgaatatgtgggagttgattgcaattgactgacacttaacgcaatgtcagccaactgatgcctagtcacctttttttatgaattaaacaatatagcaaatgtgttcatccactagaagataatcataacatgattttgcatcagtttaatcttgatcatacccaaatcatcatggcactaatgcatacccagcagcacaacataactgccttcatccaagggaaaaaatggaaaagataatgctaacatgggagagttggcaaacaatggctaggaacaatgatgcatctcaatatatctcggttctttaacatatgatgccgttcactttttgcacataagtttgacatatcttattaaaaaaattgcataattatttttttaatttcttgtgatttgttttactattagatgtattttaagcatgacttgcattttttatatttgcataatttttttaataatacaaatgatcaaacgtatatccgaaagtcaatagcgtcatacattataaacccaagggagtacatacttaattagcaaaaataaatctagtagcagatattgggttgcataccacaaaagaaaacccaatgtaatagacaagcccatgagttgaccaagactcagtttgatcattgaaaacataacatttgataggaaaaaaaatagaattatgcatatatgacaagaacaatgagtgcaaacctaattgagacttaaaagagtaagatgcaactaatacatgcaccaattgcagataaatagaaaatatattttcagtttacttgcgtgtcactaactccatttgccccttggaagccaagttatgactattatttgaatgaatgaaagaaataaattattgatagaaattataaaactaatatatctaaaaaatgtgttaaattcccatgataatttcagcaaattcccaaattaaacttcactaaagtgtccaaattggcagagctcaaaggaccttatttccagaaggattcaaatgggattttttttttttgccagaaagcttcaaaaggacaaaagattgaactaagaatatactcagcttgtgtatcaactctacgctttactgggatactatcagaatctctaatcttagagcaacaactgccgaaggaaaaaatggaagactccaaaaggagatactaactctaacaaacaaaggaaaacataaccaaaaacatcaccatgcactgcagtactagcatgtaatgatcacagtacgtaacagttttttttctgtggaaattaagtaaaaattcacaaacatttgcgattcgatagacaatggttacgcggataaattaattgagaaaatggaatgaactgtaattaaagctatagattatttttaccagtagccctgtcaggcaggccaaggctcttgatcagctcggcgccgccgtccctgtcgccgacggttttgaacaccatcatctccttcacctccaggttgccggcgatggcgtaggcggcgacgaactggaggagcgcccaggtggccgaacgggcccaggccacccgctggtgctcgcgctccgcctcgccggcgaccatggcgatccacttcttggccatcgccgtggcctccttcgccctggcctccagcggtggcgcggctctgccgctggtggcgagcctgcgcacgccgcggaggagcgccgcgaggttgtcccagcttgtggagtcgacgtcgcgcggccccgcggagaggacgtacccggcggcgtggagcgcgagcgcgggcgcgtccggcgcgcggcggagcgccgggaggaactcgcccgcgatgccgcggccggacctgaggacgagctccgccatgtcgaacgagtccatccgctcgcacgccgccacgagctgacgccgcggcgccggctcacgctcccggcgccgccgccgctccgcccctgcattcgccgcaccaccacggtcgcggaccaccttaccgtcttcttcctcctcgcgagatgctctcttcgtcttgcccttggcctccgccttgatctctccgaccaacgcgtcggtgatagcgccgccgtcttggttgcgaggcacgtacatggctgctttcttcttccccgcggcgacgatctcaccgctgctacgttctggagaggctcgcttggcgccgtcatctgcctcctcctccatcttcttgacctgcattttttcttcgtcattacagatctccatgtccgcttcttgagcatcatcttcttgaacagacacctcctccattactgcttcttcattggcttggtcaggatgcacctccatctccatggcttggtcaagaggcacctccaggtatgcttctccttcttcttcttcctcctcagtcctgtccatcaaagggatccccaccttgtcgatggcgtcgaacgccttcttcgccgcatcctctgtctccgccatggtcaccacggcctgcatgtcagcaccctgctcgggcgacggatccatggcctcgaccttgatgtccaggtcaggagacttgcccttacccttgctttccatcccgacnnnnnnnnannnnnnnnnnnnnnnnnnnnngnnnncgtcggcgtcggcgttggcggcggtggcggtggcgagcaggtggagggcgtccaccttcggctccaccgatgcgtcatcatcaccttggtgaggaaacaaatccatggcttctttcctctccttcttgacagcgacctcgccgctgtccttgtcatcagcagcaacctctcccacggccaccgccttgatctccctctcctcctcaaccggcgcaaccgcctcctcctccatggcggcgccatctccgccgccctgttcatcggcaacagaagatgctcctccttccatgccctcgccgcccgcctcgacggcggcgacggcgataccagcatgaccggaggggccggcgccgtcgccgtcgccgtgccggacctggccctgcccgtggagcgaggcgagcccgcgcgagaggtagccctgcgccgagccgacgtagccctccatgttcccccagaagaagggtatcaggaagggggaggaggcgacgaggcggtcgtacgattgccgcagagagtccaccctgccggggaacgccgcgacggcctcctccacgttcgccatcaggatcgactccaacgacgggcggttcaagtccgggataagatccggccggtgaacggcggtctgcggcgcggtggggctctccggggcgggcggcggcggcggcggcggcgcttggttgtcagccatggcgagggcgagggcgagagcggagaagtgtgaaacgaggagagcgagggcgaggcagagttggaagcttaattagctcagtttacagcaagcgaagtacgagggtgtggggcccgcttgctctctcgctagcggtggggcctacgcgtcagcgtggctcgcgtgggctgcggagcggaggaccaaatggggaacgcgaagctgtctagggtggtttgtgtaaaaggacaagataaacatagtactccttccagttttgggaagttagtagtacgacgtatgttctgaaaatttaaaatgttttgttaagataggacgatttgttaagaaccatttcacacctccttgggtttggtttgccgaaaactcaccaaaattggagacaatcaatgtgcaattttgtatgctgaattatgattaatagggaagactgagctaggaagaaccacatctatgcaactttaaaagagggcaatctagaaagttagccaagtaaatacagtatcaccatttaaatttaaggatgtacacaaaggagtagtagatatagaccattgttttttttttttgagaggctatttcaatcatgacaagaaacttctgcaatttgcaagttggaaagtactaaatggaccataataatttgctactttgaccccaaaaaaaagatgtaaaaggccttgccgaatttgcttagatcatcaagctgtagtgatgtagcgatgtcagacattatgtgctaggtaggatttttttttgggactgtctaacaatcattcgacagattttctttagaaaatcagtcgaattttcaagccaccaccatgtgctgctcaaatgaaaacgtatcaatgtacgtcagtcactggacattaatcacgtcagtgatgctgctaaaaagaaaaggaaaaacaagcaacttacatcaacttacgcatgtaattttaggggttacatatgtaattttgaaacttacgctataaatatattaaaattacatatgtaattttaaaacttatagcgtaaatatattaaaattacatatgtaaatttgaagatttacgatgtaaatacgtgccgattatttttttatgaaaaatatgacggcatatatagtccgaaaatatcaaatcacacctcaaacaattaggttaactacagtataacaaaacaaccatgagtaaaaaaattaccatccatgtaaaacaaaaattacacctgcatctattaaaaattacactgtaattaactatgaaactgcggtgaaagttttaaaaacgttaggtatagcagcaaaataatcagtcgcttcttgctcagttggtacgatgcacgtcatggcatcccgacatcatgtggtcgattccctgctctagcgtcatttttttttcactcgaaggcacacgcacaaatctcaaagtaaatcatacggtgaagaaatcgacagatttttaacaaaaaatctgtcgacagatatacagcaattccgtttttttttatttggagtttaataaaaaaaatgacagataaaccatgaacctcatgaattttctcatgtactcatcaagctgtagtgatgttcacatcttgatttggtaagtagaacagactttataaccattgaatcaacgtaagtcgcgggcacatctcaaatcttgtgctaaggccaataaaatcagctttaaagtgactacaaaagtgaaaattatgatagcaacttaattaaaatactgcaaaaactcaaaaccatgatgcatatatctggatggtttctaataacaaattatcacttcttatataaacaattttaacaactcaaagtttcaaactggtttgtaaggaattggtttgtgggctattattatagctttagtcttaccaatgatgctaattgttaaatatctgcttaaaactctaactgtcattggtccggtgaaaactggtgagttttaatacacttttgctaacgggtaaataccacttttagcctcctcaaggttggtacgtaataagtgcttctattaagtggtagagccaggaattttattatgcggtcaaatataattgcttcacattttagtgggattattttaatatattttaatggatttacatataaagatgcagaatcataagggcgtttgtggaaaagttgtggggtcagcagaccatacagccttatgggtggctccacaccactgcttccgtgatatatatgtaatgccaggttagctgaattaatttgctctagtcatcaagaaataaagtagtacaactggtagcatgcaaatacgacattttcttcatttatgttgttgacgtgtttttcggccaacatgggatacacctagtgacttgcgggtatagtcaagagagtctctaaaacctgctttgatctccttggtttaggttgccttcatcatacctccaatgggtattgggacatcattgaaccctactttgatgatgatcacctccattgtcttggtctccacctttgagcgtttttcgcccttcttctctccttccaactcgtcaaccgattcttttgtttgaaactggcttttggttgtagcggagaagcaatcatgaactgaattcgttggtttccactccttgatgaaattgtattggcagggatggtagataaggaatatgcaccggtgctggcatccccatagcatgaagtatggaaagtgacaactaggcagaagtgttggacatggattccatgccatgatttgaggcccatatggaaaccgttgctccaattgtttaggtgcttggacaaatcaccccctaggaggtgatcttagtctctttgcatcggtaggccgaccactcgatcattgtccgacttttcatctctcatattataaacatattgaaggtcatcttgcctttatcaccatattagagctaaaggcttcatttgtattaactttccaaactccaatctcacggccttttggtttgatcatctttggctaaggttcaccaacaatcatactcttcccatttgtgaattcaacataactagaccaaatcaacactttcgcattaacaaactctatggtgtttaccaagaagggatcataattcatgatcaaacttcatctttggaccatctatgaactacaattgtcctttatcaatggatgattgaaattattgatgaaaaacattgcaatcattaatagcatgtgaataagaaccataccatttacagtgtgcacagtgttttaattaactcctaggcaatggtatgtggcctttaggcaaaataatatttcttgcaagatataatcaaagattttatttcacatggacacatcaaaagtacacttgattttagtttgttgatccttgtagtgtgtccgattttaatttgagcaaacaaatggtttgttcttgttagtccaggaccatttggccttatacacgtcaggttcttcttcatccgaattcatcatcaaaatgttcaaatatattcacactaggttatttgtcaatagatataataaatttcttatttctctagcgcaactttcttaagatagagccatttgcaaaacttgaccaacatcaagaagttgtggccatcaagaagttttgaccggagcaattaaaccattgaatgcaagatcggccaaatctcttttagtaatagacaagttaaaacatcggtttttagtatctctaaatcccttgaataaaacaatcacaaattcattgtacctttgcctaatcattgttaaatcagataatgtaagctcaatttccccagtatagaaataatcatagaaatttaatttgttctaactgggtccaagtataaatagaatttgcaggtaaagaaataaaccaaataaaggcattgtcggataaagaaagagaaaaacaagcataacttgaaaacatcggcattgctcgcttcaccgcattgtgctagaaattggtctatatattcctatacgtttctattatcctcatcattaaatttcacaaattcaggaaaactaggaggatatgggattgtataaaaataatcagggtaaggcttttgatagactgtaacaatattccttgtctcaattccataattttctataatcatgataggcaattgatcatctaactttggtggtgtttggatcgagggactaaattttagtccctgtcacatcagatatttaaacatagactaataataaaactaattgcataaatgatagctaattcgtgagacaaattttttaagcctaattaatctataattagcacatgtttactatagcatcacataggctaatcatggattaattaggcccaaaatagattcatctcatgaattagtccagggttatggaatgggttttatcattagtctacgtttaatagttctaattggtgtctaaacattcgatgtgacagggactaaaatacaaacaggacctttaggcctttgttgattcttttgtggcggttggcgatcattaaagctcattttggccaccaacattcggcatcaaaaacaggtaaaataatgttcaatgcattgatttggttgagagtaatggtttcctagttttgtcatgtcttagttattttgcaagttgcattcaaataaaggtgaaatgcattatattcaaagaaaattgtgttaaccaagccaagggccctggccggccgatcagagggtgggctagctgactagccaacacctcctcaggtaggaggttaagggctagctaggccaaccagccaccccaagcccgaccgaccaccttagcctggccgaccaaaggccaactaacctgacgtggaggtccgatcatcctacaggtagactggtcggggccacacacactggttaaccggcatagcccacctcacaaccatctatcagccaaaaatgtaagggcatccaagggataaaacttactttgggagtgaacctagaccacaagatgaaccaaccgacctagcggaggcattaggagcctccacggaagctgattaataacaattcagcaccatgaaagtaactaattgtacattgcatatagaaagtagtagtgcaacaagataaatttgaatcagtgcaaagctacactggccaatcagcattgacttctgtttttctgcgaccagcgcaatttccgttctcttctactatctttatcttcagttcagtcaaacagtaatggtatcaagtactactactctgacttgaatagttgaatgtaggcaggatgaacccggtccattatatatggaccctagctaccaaaaaggtccggtatatggtgcaacaggtgtatatggtgcaacaggtgttcctatagttcctgaaaaatgctggctgaggtggtggtgaatttctgatctgacatagctttgagaattggtaaatgaaccagcgtgatatagttttcgctgtttctcaaattgatgctgcttcatcacttgtgcattttgcttccgcttcctgcgctgagttctcttgtttttctttttcctcagctctcgtaacttttgcatccttctctcttgttcttgttccttggattgattttgaaactgctgctgttgttcctctcgatgcttttgctgccagtggtgcttctcttgcgacatttggtgatgtttctgatgtggactagaagtatcagaaggaagttcttctaggctgtgcctcttgtttgcatatttatgcaacagctgggtaatttctgccttaattctatcacaatggacagagtcaatattgcattcaccaacaaccctccatgacaatattagagcattgacctgctttgacatggacagtttctgctcaatacaagatgcatcaggtgtgttaaaccaattttaaaataagcatatttgtatatcagtatgtggaagcaatcatttaccatgccaaatgatctgcagtgatttttcacaaattgaatatgatattttctaaaagcaatatgaatatataatttgaaattactcactactccactacatcctaaataaatcattacattgaaaacatcctaattacgtgcttcagaatgttgtgcagtacagtttttacaaagccggaaacaccagttgtttacctttaaatcataagagggttacattagaaaaaggaatatagttttttttttctaactctgcaacgtgaagagctacatgctctagagcacatgaatgaactattcttccattcatattcacacggatttgaaattttggttagaaaaacgagtagaaaatataaatgagatagctactgcataaaaagggacataccagtgactctgaatcactttccatgctcagtatctcttgagcagtctccttagcattctgaatatagtcttccatgatggaaagtggagtgtatttgtctgtcaaattcaaagtgcatgccaatctgatagcgacaagttgttgtccatgttcaatcaaatgaccaactgaatctgaaataatgagagataatcataagtccacatggaaccctttttggatatagaaaatgttcatgagattacttttttactagcaaatgcaaatataatgttgaggtcaccattttaggatgcaaattaatgctctgtattaactgtgactaaaagtgtaaaacataatttctactgattcagttagatgataaacaaatttatggccactaaatataacataagaaggcttgggacatggagttaaacaagcttatcattaaagaatgtgaacacaagcacaaatcaatgaatttccatatccgcgacaattgcgctagatgtgtagcataagttgcctacaaacatatgaaattatagttgagcaatgagtatgagtaagaggcattgaaactgtaccagccatcttgtcaatcagtccaagatacttgcagagggagatgcaacactgcttcttgtcgtccgggagagtgccaaagaaatggatgatttcttccgcgtcgaactccaggacaatgttgtaggagacaagaaagttgagaaggccccatacagccaaccggccgaggttcatgctgcaactttcggtcctcccgatcatctccttccagtcctcggccaagcgattggcctgctccatcgtgcccggcgacggcgccacggcgagcttgggcacgcagctgagcagctccacgcagctctcccacgcgctgtccctgatgggcgccgtcccggccagcaggtccctgacggcgcggacgacgagcgccgcgggttcggcggcggcgagaagcgccgggcggaagtgacgtgcggcgagggtggcgtggctgctgctgctgctgccggacgagcacaggatgcgcgccaggctcgacgagtccatgctcgcgcacgccgccgcgagagaccgcctcagcgacgcctccgcgccccctctgcctgtgaatcccggaatcggagagatcgccatcgccgtcagttccgccgccgccgccgtcgccgtcgtcttggtcttcgcatcgtccacgtcggccgacatttccatgggattcccccatcttctcgacatgtccgcgcccttcccatggatttcttcgctaggaggagacgcattgattgggccccccatcttcttgttcttcttcacctcaccgtcttctccgcgaggcgcctcgct

SEQ ID NO: 10349 - DNA, 15689 bp, Oryza sativa
  unsure (1)..(15689): unsure at all n locations
tatggcgcatgagacctctgtacccgcagcttcttggcggcgagcgcctcgatggccgcctccagctcccccatcgtcgtccccgccgccgccgggaccggaagtgggggtggcgccggcggcgagggggttggttggggtttcggggaatcggacaccaccattgcgggtggcgggtgcggagatcagcgtgcgacctgggatgggccttggggtccaaatgagaggggaatggaatagccgggttggttcggttgggtcgggtgggtgagactgcttcatatatagtcgtagtagcctcgtaggaggttaatgctgctgccgccgctggtaggtggggccgccgtctaaatggccaaaactgggtttttctcatgaatccagcgtgactcacgctaatgatcatcctaaaatattacataattcttaacgtttaagataatattaaaatcaaacttttatagctttgattataaataactttaaaattattcaatttaaagacactagaataacatatatagatttatcttataaaatactataataaaagtaaacatacattttgtgtatatatcttaactaattaaaatattcgtatttttcctttcgtcacatgcgtccgtcattacgttttcgtccgtccctccaaaacttttggttcgttcgtttgagttcgagtctgtctaaaaaaatccccgagctagatccccaattccccaaatcgatcaatcaaccagaaccaaaaataacacgaaaataccaataccaaatttaatctcgacctcatgaatttgatccccacaagaaacctaattccatgtattacctccctcccaatccgattcatctgagcgacaatacagaaacgatagaacattgaatcacaaatccactaaatcacgaaatcacaaatccatcaacaaatcatcctagaaaattaaatcacaaatccaacaacaaatcatcgcaggccgaggacattgctgccccgaggccgtggtacaaaggcagcaagaggcacgtcgggttgcaggcgacgtgcggcggtggaagtgcttggcgcagtcgtcgggcttgtggatgagctcgacgtgggccggcggcagggacggcatccgtccttgcggaggggagacggcttccttcttgggcgtcagttgaaggccagcagtcttgaggccagcgtcggcggtgcactcatcgtaggtcctgaggggagacggcgcttcaagagatctcgtgggcggcggcggcatcgaggagaccagcgcattaggtggcgcgcggaggacggtgaggcggcgcacactgtgttggaggaagcaccaatctaaggacgtttgtcactcgaagcgtccggcgcacgagcgcatgaacatacatatattacagaccgcgcgagaaatcaaacgaccgaggagaaatcgatgaaaactatcagttgggaattttgagtggaatcacgagttgctcttatctataccaaattttattggaaatacgattgacatagggtttattaggataggattttcccctctctggtatgattatattgtttttgttcgcaggcgacaagttccaaagagtaaggctttcggttatgattcatatagaataatatatcgagtcagaaattcagatgaatgaacgaattgatcgaacatgcaatacatttacatccaattctgatatctgaccgatggatttgatttcgtcgtcatcacgatgcagttgagactaaggatgaactcttctatgatcggttatggaggaacgcgttgtgctcgtgcaggatcggatcttgaaggcgccgagcaacgaggccagcggcgatgacgacggctccggcagcgccaccattggcaggccttgccggaggcagcggtcgtagctctccagcacggacacgatctgtttgaactcgggacgcctcgctggttcggtggaccagcacctcttgatgaggctgttgatggccggcgggcacgacggcgagagcggcggcctggcgtccctgtcgcagacggagtaggcgacctgcacggggctcaagttctggaacggcacgaggcaggtggtgagctcccacagcacgaggccgaagctgtacacgtccaccttgcggttgcagcgcttgtcgtggatcatctccggcgccatccaccggaacgtgcccgccttggaggagcacttgtcgccgcggcaggtggcctcgaggcaggacgtgcccaggtcggcgaccttgacgcgcccgccgccgtcgagcatcaggttctccggcttgaggtcgcggtggacgacgccacgcgcgtggaggtactccatgccacgggcgacgtcaagcgcgaggcggacgatggtctccggcggcagcgagtagggctcccgcccgtgcaggtacgcgctgagcgtgccgcgtcgcatgagctcggtgatgatccagtacacctccggctcccggcacacgccgacgagccgcacgacgttggggtggcgcagccgcgacaggagggacacctcggcgtcgaactgcgcctccatctcacgccggacctgcacgtcgtcgtcgtcgtcgcccactggcgcgtgcatgatcttcacggccactggttgctccccgtacatgccgcggtggatgcggctgttggaccccgacgcgatcttgggcccgaggagcagcttcgaccggtccgccgcccacgtctcgacgatcgccgccgacctcgccggcttcttgggcccgaggagcagcttaagccacgcgctgtgcttcttcattatctcctggtccatctctcacggctgcgtcgacgtcgacggcgacggccggccgccggcccggaagggcgaaaccacgcaagaggaggaccaggaacaagaagtggttgatgcgggcgaacaagggatcaggcggtcacagtttatatcccgggaatcttggtacaaatcggactccagcaacaaaagaatcctgctacaaatcggactccagcaacaaatcggactcagcaacaaaacaaatcggcgaccatatgctcagagttgttgtttgcatgccgagtgctcttttattttcttccgaacatccactaatcagcagaatccgaaattgaaccaagcagctgaatccgagtctagaccttctgttgtacgcctggtatatataagattgatccgatttagtcatgtatataagatcgtaaaatctaaatcgagagcatctcgttttagtcgtaaccagtgacggaacatcacagactggaagtatgaaagtatctacttaactagagtactactagttataatagaaaaacataatcaaagatatattttagagatcgtgtcatcgtccaaaacgtcaagaattataaaaccgaaaggagtaacaacttaaaactgaatgggacatatcctagtccaatgaatttgaaccacttatacagatttattggactaagatgtgtcccatctagttccaaattattatattttgtgatggagggagtacgcgatttccaataaaaaaaattataagtagaattcagcaaaagaattagggataacaatgtgatgattatttacgttgttatccctaattcaattctttgtgtatacctccatcccacaaaagttgatgttctagtaattatgagataaattagctcacagttataagtaccaatgtgccctccagtcgttagtgtgtttaagtgcttgagaaataaaaaagaattaatatgtatgcactcagttcaaatgaatggaccagaatcacccgggagaagtagtaatggcatcacagaactgcagcgacaatctttacaggatatttagcaattggtaaaacgactacttttatgggacggaggaggtactatataattttgaagcccatactagcgtatgcaacctaaggccatctctaatgcatgagataatcaaaccatgccacatccaaccaaaccaattcacatagtgaccgatcgccaaatcatcacacgaggcaaaaatcgaaccatcgtattatttcctctagtactaccactgcaggaagcaaaccaaaattatcacaaaggcaaaggaataaggttgatcctttctttctgttggtggatctcgtaattgaattacactctgaaactagattagtagaatcactacttaaaaaaaggtttatccatacagttaggatagaattttgggcgatcctggctttagctccattgtcggcctagcagcggcaagtcacgcatagaggtgatcggtccggtgcaagccttcgcccggatatgtgttctggtgttgtcggtgcgtggggcggtggctttttttcttcgtttttctggttacaacctcccagggttttaatcttgtaattttttttatgctctatcaatatgaacttcacgttgtctggtgcaagtcgttcaacaaaaaaaagatctttgtaggcggatagatggcccgtccacacgcaggtatttgcgaaaatcagtattttcgcatgcgggcggcccaaccacatgcgataatcgattttcgcaagcggacctcttaatgtggcccatgcgataatctatttttgcaagcggatgagttgtgcagtccgcctaaaaagatattttttccatacgctgcattaagacgcacgcacgcgataacacatttcagcaaaaaatgtaaaataaaagaattatgaaaccctaagatatgcatccacatgacacaacattcatagatccatccacatctacacgccacaaacaaattgtacaaagaacattaagcaaagattcatccacaaacatagactacaaacaaacaagaacaaacatgaacaactagaatttcatccaaaacatagtacatgcagcaatagatccgagtccagcggaggagatgaggcgagcgaaggagactaagaggcttaggagaggagacacggggaaggagacgaagaggaggaggaaagaaggccggcgattcatacccggggcacacgacaacgattaagaagtagaggagaataagcaccggatcccgtcctcctgaggtcgcccgtgccgatgccgtccatcccatgcccactggcacaatgaagcaagagagggaagccttcccccatgccggcttatgggggctggtctggcctcccgaccacccaattcgtcttcccaaccgatcgatgacttacccaaggtcgtaggtgctagattcgcccgccattcggtcaacggcattggatccaccgcctcaccgtcgtcagtgatgaatctgcctgcccagtggtcgccgacgatggatccaccagtcccgctgtcatcgatgctagatccaccctcgcacgatcgatcgtcgatgatggatccgacggctactcctgtcgtcgctgccgctcccggtcaatttgagcagggatgttacgttagagagagggaggggagcagtggagaaggtgggggggactaggagagtaggggagggagatgtaagtgaggagagagtggggagaggataaggatgggtggctgtagtggggttgaggatcatttgctctccatgttaatcacatgcatgtggcctttaagaggccgcatggaaaaataaatcttcacatgttgcccttgaaccactcgccccgaaatgatttctgtgtgcaggagttatggttcgtctacaacatactagggtcttgtacagaaaaattaaatatgcaatgcagtagtgaatcaaaccatgcatcgtggaccccatgtcttggtgaactattcaattgtcggttcaattagcttatagtgcaaggatgtgtaataaataatgatgatggcagttattcacactaatgttattattaggggtgctatcgtatcacaactgctaatcaagaaataacctaaaaaaagtacgaagttgagtaaatactaagtcatactataccgttgctttctaaagtgttgtcataaataggtagatggacatatgaaacttcagttaatctacctacatggagcataaccatagtaaaaaagacgagactgacggttgtatcgtaaaaaacagaaccacaatccttcttactaggtcggtttgctacaaagaccggatatgcattctgtgtgaatcggacggttttacgtggaaaaccgatgacccgccttctgttggtgaaaatgggccatcctataaaggctcatgatgcttactaaccaacccaatacgctttagagcaggtacaatagcaggctataagccagctgaaaatatattttaagataaataaggagagagaatagtagcgggctacagatttacagccagctgtagcacgggctccaagatatagtgtgtgtatgactggtgggactaggtattaatagtgtagtatgtaactattgtatgaatgagctattagattagctgtagataaattggagctagtagttggctatactattgaacttgctcttattgcagaacggccgtaggaagggattaaacgctgtctacctagttcaaaacttggcgtcactaccaaacagctagcttagaggagatatgcatggtaaataaactttccagttcagcacctagctagaccggacgaatcttgtggaaaatcctgtggaattcctacttccgaaaggatacccaagttttcaattgaatacacagttattggacccaaaaaaaaaagaaatgaagggcgtattccaaacagaaataaaaaaaaccatcttttctaaggaaaatccttaaagtcgggcgaccggtgcgggggagccggatcagacgctccccccgcgcgcccctcctccacgtgcgcacctgttgggcctacccacctctctctcctctttttctacaaaagatgtttcacctagtgtacttacagtattttactatttataaatctaatgttgtagtgaattaaaatactcttttgcaacaaaaaacccacatattttggaaactctctattaagggaatttggtttattttttgttccacaagaaatgtttcactatgtatacatctaatgttacggtgaacgaaacattccattgcaaaaaaaaaacccacatattttggaaaccccctattaagagaatttggtttattttttgttctaccgaaaaatgttttacctagtgtactcacaatgtttcactatatatatagatctaatgctgcagtgaacagaaacattctgtcggtatttgctgaaacattatttttatataaggtgaaacaacacccgagttaaacgagtgaaacattttcgatctacttagtgaaacaattccaatatacctggtggaatattgtgcaacatttaaaaataattcaataataagcttttttttttcgttggaatatatccatgtgtagtcttcttttgaatatttaattgcaacgaatttaatggtgcaatcggatcatgatttggataagtaatttaagagaaaaatcagtttaaagtagttttgcacgtaaatcgggtgctgacgtcatgcttatgtcagcgcccgattttaatctcctcccatcggccgcccgagcgggagtcacgtcctctttctaagcccaattcacgcaagtttagtggctcatttcaataattagcgcatggtagatattaggcttttggctgttacattttcgatacacaacttcaaaaccctgggtctgcacctgaaaggatgtcattactcattatatttccgcagccaacttgcttgatttggtgcttgttccgctctatggccagtcaaattctcctataacacatttagcatgatagcatatttgtctcttcttgctacatttgttcatgcgtacgcgttgccggcgtgcacgccggcccactaaggcccatgcacgcacgcgcttgttagggatggcaacggggcggggcggggccgggttggacaggaacggccctggccccgacccccgactttatcctccgcccccggccccggtaccatcttcgggtgaaaagcttcccccgcccccgacctctacgggtccccgaccccgaccgaggccccacaagctatagagaaaagaggacaaaaccaggattgtagcagctaagatgaagtggctcatcgagaaggctagcatcgcggagatttggcggaggtgcagaagccggcgacgcgcgacgaagacaaaggcgaagcagccggcgacacgcggcggagttgcagcagtcggagacgcagcgaaagtgcaacggccggcgacccgcggccgagacggaggcgcagcagccggcctgggcagaggcgcagcctcgcagggagctgacgaggcgcagcagcttgcaacgactgcggtagcgccgatgcagtcgctactcgttgactgtatctttctttttttattcttttgatttgaaaggtcattgactcgatctggatggatggctccgtaactgtatgtatggctggggtagataagatgggataggaaaagttatttcacaacatgggcttgtttgggccacatttttaatttgcaatctacgcatgtaccatatttccgggtccccatgggtcacccgcgggtggaaacctagacccgcccccgtccccgcatattttcggggccccgccccgctgcacccgcggggccaaatatagccccgaccccggccccgtagggtcgggtccccggcgggtacccgtccccgtcggggaaattgacatccctagcgcttgtgtttctctcttttttttccttttttttccctgtttgttattcccgccgtacggatagattagtttcctatttttactaatgattagtttactagtaatttttaaatcttaactttaaaattttcaaatctcgagttgaaagttttcaaatctcaagttgaaagttttcaaaactttcaaatctggacttgaaagtttttgaatcgagtcgaaagttttcaaatcttgagttgaaaattttcaaatctcaagttgaaagttttcaaaattttcaaatctggacctgaaagttttcaaatctcgagttgaaagttttcaaatctgagttaaaagttttcaaatctcaagttgaaagttttaaactttcaaatctggacttgaaagtttttgaatctgagttgaacgttttcaaatctcgagttgaaagttttcaaaactgagtggaaagttttcaaaatttgactttaaaatttaaatcttaaatcaaaagttttcaaatctgacttaaaaattttcaatctgttagtaaaaaaatctcccgaaaaaagaaaaaaaatcttgagaatcttccataattactcgttattagtgttaagtgggtgttaactaatactatagagtagttagggaggtaatactataaagtagttagggaggtgctcgctgctggcgcgcacgcgctagctagcagctaacaaggccggtggggattaaacagataaggggctactaagtaagtttagtggaagcggaaatccttgccacgaagcaatttaggagctatatgaaccccttattaagttgcatgaaccgactaaacaaaataaaaaaaacttaagctaataattgaggaagatgctcaatcaactattttaacactttaccctcacgtgagcctattaatgttagacgtggaatatttattagtataataaatatcaaattgaatgcacaagctagtttaacgcaaaagcattcgagaatgctgcgcgttgggcgcccgatggcatggaaaaaatcggacgcctcgtggcgcccgcgcctcctaccgctccttttaaaacgatttttctcttaaactaattatccaatctacgatccaatcacattgttgtattcgttgtaattaaatctttacaacaagatcacacatgattatatttcgataaaaaaatattttagcttttctattgatatttttttttgaatattgcatatgatctctttcgatgtttcaactattagttttatgatgtttcagctagtgtacttacgatgtttcactatgtacggatcaaatgttgtagtggattttgatattatggaacgcgccgttgtaacaaatcacccatatattttggaaaccccctattaagggaatttggtttatttttttgttccaccaaaaatatttcacctagtgtactcacaatgttttactatgtatagatctaatgttgcagtgaactgaaatatttcattgaaaaaaaacccacatattttagaaaccccctattaaggaaattcgttttatttattgttccccaaaaaaatatttcacgtagtgtacttataatgtttcactatgtatggattaaatgttgcagtgaactgaaacattatttcgctatttgctgaaacattatttttatataaggtgaaacaacacccgatttaaacaagtgaaacattttcgatctatttagtcaaacaattccgatatacctggtggaacatcgtgcaacatttagaaataattcaataataagctaaaaaaattttgttaaaatatatccatgtgtggtcttgttttgaagatttaattgcaacgaatttaatggtgcaatcaaatcatgatttggataagtaatttaagagaaaaatcagtttaaaatagtttttcacgtaaatcaggcgttgacgtcatgtcatgctgacgtcagcacccgatttttccccaaacattcggacgtccgaaacggagttgcctccaaaagcattaaactgaaattcatttgtgcttcgagacatgttgaacagaaaccgcaccatcatacctccacgcctttgcatataatcctcaaacgtccacacttaaaataacaaacgaaacaaggagcatgtcaactgtcagttaaatcgacaagctgcaccttcaaagggcagaactattgaaaagctattacaacaaagagaatggccaaaattgtatatacatgttaatgtaaataaatgtccaacacaacatgaggcaattgagccaacacaattcaagaggaaaactcctgtaagcatctatatctttctctagtttactcaacaacccattgcagcaagtgctacctgggatagaacggtggatgacggtagaagggataattaggctgttggggattaaacatacccataaattgagaaactccaacattttgtgcaaatgcagcgctctgatttccaggccaacctagttgggcagcataagtgtgagatataggcattgcagcatatggtgaatgcccaacagaatcaacctgcacaatatgcggaaccataggtgatatggaagcagggatagatggtgttggcagcttggtggtgcatggccttgggcgtttctcttgtggcttactttgctgttgttgttgttgctgctgctgttttttctgtggcttcttatgctgttgttcttgaggcctatttgtcttttgttgctgctgctgctcttctggcttagtttgctccttccccatcttctcttgcggcttaatttgttgcttctgctgctgctgttgttgttgctcttgaggcttatttgtgtttagctgttgttgcttcttctgttctggcttagtttgctgctgccccttcttcccttgtggtttaatctgttgcttctgctgctggatctcttgtcccctgtgctgttgctgctcgagctgctctctcttgcgcttcttgtttgtatgcttttgctgctgctgctgctgctgctctgaatttgaagttgaggcagaacaagcatcccctgaacttcgcttcgttgcatattgatctaataatttcttcatttctgccagcataccactgcgcacgttgaaatcagtgatctgctgttgaactatgttctgtgcaaccattagactatccacctccttcgttataagtggactctgctcacaagtaaatgtgccatcatcaaatatttaaaccatcaaaaaataaatagctcgaggagagaacaaatttttgtaacataaacatctaccagactactactacaagaatgtcttatttccaatttcttaatttttgcaaggtaaaagatcactctaatagtccatgcataacaatatttcaagtttctatttactcttatgatttatgacatcgatcggtgccagatcacgttgcagtataaattagaaaagtactaccccaacatttaatcatttcctatggagtagtcaataccagagacttgcgtggagaattcatattaattatatccagagcattctgttttgccctttcaacatatcccttcagaagagaaagtggagtatatttgtctatcaaattaaaagcttgtgttaacagtaaggcttcgagttgttgaccatttccaatcaaataatcaattaagtctgcaaaaacatgacaacaagaaaaatgtcagcagacattgctccagcaaaataaaaattatcaaagagataaatgtctacaattatgttgaaatgtatatataaaaaggaaataactagttaactacaagtagcacagcatcatagtatcaaaaattgaaatttcatcagctagttactacagagtatacattgcaccaagcaattaccaggtatatctgtgatgtatcaatatcagatgataaactatcctacatgagcttatattaacaggtctatcaaataaacaaaaatgtcatttggtcgcagcgtctacaaacactgaagaaactccattatggaattaacatttttttttactgtgaatcaggaaaaagtacctcgtgcaaaaacagggcctcaaggtgcacaagtggagcaactaagcaagtgaataataattgaaactttgttctcaagactagcatgccaattagaaaggatttttattttatcgttcaaattattggtcagctgtcacttgtatatactgccaatagcccttcaatgcctggagatacatggaatatgcaaaatggttcaagatgttcaaaatgattgactgatttagaccatcagaagaggaacacatccctaaaaagctcaacatatctatatgtattcatcgaacaaataccacaaaaaataacgcttattaggaactcaaatgaaataagcaagttattaatctagatttttttttcttgaacacgcaagagaattgtgtgtcatttctttaagaagagaagaagaaaaaacaggggaggaaacgatccctccccaagagttaaaaaaaaaaaacaacgcatgcttaaaaaggctatcgaccaaaacccacgcttaatctagatttcaagtggattttcaatgtacaacatgatatagtcacaggctcacagcataaggatcacaatgattgagatccactgcctggggaactccaagctgcttctccaaatgaaaattgatgtatcttgaaatcaaataatgtgcagccagtacattttgaataaaacagtccattaagacatgttttcatgttgatcgtttaagtaattaattttaaatcataaacatctatacagttacattacaagagttggagactagaagagttaataatcaatcaggtattgttcagcagccacggttaaattggttatgaaaagcagtgagatatatgccagaacagagaagcaaatacaagagatcgagttgtgccatctagttctctatgttgtgcagtggttttcctataggattcaatgattaattgcccctgaacatctgaggtatgttgaaaatgtggcaaaagatgaagcagaatagtagaatttgaccagttgaccttcagttttagtttttttattgtactcccaaaattctcttttgtagtgtgaaaaaaccacgctttatcataagagaatattctgggttaaacgatggtgaacagatattagattagaagattatttttactacactatgagttcgacatgtttcactccgactactatacaagcacaacctgcttgcatgcaacatttcttgctaccaggaaaaggagtactctacctatgcatctcttattggatgattcactattgatgattatcttaaaggctagcagcattatatgcagtgcacatgttcactgttcagtggtggctatgaaatttggcagtaatgaaatgggtcgaacagacctagatgaaatactgtaaactatagcataatgtgcatggacagagtggctgcaattgaaagagagaattacacatttcgatgagtgtttgcagggtgccagataaaggctagcagcattatatgaagtgcacatgtttactgttcagtggtggcaatgaaaatttatggcattaacatactatcattgagcacaaaagtgcaggaacgcatatgatccttgagtgaagagagagtcatccataccagtgatcctattgacaagcccaagacctttgcagagttcgatgcagttctttttctgttgtttgcgtgaaagagtaccaaagatacagaagatctcatcaacagaaaactccgatacaatgttgtaagaaatgagaaaatacaggaggccccaggaggacaggttcaaaacgtccctgctgcttccagtgctgtcaatcatctccttccaatccttcgccagctgcttggcctgcttcattgtgtctgaggacagcgaggcattcactgcaggtaagcaccgaatcagcccaacacagttaccccaaaccttggtggtcttcatcttcttgctgagaaggaaaccctggacgacttggaggacaagggcagcagcatctggggcatggcgcatcaccacggggtactcatgccagaggcaaatgctctggttcttacacaccaatttcaacagccccctgacgtccatgccagcacacactcccctaagatgatcgctgcaacttggaagagctcgattgccttgttctcgagacgctttctcgtcgccctcctcgatgtcatgctccatagatgtcaccttagcctcattttgctcctccgatttggcctccattgtctcaccgtcagccacctgctgaaccccttgggcatccacatccccattctccccaatgtcgtgttcttgagaggccagcttgtccccatgttgctcctcatctttggcctcaattatctccttctctgcctcatcctcttcctgtttctgcactggaatcgcactcttggaagactcatcagcatcttctttggacttctgcatctcctcgttggctccctgctgctcctcgtcgacctcctccccggcctcctgaacctcttctctgacttcctcttcctcctcctcaatctcctcttcttcctcctcaatctcctcctcgacctcttcctcctcaatctcctcctcttcctcaacttcttcctcctcaacctcttcctcctcctcctctttctcctcctcgtcgctgtcctcttcctgcttcccgcccttctcgccgtcgcttgtggaggcggcggcgggacctgcaagcgcggggcgggccgcctcgaggacccggagctggccgaaccgccggtcgatcgacgactggagcgaggagatgtaggagtcgaggtcgccccacgcgaaagggagcgggaagggcgagcaggcggcgaggacgtcgaagcctcgcgcagcgccttcttctttcgcgggaaggcggcgatggcngncttcatctncnccgtcgtcatcttcacccggcaggccgtgcagncgccn

SEQ ID NO: 10350 - DNA, 2263 bp, Oryza sativa
  unsure (1)..(2263): unsure at all n locations
acannnnnnnnnnnnnnnnnnnnnnnnnnnnnnnnnnnnnnnnnnnnnnnnnnnnnnnnnnnnnnnnnnnnnnnnnnnnnnnnnnnnnnnnnatttacttgggcttttctctttggaataagttcactttaggtccctctatttgtcggtcagtccgattttcatcccttaaccgtaaaaccggatacgacccgtccctcaacttacgaaaaccagacaaacgagatccctcggcagtatggagggtggttttggccgatgtggcgcctacatggctcttttgactatgtcttcatcccacgtggcattgacgtggcggtgacgtggcaactcaatatgaaaaatattaaaccccgtgggacccacatgtcagttttagacacaaagtaataaaaaaaatggtgggggtccacgtgggctccacatgtcactcccccctaccttttcttcctcccctctccccatctccccatctcccctctccggccacggtcacggctgtgcccgggcagagacggatttagcgtattagcagtgggggccctggaccccactcaaattttacatatattacacatacccctaatcatattaccaataggcccccactgcacctgacaagaaggcccccactcttctggtttccttcctttgcaatctttgtgcgtgcggtgaggacagtattgaggactcgaaccgtccgctccccttccctggatcccaatctacaaatcgtaattaccggagctattgaggccatcaaaatctggtgcttcccgcagttcgccgtttcccacagcctgcaagtgccggcgccgaaggaggccgtcgcgaccactgcctggaggcttcacgagagccacggatggcgggatgtcggcgtccttccatcgctatctgcccaacaatgcatctcccgtgccaatcgcgtcacgccgcaagtcgtggacagtctctatgggctatggccacggcccatgcggccatgtcggcaagcctcacccggtgcacctgcagcctgaaaccctctctagttgcccttggtaagtagccacggtatgtttttatgtttacattagcaattttgtctttcaaaattttgagccgtactcctctagtttgtggtagcactaatatcgtaatgcaacatctcatcaatgatttggtaggaaaagataatgacatatatttgtaataaaaaacaacagcaataatgaacactaatggaaggaatctagtgtaaatgcatcaaaaccaataactagacaaaattttgcaatgcctcaagcccctcaacctactgaagtactgattcagacaagcttccttggagtaatataatatgtcatagtcatttttatgtaggatctgcaaaataagtgaatttacttgggttttctaacttgctatatataagttataaagttaagttagataatttacataccacagatgcccccagtcaatttttatcctgcgtccggcacccctggtgccggggactaccacctcaagaagactccacccgcacgtccgcccgtcgcggccccagtccgtcgcgtcggcttcgcgctgccgtccaccccccgctccggcccgccccgccccgccggcttcgcaccgctgcgcacctgaaagacgtcgacgacgaggctggcgccctccgcttggctccgccgcccgccgagtcgcagccgcacgcggacgggagctcgacgcagcccgcccccgccgccgcggaggaggaggagaacacggcgctcaagactctacaagttccatctagctttgcaaggcccatcaaccgcagcatcatcggttcttcttcttcgtagtcgtcgtctcagaattctctgcggatggaatattcagacctgtggatcggacaaagtatactcgtttgaatcattgatcatagctggagaaaaaacctaggagctggggataactgatatgatatatatggaaaagggatagacatgctattttatctctaacaatgaaagatgtgatcatctcaactaacaatccatggcagcaacctgcacggctgcgtggacgagggcgccgcggcaggagcaggcggcggagatccccatcgtgctgttcccgtcagtggtcttccccggcgcgacggtgcagctccaggcgttcgagttcaagtaccggaccatggtgcacacgcggctccaggttcggcgtcgtgtactccggcgggcggcggcgccccggcggagtgggaggcggggtggggggccnnnna

SEQ ID NO: 10351 - DNA, 31353 bp, Oryza sativa
  unsure (1)..(31353): unsure at all n locations
ggcgcgcattgtagattcgtnnnnnnnnnnnnnnnnnnnnnnnnnnnnnnnnnnnnnnnnnnnnnnnnnncgcgaggatccgccgcgccgccgtaagcccgtcgccgccccccactccgncccgctctaccacccaaccgaagcttcttcgtcggcggcaatggctgataggggaagtaggggagaagtgtatagagaggagaaagaaattgctctctgcaactgcaaggtagcctcccccttcaattccagcttattaccatgggagagcctggcctcttcctcgatgatgcactagctagttcctccttattctctcagttttgaatatttattattgtctctattaaatttggtactccctccgtttcataatgtaagtcattctagcatttgctacattcatattgatgttaatgaatctagctaagtatattaatatgaatgtagaaaatgctagaatgacttacattatgaaacaaatgctagaatgacttatattatgaaacggagtagtgtctaaattacttcaataccgatgaggtgctaattggtactgacaatgttgaaacctgaaagtactatctactataactgttaactgtaattccttagttaaccctagttttatcgttgaattgaactagtggagtgtggcctcttctgcctgagatgttcaattcattctggtaactaataacattgtttctgtctaattgcttaccctcaatttgcttttatgtttgtttaattatatagagtaaagttttcaaaagatgaggagattggtggaagtcactctgcacaagtgctgctggcaagggacacgaggctaactagagattgagtagccactgctagaattatatgattgatgacagaatagtcatctggctaggacctataggactctgtgcataagtattatatccaagaaccggcactgactagaagcaggtctccggtggcgcagtcctcttcaaggtctccggcaggtttccagtaatggccccaacaccggcgctctccagcagttatcatccccttccctctcagcttaccataggacaacctggccttgctatattgtgcgctagtaatgttgaatttggtaatctcatgcataataaaccctttttgatctgttgagtacttgaatctggccattttagattagttcaatattaactactctgctgatgcccattggtactgtgctactgattttgttggaaatcatgagtgtgattttttttaataaaagaagggcaggagatctgtctattcaattgagaaaaacagaaagaaatatacaagaaatatacatacatgttctcagccaaaatttggaagaaacgaatgcaacaactaagaaaacaacagctagaactatctattcctggttgaattccccctgggctaatctcctccctgataatatgtgccacttgcatgtcagttcttgattcttgttgaaacattattcgttcccttccctgctatacattctgtcaggtcctaattaggtatccatgcattaatcttatatcttctttgcattgatcccttcccagtgcataccaccaatctttgttagacagattgtgccaattggatgtttccatcaaggccaacttatgagtatacgattccatgtatgaataaagaattgacacactttggctaaatggatcatagtctcatcctccatgataccacaaagtgagcaagatgaaccacattcttcagttttatcagtgaattgaattattgggggtgtggcttattctgccctagttcagtttgttcaaatactaacttttttttttgtctactgtcttaccctcaatttggctttatattagtttaattgcaggaaatacttcagcttgcaaaagatgatgagattaaacttggtggaaggtggaagtcactcgacacagtgctgctagtaagatacaagaggtcaactggagagtatcccagtacaatgtaaagcgctgctggcattagatgatgggaggatagtcatctggctaggatctacaagacttttgctcactctttttcaagaacaagcacttccacaggacctcagtttgctgttaatcagttttgaaggaatcattccattaatcagttttgcagcatcgttgtatcgtgttgcattggagccaacaaagttgttgcaaattcttgaagatgctccatgtttttgttttgtacaatcttcagtaaatgtaaatatcatgtaggacgtacttgtcagtatacatcctagtactgacataagttaggggaactgcagctctgttttgtagctcctagcatgttggttctataactgtatgcaagaaaagtgctagggtgtcggtggcactcatgtaggtgacattcacagtgcaaataaaaaaggatgtggtatgaatgtttgttctatattctctgaaatcgtatcatttattcatatgtcatccattgaggccaaaatgcctgtgatgtgtgaggatgagccttttggtgcgtgtatcactccagtcaataattcagtaacaacggtgcatgttttataagcattagtcatggtgaatctgagaatgctctttttggagcctgttgtcaatttgttaaagattacatccatgctgtgtcctgaaggatcacaacatttggtcgttttttatccatacagtgtgtgcaaactgaaaaggaagcagagaagaaaacaaaaccagagtttcagactttcagtataaactaatgtactctgttctgaatttgaatgacagagctttattgaatgtgcaccactcattgtacatggatgttattacttacattgaattcatagaaatcaacagcaacctcaactaataaatcacatgttacattcaattgaaccaatgaactaataaatacatgtaattccagggtagaaacacaaaactcctaaacttctggccgctgcacagactgcagtactgcgctacagaggaagaagaactgatatcttcctaagaggacaatgtcagcgttgatcacttgctctgatctcttcctaagaggacaatgtcagcgttgatcacttgctctctgcagggcgctagtctgctggcatgtcggaaaacagctcgtccatgtcgaaatcgaggcagctcgtatcatccgtggtgaagtcaatgtaactaagcacttcatcgatgctctctgggaactctagatcagacaaaggcatgctctctggggactcaagatcagacaacgccatcggcacctcgacgcccaacggtgaggagttgctctgcttgttcagcgctgccgctgcgccaccaccaccaccggcaccggcttcctctgtctgcgccaagaactggtcaggcatgtccgacgcacgcagagatcgctgcagctcatcgtcatcgatgctcccaggaagatcagcaaataacagtgacgaatcagccatcaagtcgtaggagctctggccctgcagtggtggcactagagctgcagtaggaggagcgggctgtggttgcgggcagcgctcctcgtcgagcagagcgatctcttctctctctgcaccaccggtggcatcggcttcctctgctggcagcgcgatcaggtcggaaagtccatggaacacccgccaataatcgtcgtcgatcacgccggaggagccctgctcggacagctcggtgccctctgtttgcgacacagacaggtcatcgtcatcgattctgtcgggaagatcagaaaacagcagtgacgaaatggccattaggtcgtaggagttctgcttcaccagagcgggctgtggtggtgaccagcgctcctcatcgagcagaggattctctacaccagcagtggcatcagcttcttctgctgggggaacgatctgatcgggaagacaatgtgacgccagcgaagattcgccgtcgatcacgccataggtgccctggtcggtgccgtcggctgcaggacgaggcacgtatccgtcgaacagagtggtctcagccacggcgcgccggtgagtcgcgctttcttgatccccgccgtcgtcgtcgtcgtgggagtccagacactgcggctccctcttgcgcttcttgccgtggccgctgaacctgacgcggtacagccggagctgcgacgaggcgaggtcagccggcgacgtcacggcgtactcgtgcataacccagcccgagctgccccgttcaccctcggcgaagaagctcaacacatacttgcgccacgtgatctccaggccttcgtcgccgccgccgcctccatcgtcgcctgggacgaccagccgctcgccatccacggccatcctctgcccctgccagaaccctccgccctccacggttcgcttctgtcgcttgcccttgccattcttggcgcgtgcctccgcgaagaagaaggcctcgtcgcctcgggtgtgatccgcgagaagcgtccatggcggcacgctcaggggatcggcatccacgatgacgccgtcgagcgggaggggcttctgctggatgcgccggagaaggtagcgggagacgagctcgtcgtcgctagggtcgaacctgaggccgggaaggagcccatccgcgcccgccatcgccggctcgatcccccgatcgcgcgccgcgccgccgcctggggatttctagggttttgggggaaatcttggtcgagaggagatgagtggaggatgcgcgcgtgggatatttccagtaaggtgggatttgaatttattggacgcgccgacgtcagcgtgagacagcgtatgtctcacgcgtgctcccgcgcgagcagcggggcttcttttttgtgatagttttttcagataactagtgtttcgagcttgatttggaacttgttttgatcagttttataattcgatcagaaatttaaactgttgcttgtcctactcattcttatttttgaaggaatttttttgtaagaagaagaaaatgatgggcaaagtattgttaattttggaaggcaatcaaactgaaggagcagtgtcttttttgttttctgaatttggatgttactaagataaatagagtaatctatttatcaataagtgccaatgtcttgaattgcagtctctgaccgaatgccagctgctgcatcaatttgaattgggactgaagaaatgaaacagggaggtgaaaatgcagaaacttgtggaaaagaaaggaattgatcttcaaattgcaaatgtacagaatgaagatcatccattccttgaacttgtcccaataactccaccttttgctgatttttttttttcagaatctgttcactcactgaagttttgcaaggctgctagtaactttgtcaagatgtcaaggctgactgcagcatgccttgaggtattagtatttagtagtagatgttaagagcattttctccgtacacatctgcagcataccttctctgatgctaattcctggatctctgatgagttgcttacagtattttcaaacaagacactgttgtgctaccgggacacaggcgtaattgactgactgtttacttcagtggacaataaaacagaaaggggcaaacatattgttattgatgattttaacagattcacatgggtatatcgttctcttgaagactggagcatttgttcattcagtttcaatcatatgttcaacgatatccaaataataaaatctgctcaatcagactgattggtttgatgttgacttgaaggttgcaaaaattcattctgaaacttggcattgcacatcgtttgtgttcccacatgcacattgcaacattgtagagacttggctaactcttctcgttcgcttttcggatgaggccttgctcactgcaacctaccttatcagcaccgactttgtcttcagataaccaacctgcacctgaaactgtattgtgtaaggagaagataggctgcagaataatgtgcgtatgctacagtgacactaatcttatcattagcagcagtttcgtactttcgtgtggttgatctttttatgccaaattgatgtttcgtgtggcaggtgatgcggcacggttcctgcgctgccgtatgtgctcctggtgcagcaagatggacgccgtcgagacgcggcatggcgagtcggccaggggaaaaggtggagggacggtcatctaccgttcgcaagggcgcgtggcggcggtggcgaggtacaacgggttgggtagattccgtcggcagcggcaccccggactccggcagcgcgacagcggcggaaggacgacggtggctggccgggttggctcatctcgcagctcgccaggctggcttggtaggctgggccgagacagagcaggcccaccggtaggttgggctgctagatgggccggcctaaatggaggaagaagataagggtgctcggctagactagagataggctaagggtttggacaaggtgtggtttagactttgaaactagttttgtttttatctgtataatatttccctaaaggattttaatttaaataacgggtgctttaataaatgacgtttgaatttaatatttgaacttaaaatttggatttaatttcttttgaatttatttattttaatttttggcactagcacaataggaagagaaaaaggaaaatccagtgaatatcagcattattcaaattttgaaaaaggtttttagttattctaaagttttatattcgaaaatttcagtgttacacatcagtcgctcgctctaatccagcccacgatgcaatgcgataacaagaaaatcacgtcacggtcttctctgctttctcctctttggccgggcactggcacccccatctctcctagggatgaaaacggagcggatacgaacggataatgctcatactgtattcgttttcatattttttttaccggatacaaaaacgaatacggatagctcgaatacggaaacaaatatggattatctcgaataagaataagaatcgaatatgatcggacacgaatatggaaacaatttttttctcggaacacgaagaccaactcaacttctaatagaaacaaatatcaaaatatataattacctcattttatataaaatatagtataatttataaatatttttaaaatttaaataatattaatattgtgggctagtgttaagagatgaactactattaaaatctaaaaaggtatattgaaggtctagagttgtaaacaaatgaggtatgtctcatgacttctatagatatccgaatagcactgttcactggatatccaaattactattcgtatccgacgaaaaccccgatatcatattcatatccgtatccgggaggaaatatccgtatttgtatccgaactatccgatctgaaggtatccgtattcgtttctctccagaatggacggaaactatccgctccgttttcatccctaatctctcccatctcttcttgggttaattgcactaagagcagatacaatagcatgctataaaccagctataaacatattttaaagagataaagaaagagtgagaaaagagcagcgagctacagatctgtagccaactgcagtatggactcaaagacgtaacgtgtgtatgacaggtggaccaggtattaatagtatagtgaacaactattgtatgaattggctattacattggctataaatgatttggagttagtagtgggctatactattaaacttgctctaatgccactgcaaatttgtctgttttgataataatattataaattatttgggccttgttcggttgatccctgtgagggaggattgaagggaatttattccacatctattgcggtgtggaattatttcctctcaatcccctccaattctcttcaatccgctctaaaccgaacaagacctaaaccttccaaaatcctatccctgccatgccatacggctgcaacacattttgacattttgatgcgtttttatctaccgtatttctgtaaagaccaaaacacccatgtttccttctacaagtgcgacgacggcggcaacgaaggctgggtttgcatatggtctgcaagtccggcaggcgaggtgcgcctggtagtggggacgacgacaagccgctggttcggcaacggtgtgaacagattcagcaatatcgaggttgccaggtcggggatggtgtgtcctgcggcagcgaggtcgggcggtggtcgtcgatggcagacctccatgccagctcctttcttttcctcttttcttttttttttgtcctatgtgtaatttttacccagatttggtgcgtattgtttgcaatttgaaacaaattagtttgtcgaattgtacggatgtttttgcccgtgtatgcaaaagtttggaattttacctttccgtattatttttcatgaattgtggagattatgggtaccccatacccacacggcatggttatccgactggatataggggataacttatatctatagaatatgtaacagatcatgacttgggtattacgttttcttgtatattatggaacggcctaaagttctggccctctagggggcatgagcacatatgatcgtcagatctaatacacccggtggattcaaatccccaaacatgagtagggtattacctctcattgagagggactgaacctgtctaaatcctttgtctccgcatccatccacttttagatctcgtgcgctacccccttttattattgttgaattcatgtttcgacagttggcgcgctaggtaggggtgcgtcgagttatctacgagaagtgagatggaaccaattagaaggcgccgaatcagattcaatctagcaaggaaaatcaacctcagcaagttggatcactccaatctccgacgtcaccaatggtggtgaatcctcaagatgcagctcgccaagatgccggctggagctgctatacagtccgtagccaaaaaaaatcatctgtatccaagagatcatcggccacgtctccagctaccagcctgcacaaccctgcttgatcgtactgctctgcatggaggtcggccacgggagtcaccactgctatctggacaggcatgctggagcgatggatgttcacacgcaccggatagcaatcgagcctccgatccagtcgtcgtcgtcatcgccgttttctgttatgctcggtgagattgattgctgagatcaaactggacgcttcgagttcgacgcggactcggcgcctcggcggaggcgtgtagcagtgcgtcatccaccgcagccatctatcagccgtgtgaagacagctactcgccgggatagcaatcatccgtccgcacatgcacttggacacgcaaggatcggctctgcatctacacgcataaacacatgcatgcatggataaaaactgctatccggcatcggctaatttatcgttccaatctattattataattatgatttttttaatcatagattgatctgccctttgattcttcgttttctctcgcgtgcatatactggcgtttgacggctccatgattacctccgacgacggcatcatgctgaaggactgttggttacaggggcagatgcaagcacagtggagtgcaatactttcagatgcatggacatgcaaattagtatgcgtatatgctgcatgcatacatcaatatatatagcatataatatctatacgttattgctaattgctattcctaatcagtctgattaatatattgggtattttttgcatgtgagatcatcgttggcctatccatccggctgacgtcgccctgatctggctggagcgagctgctcacactcataatttgcactctgccgtatgcacatatatacacgcgtgcgagcagattgggagcaaacatgtgtgaggacatatcctagcattttccaaccattgctaggcatcttcatcttcacagccggcttgccttcgccgccgccgactggtgcctcgacctacacggctggtctattatgccgctgttgatgggcgtctacgtcttcaccgcccggccgtctcgtccgctgccgactggtgtttccgcctacacggctggcctattatgccgctgttgttgggcgtccacatcctcaccaaccggcttgccttcgccgccgccgattggtgtctccgcctacacggctggcctattatgccgctgttggtgggcgtccacatattcaccaaccggcttgccttcgccgccgctgattggtgtctccgcctacatggctggcctattatgccgtcgttattgggcgtccatgacctcaccgccagcctacctccatcgccaccgactggtgtttctgcctacacggctggcctattatgccgccattgttgggcgtctacgacttcaccggcctgtctctgtcgccaccgactggtgtcctcgcctatacggttggttggtcacaccaccgttcatgggcatctacgtcttcaccaaccggtttgcctttgccgccaccgactggtgtctctgcctacatggctggtctattatgacgccgttggtgggcatcttcgctttcaccgtcgaccgccttctttcgccgccgactggtgtcttcattgttattgacggacgactttgttcccacattggccacctctgccatcatcaaggggaatattacaaagctaagtcatcattaattttctttatatgatatttttcttttcctctgcctcactatatcaactggttcgccgttgactagtgagtcgagggctatagatgttatatcatattttttaaacaattttcataatatttatcttgattgcttgcgacataatctgagtacaaaagtgcctatcgagttatggagttctatcttcctatactttccgtttggtttgtcgatggatagttgcctttgggccgattcctagcacccgggggctcgttgaatggaccgagtaacgcaaggtgctaagtattactcggaagaaatcaaaagcatagagataagataatttattttctactcttaataattgcaaaagtacctaagtagtaaactctgatccatgaaactttgttccactaatgacgaactcatgtcactcatatgcatgtttgggaagtgcctaggccgactcccaatgtttgggggctatgactagtcgggcagagtgtttaaacgtaaggagtcatctgctcggggaaatcaaaattgacaataggagaaatatatatttataaacattttaaaatacttaaattttcctcgagtattatatttgcatcagatactactcatcctatatatttgttctgcaggatccagatccagatatgcataaaaaggattcatggctttaagcttatctcttacactccaggaatggattagtcagaacatcaccacaggcttgcagtcgtcaccgccgactggtgtcttcgtctatacggttggttggtcacaccaccgtcgttagacgtctacatcttcaccgccggcttgccttcgccgctgccgactggtgtcaccgcctgcacggctggcctattatgccgccgttgttgggtgtctacatcttcacagaccggcttgccttcgccgccgccgactggtgtctccgcctgcacggctggcctattatgctgccattgttgggcatttacgtcttcaccgaccggcttgccttcaccgtcgccgactggtgtcttcgcctacacggctggtctattatgccgctgttgttgggcgtctatgtcttcaccgccggcgtgccttcgctgccgccgactggtgtttccgcctacacggttggcctattctgccaccgttgttgggcgtcttcgtcttcactgaccagctcgccttcgctgccgccgactggtgtctccgcctgcacggctggcctattatgccgccgttgttgggcgtctacgtcttcaccgaccagctgcctcgtatgacgacaactggtgatatcgtcttcacggccagccatgtcgctgccaccgctaataggtgtcatcatcttcaacacaagttgtctgcgtctgctgccgaccggtttcttcacttccatggctgcatgattcttccagtgttgattggccttatcgtcttcaccgccggtcgtctcatctgctgctgattagtgtcgtcgcctccactgctggtttatattgctaccactactgatggacgtcatcgttttcattgctggccgccttgtttgacgcctactggcttgttcacctccacggctgcgcgtcttcgtcatcattgactggcgtcatcatcatcgccggtttgccttcggcgccacccatggtgtcttcactttcatggctggcctattttgccgctgttaaagaacgtcttcgttttcatcatcattctacttcttccgttgccgactggttatgccgccgccaactggtgtttttatcttcacaaccacgcgtcttcgctaccggtttgcttatgttgctgttgactcgtgttcacttcatcacgcctttgcaactttgtcaccatggtggagggacttcatctttattatcttcggcaccggccaactcaattgccgctacttcgcaagttttgctacttcaccagccacgacgtctacaagagcttcgacacctcggcatacgtcaccaaatatgatgccgtattattttactacaacaagtggtgttcaaatcttcaatatttttactcggacatcttcaacatgcatcttcacttttgattgcaatgactactcgatgacaagaagctgcagttctcgactctatgttcagttatttcccaactaaccaaagagtcgggggctatacaaatacaagactctcaaatcagccaacgagttctatggaatctacttcgagagttataagttttgtcttcgcttcagagcaagtgttctacttcagcaactccaatgatttcactggtaattttggcttctctacgccgccacaatctactccaaaattttcaagtatcaagtttgagattctatctacatgtccgggagtttagagttatcaaccaatcagctcagtttcgatgagttggacaacaacatttactttccttcaagtgaagcatctgcaacagctacaactccaagttctactaccatctttacaaatcaaggggtgttacatcaatcttcgttatacacacatcaagaaaattacttgagctttgatatcttctcaacagtttgatggattattgtcactgacttcatcaccaacacctctacttcatcggctctgacatctctgccgttgctaatggatgactacgtcttcgcctccggttgcttccgttattgccggcttgttatttcaccttcacggttgacctactatgcaaacgctggtgagcgtattcgtcattatcattggttgctacactgctattgactggatcaccgacatcgtcatctttatcaatatcctgccaagcctcttcaacatagcctattctactgctgtttgatgggcaacttcgtcctcatagtcgatcatctctgttgctgcttatcatcattactgtcggttgtgtttgtcgtcgccgactattttcttcatcttcatgattggtggatttcgtcatcgcctttgatgcgtgtctacatcttcactgtcggcttgctttcgtcaccaccgactggtatcctcgccttcacggatggcttattatgtcgccactaatgggcatctttatcttcttcaccagctgtctcgtctgtcaccgactgattatttcgttgccatggctacacaactttatcactgggcaccttcatattcattgctggctgacctgactgctgccgactggtttcttcgcctccacggctgtgcaacttcatcactttagattggtatcactatcttcactaccatcaatatttttgccacctctggtagacaatattatctctatattggtcgtcttgtctctatgccaactgcgccagctaccatcaatggacaattgtgactacgacagaaggacaagctatatgctcaggggcttactagctcaaacacaagtatcatacctccaatttggacttgttccggatacatgcaacatgaattcataatcatgggtctattttctatgctcaaagactggactatttattattccctgtaagggttatcaaccgaatacttgcgccagtcgggattcaattgttatatctattttggagtatcccataagggataatcacttagatcagaagctattcatatgagctacacttggtctatatcacccggaagatttattactcgggagcatgttacatgcgtcatcctttaaagggtgtcgaaggcatattttttggtctaggcctaatatgtctgcagcccatattttcaggtgtggcctatcacgttcttttaaggacttaggcactttttgcttaggccaaagtgcgcgtgatcaagtgcccaataccttaaaatccttttataccgcagttactcaactttttaggagttggtacaatgcatcttaaaaggtatcaaacagcaaagctttatatagttgccccgctgacttttttatataagtcaaggtgatgtttgggtttttaagcaattgattggatacaatatcattgctttttgccacgtaagtgtgcatttttattgaccaatattatggcttaggctgattatatattatggtcattttctaggcggttggtaaatcctttatgagtttatttactcggattttacaccacatatgccgtatatttccaggcgtggtaaaaccatgtgtcttttagggacttaagcacatctgttgaagcagtgtgcgcatggcttatgcccaatactttggaaatttctttattcacagcattcaagcttttttatagctgttttgctatgtgaattttcaatgatgtagtcaactttaggttgctcgcatcaatttttacaaagcagtcggtatatcatctgggctatgttatttggggattcgcaccgcatatgctatatattgatatcaagtcacttggttgactataattattaaaaaccactcggttggttggattatttattccttgactatatgcttggtttgttcaactaaccacatggtcgggggctacacctattaggtgcatctactcgatgcacataaatttacattcaattatttttcagcccttcacaatctttggatttggtaaaagtattcgggagattatggcaaagatggttaaagcacttggctttggaataatctagttcaagagaagattatctttttgactgtgaaggtctcaggggctactgtggagattatgggtaccccatacccacacggcatggttatccgactagatataggggataacttatatctatagaatatgtaacagatcatgacttgggtattacgtttccttgtatattatggaacggcctaaagtcctggtttgataatattgtaaactagatttaggaaaccgataccgtattggttaaggtttgtatcttgtaatcttgccccacatcctatataaggtgggcaggaggccctctagggggcatgagcacatatgatcgtcagatctaatacacccggcggattcaaatccccaatcaggagtagggtattacctctcattgagagggcctgaacctgtctaaatcctttgtctccgcatccatccacttttagatctcgtgcgctatcccttttattattgccgaattcatgtttcgacatgaatgcaaatggatggaggaacatgggggcaatttggtcaaaatatgaaataaagatggacaaaaaacgcttcaaaacactcagacatatggcatggcatggatatgattttgggaggtttgtggtggcatcttttcaaataaatgaatgatgatgatatttttcaaaatagataaatttataataacatgatctaattaactcgatttgctatgtgggttctaccttacgatttctccccctacatgcatgttactccctccgattttaatgtatgacaccgttgacttttttattatcgtttgaccatacgttttatttaaaaattttgtgtaaatatgaaaatatttataccacgcttaaataacatttgatgatgaatcaagtcacaataaaataaatgataattacatattcttttgaaaattacgaatggtcaaagttgaaaaaaaaatcaatggcatcatacattaaaataaaaataaagaggcagtatatacttgaaccagtaacggaactgcaacctttccatggagtcaatgggcaacaagatcccgccacgccggtgccaggaagaaccaccgcaaaggtgcttgatcgccaaagttgtgttcccgtgcactgcggcacgagcgccggtgagggccatgaaggccaacctcgtagcctccgtcgtgaggctgctatgccacgggctcaactcgccaccagcatctcccgccacaccacctccgcgcgggacagaattacttatttaccgcagttacacggtccattaatgaaaaaaaaagcactatcttggtgccttaaggacatcctcaatgtttaagtgcagtagaacaaatacccgtgcgttgcaagctattttaatctattatcattatacgttttagttaaagtgaaattctctgtgggaattcgcatatatatgcttttagaaaattatgagctgcagttagaagtctgatcatatcaggttagcatgcgagtttttttaagagatttcttatacaactccttttgtaattccaaaagagaatgaatttaaaaaccgactcaaatacggatatgtatttccaaaaacgaacgaacttagaaaccgactcatacacgaataacgtaccaaagtataaaaaaacatcttcaatttttataatagtagagatatagaccataaggtgggacccacaatcatatggtctttcacttataacatatgctacaatgtttatgatcttttctcaaccttaaggtaggacccacataaaaaaatatttttaacctttaatatgcaggattcaaaaaccaatatggatgttacaaaggtataaaatgatttttttttattccttatggcgtagccttaagcttaaggttgtccatagcaactttttctccttttattttctcccaatgcataaagtgagaacataaatattactttaatcctaaggtcatttttacatgcacattgtggatgcccaaagaacatgttcagattggaccaaactgtcgtgtatgcgtcatgtcaatgtcacgtgagacaaaaacctaatcaaaagagccacgtatgtgtcatgtcaatcaaatctggagacaatattgttgagggacctcgtttgcattggttttgtaaagttgggggatacattgtatgcggttttgcggtccagggacaaatttcagactcaacgataatttgaggaacccatagtgaacttattccttcattttttatttgtttgggcccggtccatgaaaagcccatagaaacatgactccacggacaagaagccactcgtcgttaacccccctgccagtgagccaccgcgccggcgcgccgtcctccgcagtctgcaccgcaccgctcgaggggagagcgccaccgggacgagagacagcgtgaccatcctggattctaacttctgaggggtggatacaccactctagctcatggcagcgcggtgtggtgcgacgcggcgggccggcggctcgccgcgcatcgacctagcggcggcgggaatggtgcggcgcagacgggacctcgctgtccatcgagtccaaccctctctgctccaaccacagcgccggaccgccagtgccgccctgtccttctccaactctacggactggaaggggcaaggtctctggcggtgaacaattggagcttgaacaaccatggtgggttgtcaagcaatgcacccaaccccagcgctctccgaaaggtagcctccccttcgtttccagcctactgttaccttgggaaaacctggccttgctagatcgtgcactagttaattggtactgcattttgttatcatgttggaaaccatcatatgattttcccttctaaaaataaaaaacagcaggagctctgcctattcaattaagaagaacagaaagaaacatacacagtcatagaggttcttagttacaatttggaagaaatagatgcaacaactaagaaaaataacagctagaaatattcgttcctagttttattccccctagctaatctcctccctaataataatatgttgttgaaacattattcgagccctttctttctatacattctgtcaggtcctaattagttatccatggattaatcttctatcttctttggattgctcccttaccggtgcataccaccaatctttgttggacagattgtgccaattggatctttctatccaggccaaattatgagaatacgatttgccgtctattgatgaagaattgacacgctttggctaaatggatcatagtctcatcctccatgataccacaaagcgagcaagatgaactactggccatcccatgatggtaatgcttcagttttatcagtgaattgaattagtgggggtgtggcttcttctgccttagatgttcaatttattcaaattctaacaactatttttttgtctactgtcttacccttaatatggctttatgtttgtttaattgtagacaatacttcagttcatattttggtcaatgaactgggaagatacttgtaaatcaatgaaccttgctgagctgcatgaactgctctccggttcatccaatccttgtttacagtggctacaatctcaatatttgtagggtcagatgctgttaaaaacaagatcagatgatacaccagtttggaagacaatctgtggggtggtggaatcagtgagtgcttcaacaaaggtctcagtgggtaatggccagtcagttcaattctggagagatcactggactgaagcaggttgctttcatacatctttccgaatgctcgccacctttcccacaaacatcaattgcccagtatcttcccagttcataaacaatatgtgggccattgatttacgcacagtccaattcagtatccagacaagctcagcttgaacttcaattccttatggacaccttagctgatcaccaacttcaacatgagagaccagatgagagggccttcatccttacctccgcaggaaccacaacagccgcggcttataatctgcacacatatcagtatcacggcacactatagaaactggcagtctttatctttctttttttttatcaagggctgcatggcccccatttccattaccagaaatgacaatcagagttcttacaaataaaaggaagaagaggttaaaaaaaaaaagagacagcaagagagagggctaggcatagagggtctgggacagacagagtgaacaggcaattactgaaacagaccacaccctcaaaatctattctatgaaccctgagccagccaaaacaaaactacccaagttgacagattacatttttgtgcccagattgaaacaaaagcaaccagcgtctggtatgatcttcagtcctccagtcttctgattcccgtcccccagccaaacttgggacaaaccaatcccaaatacttgcataattttcatgtggctagtctttagtgacagactaaacactaatggaaacagagtccacaaacaacggtcatcggaccctcactgcagtttctgcctgggcaactgaacctgcagatctatacaagcaagcaacaatcagcaaaaatatccgacaatatgttgacaccttcaacctggcagaaacatctcaggatcaccttcaacctggcttgtctgtatgctttgccgcctgctcccacaatctgtggaaggtgcacaataatatggcttttcgacacgcaaatctcaacatattgaaccttcttcatataaaaaaaactcagcacaagtgctgctggtaagatacatgagaccaagtggagcatatccctgtacaatgtaaaaccactgctggtactagatgtggtaagaggataggatccaccagaatttttctcattctgtttcaagaaccagcacttccacaggacctcagtttgcagttcagttttgaaggaatcattatctcttgcattggggccaacaaagttgttgtagattcttgaatatgctacatgttttccttttgtgcagtctttagtaaatgtaaatataatgtaagatgaacttgcattgtcaatatacatcctggtatctgacataatttaagggaactgcagctctgttctgcagctagcatgttggttctgtaattcgatgcaagaaaaatgccagggtgccggtggcactcatgttataggtgacatcgctagtgcaaataaaaggatatggtctgaatgtttgttctatattatctgaaatcgtatcatatattcatatgtcatccattgaggtcgaaatgcctgtgatgagtgatgatgggtctttttgttgcatgtatcactgcagtcaataattcagtagcaacggtgcatgttttataagcattgctcatggtgaatctgaaaaatgctcttttggagcatgttgtcaatttgtgaaggattacatccatgctgtgtcctgaagggatcacatcatgttggtcgcttatatccatacagtgtaggagaacaaaacctgagtttcagactttcagtataaactaatgtactctgttctgaatttgaatgacagagctttattgaatgtgcaccactcattgtacatggatgttacttacattgaattcataccaatcaacagcaatctcaactaataaatcacatgttacatttaattcaactaatgaactaataaatacaggtaattccaggacagattcacaaaactcctaaacttctagccgctgcacagactgcagtactgcactacagaggaataagaactgatctcttgctaagaggacaatgtcagcgttgatcacttgctctctgcagggcgctagtctgctggcatatcggaaaacagctcgtccatgtcgaaatcgaggcagtcatccgtggcgaagtcaatgtagctaagcacttcatcaatgctctctgggaactctagatcagacaacacaatcggcacctcgctgtccatgacgcccaaaggtgaggagttactctgcttgttcagcactggagctgcgccaccaccaccaccggcaccggcttcctctgtctgcgacaagaacaggtcaggcatgtccgacacacgcagagatcgctgtagctcatcgtcatcgattctcccgggaagatcagcaaatagcagtgacgaatcggccatcacgtcgtaggagttctggccctgcagtggtggcactagagcatcagtaggaggagcgggctgtggttgcgggcagcgctcctcgtcgagcagagcgatctcttctctctctgcaccaccggtggcatcggcttcctatgctggcagcgcgatcaggtcggaaagtccatggaacacccgccaataatcgtcgtcgatcacgccggaggagccctgctcggacagctcggtgccctctgtttgcgacacagacaggtcatcgtcatcgattctgtcgggaagatcagaaaacagcagtgacgaaatgaccatcaggtcgtaggagttctgcttcaccagagcagcagtaggggaagcgggctgtggtggcgaccagcgctcctcgtcgactgcaccagcagtggcatcagcttcttctgctgggggaacgatctgatcgggaagacaatgtgacaccagcgaaggttccccgtcgatcacgccataggagccctggtcggtgccgtcggctgcaggaagagccacgccgcgccggggagccgcgcgttcttgatcgccgccgtcttcatcatcgtgggagtccagacactgcggctccctcttgcgcttctgaacctgacgcggtacagccggagcggcgacgaggcgaggtcagccgacgacgtgacggcgtactcgtgcataacccagcccgagctgccctgttcaccctcggcgaagaagctcagcacatacttgcgccacgtgatctccaggccgccgccgccgctgccgtcgacgccgcctccaccgtcgcctgggacgaccagccgctcgccatccacggccatccgctgcccctgccagaaccctccgccctccacggttcgcttctgtcgctttcccttgccattcttggcgcgtgcccccgcgaagaagaaggcctcgtcgcctcgggtgtgatccgcaagaggcgtccatggcggcacgctcaggggatcggcatccacgatgacgccgtcgagcgggaggggcttctgctggatgcgacggaggaggtagcgggagacgagctcgtcgtcgctggggtcgaacctgaggccgggagggagcccatccgcgcccgccatcgtcgcctggaactcccgatcgcgcgccgcgccgcgccgccgcctggggatttctagggttttgggggaaatcttggtcgagaggagaggagaggaggatgcgcgcgtgggatgtttccagtaaggtgggatttgaatttattgggggcgctgacgtcagcgtgagacagcgtctgtctcacgcgcgctgccgcgcgagcagcgggcttcttttttggggatacttttggggatacttgttaggaatttgatttaaactggtgctggtcatacgccttcttatttttgaaggaattatttgtaaaagaagaaaattgatgggcaagtgctgttaagtttgaagacaatcaaactgaaggggcaatgtccttttttttttttaattcggatgttacttatagagtaaatttatttatcaacaagtgccaatatcttgaattgcagtctctgaccaatgacagctgctgtatcaatgctgattgggactgaagaaattaatcagggaggtaaatatgcagaaattgtggaaaagaaaagaaactgatcttcaacttgcaaatgctttcactcactgaagttttgcaaagctgactgcatgccttgagatattgatagagggtcgctatgttatggagaagatgttaagagcattttgtccatactgaaggtgcctctctgatgcatgccaattcctgaatctttgaaggattgtatccatgattactaaacaggacactattagagttgcttacagtattttcaaacaggaccctgttgtgctaccgggacacaattgttttgtttacttcagaggacagtaataaaatgagataatctattatatgccactgactttatcacacgtctacgatttgccactgactttatcacgttctacaatatgccatcgacttttgcttaacttctacgatttaccatcgccatccggatagtcttcgttagtactgtataaatttgtcaaaatgaccaaaaatacccctaggacaaaaactttcaaattttggataaaaattctgaaatgtcagattttaagtttttggccaaattttggatgcttacaagcttatgttaataatatgatattttgataattttatccaaattttggaaatttttgttctaggggtattttggtcatttggacaaaaatgaacagtgcgaacggaggctaaccggacaacgatgataaatcgtaaaagttaagcaaaggtcgatggcatattgtagaatgtgacaaagtcagtgataaattatagacgtctgacaaagtcagtggcatataatggattctctctaataaaatagaagggaccagacatactgatattgatgattttagcagattcacatggatccagatatctcttcaagaataggtctgatgttgagcattgagtgtacgttcattcaatttcagtttcaaacatatgttcagagatttctaaatagtaaaatctgctcaattcagactgatggttcgatgttgacctgaagattgcacaaattctttctgaaacttgcacagattcacatcgtgtgtcagtgtgtgttgcccacatacacattgcatagactaggctaactcttctagcacatctcttcctgttcgcttttcggatgaggccttgctaactgcaacttaccttatcagcaacgacttcatcttcagacaaccaacctgcacgtaaacctgtattgtgtgaggagcagacaaagactgcagaataatgtgcgttatccgctaagaagccatggatacagtgtggactatgatgtgttgacgagggaaactgttttaatccctcgaggggatatcccctcgttctttgtatgtcacttaaatggttataaaaaatttgaaaaaaattagaaaggtgtattaacatgtgatataacacttcacaaatatacaagttcaaattcaacttctacatctcgtaacgaaaaaaacaaattgaaccgcagctagttaatgtatattcagagtcaaatttgtttttttcgttgcgagatgtagaagttgaatttttacttgcatgtttgtggagtgatatatcacatattaatacatcttcttaatttttttttccaatttttttataaccatttgagtgacatgtaaacaacgagaggatatcccctagaggcatcaaaatcctcttcctgttgacgacacctttagtccggttgtcagacctgctacagtgactaatattatcgccagcagtagttttgcatggctgatctttagccaaaatttatgctatagtttcttcttttctgctgtgtgacctttgtgaagatgtatatatgcaataaccacctggtttcattggtcctgctcactcaacacacctatggaaactagatgagttgtatggaaataaactggatactgagttgcaggagttgggctttacacaaaccaaaactgaaacttctctctttatcttccatcaatatgctgtcaccacttatatccttgtgaccttgtctatgtgaatcatattgttattgttacttcatctacagaatatgcccagtttctgaaaaaaaatatgcagaatctgacactgcactaattcagcaaattacagccatgtttggctgtttgccctcaaggctacagggaagctgtcatatattctgggctttgaaacaaatacgcaaacctggaggtggtgtgaactgtgaacttgacccaaaagaagtatatactcctataccaaattatgaatgatctgctacagaggattggtatgcaatttgccaaactgattgcattgcagctcctatcatcatatgtcatgttcagacaagttattagctaagtattgtggactttgtggtttcagacattcaggatctgagatattaaaatactcagaattactcagttaataaaagtatttcagtgtttacaagttactgtactggtcggctacataactgatcttgctgatctctaaagattatagcttgtgctaggcttactattcagagaaggcagcctgttcaaacgctgactgggctggtatttctgatcacagattaactctttggctttttttttttttacgaaacgcagattaatcaatggacatgtagtgcgcctatgccttggaaccaacttgatttcctgctgctataaaaagaaccaacagtctctcgatcaaatacagtctgaatacaaagctgtggccaaaggattcagaagagctggctcggtatggaagtaaattatggcacaatctttttatgaaatgaaactctgggcaccatcagtattgttgggcatatttctttttgcattcttctcctgcaaagtctattgtaagtatcagcaaaatatcagcaaatgactttctttaaattgtaatgtcaatgttgatctcgacctccatgaggctgcttcgctgctacacgccatggtgataaaagcgtcctttccaaaaatttatttctctagttgagccgaaacatgttaaaaataatactgaccttcgtttcaaattagttgttgttttaatcttgtcctaagtcaaatatttgtacttttgaccattaatttctagaatttgacattacaacgcaatgggccggaccggctcttgccaagttacaaggaagggactgcaggggcaaacaaaaaggaaaagataaaactaaagctgttgctcctagacagagggaaagatgcgaaaaggaaccccctatcctcccaacaaatccccaaacaaagcggcactagctaaagaccagagatggtcctcttggaggatggaccccaacaccacctagaccagcgaaagggaagaatcaaaaaccctgacgttccactccttccaaagctgtcaggataggaacagaaagtcgaagcccttgtgaaggtgctcaggcaagtagaccctagcatatgaccaccagccctgaagagtgtcgccacgggaaggagcgagcccaggccagctagacttggtgagcgaacacacaatcgagaaggatgtgattcggcgtttcaagtttcttcgcgcaaaaggggcaggccgagtggccgtcaatgccacgcttctgcagaaggtctgccatccagcagcgttgctggaatgcaagccaaagtaacaacttgcacttggcagggccctcagcctgccacagcagttcggtgcaaggaaaggggagttgcccagcaataaagcatgatagggcgagcgggctgagtagcactggttgcccgtccaacaccatacaagacagtctccagttcccggagagagctaggtaggaagcacccacatcctagaccatcaagaattgggagatgacaaggacaatgagggcgccacggatgtcccttacccagtagttgtcggcaagggtggaggccaccgtgtgtaatcccctgagacgtagggcaccggaaggagattcggagccatggagtctagaagtttatatggtcaaacatcataaaatttatgcttttagatgcatcatgaaaaatactttcataggagtaatatgtaatttgcatgtcataagaatgtatgaatttcaaaattgattgtgaaagatagatatattcaactttggacatatgtagaatcacaagtaatttgaactggatggagtagttgtagtgttttagcacattaccaccaaaacaaagtgtcatgtggccaggggacacacacaaaaacaaacaaacaaacattttttttaagtgtgttatggcaaatgacacaacactatgatgtcttatatcaaattttaccagaataaaatgatactagaatatagatctaacataaaaaccgataacataactgtaactaagaatttgagggggggaaatgctgtaggaaacacgaaaagcatgtctagtacgataacattaagataactcgaaaatgggtatgctacacgcacaaagatatataatcaatgtacccatcttataacccctaatccgtcatggctcccacataaaccgtattcgtattcgctcctgcttgcagtttggcctttctgtcctgctgataaagcttcaccagatgctcaggagtgcggcagatgcgcgaccagtgccccctgcacccgcacctgtagcaaagctgccctgcattcttgttcttctggtgatgatcacccggcacgttcttgttgaactgggggttcccattcttgttgagctgggggtttccattgccctgccccttgttgcccttgccaatcaccttgctcatgttgctaatattggtattagcaacgttgttgttcttgttgccttggcctcgtccgcctcgcctgtttgcaccacctttccgctgcccttgctgctggttgccggccggatttggagcagcgccggccgctacgggttgcgggccggtgcgaccgccgccggagttttggttgctgttcgtcgtcgtcgtcgtcgtcatggctgatgattcactctggttcgatgcaaccaatggtgtggaaaccggtgtaggggcagagtgggtgttcgccatgagctgctgattgttctgatccgtcagcgggtcaccggagttggggggtttggccatgccgcacggcggcggcggcgacaggggattgcgggcgttggcgccgtcgtcagccatgaacagatgatgctgctcctgcttcgtttgcggcaggttagtggcggtcggtggtcgaagtcgaacccactgccgctgccgctgccgccggagaacggctgggttggtggcgttcgccgcgtgctgcagaggcggcgcgttcgcgggttttgcagctgtcacgggctgctgcttctgttgctccgggagcaagtgttctccggcgtttggtgcgttggccatcaactgcttctgctgaggaagcaggtcaccggcggcggcgtccgtgggtttggccacgggcggcggctgctgctgctcctggaacgggtgttctccggcgtttcttgcgttggccgtgaagtgcggcttctggggcggcaggtcaccggcgttcatgggattagccacgcccacgcgctgcagccgctgccacggcggccgcttctggagctggccatcgcccgcgtgtggcgcgctagctgtgaactgctgccgcgatgggttcgttacattagcctctcccacgcgcgcctgtgatggcggcggcggcgaggagcccacgatctgcggcgttggcgaggggaacacgcccacgcgctgctgtggcggcgaggaggaggagcccgcgaccaccggtggcggcaaggggcacgtgagattagcgtgcacgcgctgctgccgccattgcagcggcaggcgatctccggtgttcggtgcggcggccttccgcaagtcacacgtgtcccggggtttacccatgtgctgctgcggccggaacgcggccgagtggccggcgttcatggcgttagcggcgtgttgccgtagcacagggtggctgccgttcggggcgccggccgtgtgctgctgctggagcacagggcaactagggatcgggggtgactgcgctgtaccactaccgtttcgcgcgcacaaaccttggccgccgccaccgccggcgcgcttgcagacgtcggttagtctcggggcgtccatgctcgcgcatgccgccgccgtaagacccgtggcgccggccggaggagatggactcacctccacgggttcctccttgacctgcacctttgacggagacgccatcttcgccgccgccatcccgccgggtcgaacgaacccatcttgcccgacaccggcacgctcgccggcggtattcgacgcgcatgccgccgcctccacaggctcctccttgacctgcaccgtagacggaggcgccatcacctcgtcctctccctgttcctggacgtcctccatctcgacgtcctcgtcgtggctcgcggcggcggcggcggggggcgcggggcgggaagcctggagggcctgcagctggctgaagcgggcgtggatggaggactggagggaggagaggtgggagtcgaggtcggaccagcggaaggggagggggatgggcgagtggaggacgaggctgtcgtaggcctcgcggaggccctgcttcttgccgtgcagcgtcgcgatggcggcctccacctgcgccgtcgtcatcgccgtcggagggggttcaggaaggcacaggggcgttgccgtggcggtggcggtggcggtggcggcggcggcgagctgttgcataatctccatcgcgatcgattcttgctgcggccggtgggaagccgacgcggtttatatatacgcacgcggccgcgaacagtccgaggcggataggatcaggattagggcacaattcatcacgattagaattggagtcgtttgtggtggattagatttgatttgaaggatcagctgccttgactgggcctaggcctttctgggccgcttcccacgattggtctggcaggctacatttcagcccggattttggattggaaaaagtacatcacatttcgtcatggcgacagcgtctttgatgcggtgggaagaagggtcggcgtgaccgccggctgccggggaaggagcacgtccaacaggaggtacatgcgacaaacggcgttgccgatagctgccgtcgcgcggatggccgcggcggtcgtctaccttccctcctcctccgtgtgccgtgcggcaccattgccgtgatcacgtgtcgtcatcggggtgaggcggcgacgcacggtggtgcgggcagcacggcggaggggagggccggtgcggccaacgattggcgggggaggagcgcggcagagatgagggccgatgcggcggcggtggcatcatcgatgtggtggggaagatgtcagcgcggccgacgaggaaggagcggcggagattggcgtcggcttgattgaggtcgagacgccctccacaccttagccgccggcgtcgagtcgatgtcaccgccagatcgaggtcggtgtcgccgccggaggagatgcctcgaccgacgcagtcgaatccccatagcagcagcgcagccccaccatttccggtcaagggggtgttcacctatgagcaacttacggcggcgatgggaaacttcgcggagccatccgaaacctctttgctgcgtccccagcgtgctccacttcccggccgcgtgccacatcctcctcaagggctgccccacttcgctgacttttgccccagggccgcctccatcgccttccccgccctcggccctctttatcctctacgatggcttttccttcgtcggcctcgtatcagagacaatccgaagcatggtggtgggcgggaggcgcaagatcgtggacatgctatgccgctgccctaccctgccggccgccagccgcgccgctccctgttgcacgtcgttttcccttcaatccccggtggtcctctctccctcggtcaaaacacgcaagcaacaaaggagaaaagagaaaaaaaaaagagaagaaagaaaagaaaaaggggggaagagaagaggctgacatgtggggtccacgtgggtctgatgtttactcagctgccacgtcggaaccggagttaaaactgcctaaagtgattcggttttgtaagattagggatgccatatattagttttgtatttggaggacgattttataatccgatgacaacataaaggaccttcgatatactttttccctttggattagctcggttggacctggcccgtggaatatttaatttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10352 - DNA, 731 bp, Oryza sativa
ccgctcttgattgtcgagctcggtacccgttgctgatgtgataaaaaatgcagatgttgtactgtcgactttgactggtgcatcttccaaaaagctagatggtattacatttgatttggtcattattgatgaagctgctcaggcacttgagatggcatgttggatagccttattgaaggttaatactaacttatgactagttttttttttcatgttgctgcacgttttgagaatgatgattgctgtaaacagtcatcaaaggttctcgtattatttatgcttttttgaatagcacaataaagatagcatgtactgtttcacaaactcccacccacgcgcgcctgtgatggcggcggcggcgaggagcccacgatctgcggcgttggcgaggggaacacgcccacgcgcttgctgtggcggcgaggaagaagagcccgcgaccaccggtggcggcaaggggcacgtgagattagcgtgcacgcgctgctgccgccattgcagcggcaggcgatctccggtgttcggtgcggcgggcttccgcaagtcacacgtgtcccggggtttacccatgtgctgctgcgggccgaacgcggccgagtggccggcgttcatggcgttagcggcgtgtttgcgtaacacaaggtggctgccgttccgggcgccggccgtgtgctgttgcttgagcacagggcaactagggaacggggtgactgcgctggaccactaccggt

SEQ ID NO: 10353 - DNA, 1236 bp, Oryza sativa
gcccatgattacactcgcacccaagctgaaattttattgtctctaataggtttctatggagaaatttcttaagcggaaagcaccagattgtacaagcaatgtggggagttcatatcccttcgactagatgatgccagttgggaaaagacgatcgaatatgatccaggctcaaggaaaggaattgatgattatcatcccaaccaaagagccaaggtgagaagaaagtactcagagaatgggccttgccaacctggtgatcatgcttttcccatatcagttatttctaacaaagatagaaaattcaatccggcatggtttgatgagtttggtggatggcttgagtacaacaagtccaaagatagagcatattatttcttttgcttcttggttagggaccggaataaaaagatagagcatattatttcttttgcttcttgtttagggaccggaataaaaaggaggaaggatacaaagcatttgttaacgttggttggaatggctattatagaaaggataggcttaaagagcatgtacgtggagttggtagcttgcacaataaccagcattgttaggaacttatgatggttgcttggtgggctcttacgacaaaaaaaaatatttcgcacactacatcgttggactaggttatgactatttgtatttggtctagtgacaagcaccttattttcattagtaataacacccacccctattggacaatataaacccgaatggcatattgacgaatagttttaatgtattaagaaattcgtcacaaaaatccgagcctttcagattccgaccctgatttattattcacggttttttttgtggtttcccagagtcatggaactaaccactatgggggtttgggtgaagcctccttgaagattgggaaaaaaggggaagggtgctttttatttattttcccaacaacaaagcaggggtgcttggaaaatttttgttttttgaggcagccacacaacttcttgtcacaaaggttcaggggcaaatttcgggggtccccttttcctccttggaactcaaaaattttgaccgggctgttcctctcccctaaaaattcggaaaaacccccccctttgtggggcttttgcaggttaccaatatgcccctgttctttataactcgttaaaaaaaaatagtctggtttggcagccccacaagccatatatttttgccggcccaaaatgggctttatccacaatatgtgtgtgg

SEQ ID NO: 10354 - DNA, 609 bp, Oryza sativa
  unsure (1)..(609): unsure at all n locations
agagcnntnnnattgaaatctatctcgtagcccgtccataagatgctcaaaattcagatggtacggaacctacaaaagaactagtggatgaagccaaggttggtgaacaacatggtgagctgaatgtgaatgacagggaagaacttcttagtgaaattcagaggttgaaggatcaactgaaacaacaagcaggtgaatccacaaatgtcagccttctggaacatttgaggaatggcagcacagaccaagaatatgagctagacagagaaagggagaaatggatggagtctgaaagcaaatggatatgcctaactgaagagctgagagttgatcttgaatcaaatcggatgcttgcagagaaaacagagatggagcttagcaatgaaaagaagtgcactgcagaactggatgatgccctccaacgagccatctacggccacgccaggataattgaacattacgccgagctccaggagatgtacaatgatcttcttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10355 - DNA, 636 bp, Oryza sativa
  unsure (1)..(636): unsure at all n locations
tggcccccnnaatagatcgacttcattgacgccngcggnngactctagaggatccccgataatgaagaagcacagtgcgtggcttaagctgctcctctgtcccaagaagccggcgaggtccgcggggatcgtcgagacgtgggcgggggaccggtccaagctgctcctcgggcccaagatcgcgtcggggtccaacagccgcattcaccgcggcatgtacggggagcaaccagggcagctcgggctgggttatgcacgagtacgccgtgacgtcgccggctgacctcgccttgtcgcagctccggctgtaccgcgtcaggttcagtggccacggcaagaagcgcaagagggagccgcagtgtctggacttccacgacgacgacgacggcggggatcaagaaagcgcgactcaccggcgcgccgtggctgagaccactctgttcgacggatacgtgccttgtcctgcagccgacggcaccgaccagggcacctatggcgtgatcgaccgcgaatcttcgctggcgtcacattggcttccctatcagatcgttcccccagcaggagaaagctgatgccactgctggtgtagagaatcctttgctcgatgaggagcgcttgtcaccaccacaacccgtn

SEQ ID NO: 10356 - DNA, 627 bp, Oryza sativa
  unsure (1)..(627): unsure at all n locations
aggggtcgattgaannnnnnnnnnnnnnnnnnnnnnnnnnnnnnnnnnnnnnnnnnataaactacactcttaagattttgtgcttagatagtcatccggggtacaaagtaccagcaataccccctcgtaaatagaactgacaaaacagtagataatcaagcaataagaagtctaacacaacagcaatactacatgaaaatgctctccccttagccatgcccctcctcatccaaaatccatgtaatcaacttcacctcccacagaattctgttgatctccacctttccaagagggaggagacatatgcatcatatgggtctgcttcttgtgtgagggtgcggtcaacaaaccccttgtcgctttaggctaccctctatacctgcagccagcaaaataaaaaatcctggctcaatgacaactaaatagtagctctcatttctatcatttccctctaatagaattccatagcgaaacaatcaacctaggtgatgtgctatttccatgaaagcacaagccatgatgcagtttttgtttccaccatctgtttgttaggtaatgtattgtagccaattaggacgtaatgttgaggcttatgtcgatgacttggttgtaaagacgcgcaaccag

SEQ ID NO: 10357 - DNA, 700 bp, Oryza sativa
  unsure (1)..(700): unsure at all n locations
nnnnnnnnnnnnnnnnnnnnnnnnnnnnnnnnnnnnnnnnnnnnnnnnnnnnnnnnnnnnnnnnnnnnnnnnnnnnaagtgtcatgagtcacttnnnnnnnnnnnnnnnnnnnnnnnnnnnnnnnnnnnnnnnnnnnnnncgaggtgagcggcggatgcgcctactttgtcatttggagaatgccggatgtgtgccacgtgtacaagtactccttccacgacgatgcggcgacgccaatggcagagctgccattcgaatggaccttcatgatcaagagaacactgtggttcctgccccagtattccagcgtagccccaactccaacccaagtaacttatactcctaactatttccttcctcccttccgcaatcccaccctaaaattttttaacatgtcacatcgaacgtttgaacacctgcatgaagtattaaatataggctaaaaaacaactaatttcacagattgcgactaatttgccagacgaatcttttaagcctaaatgctccatgatttaacaatgtcgtgtttacaatgtcatgttacagtaaacatttgccaatgacagattaattaggcttaataaattcatctcacggttttactgacggaatctgtaattaagttttttttattagtgtccgaacatcccatgcgacaccatatttaatatccgatgtgacacgccacaactttacacc

SEQ ID NO: 10358 - DNA, 626 bp, Oryza sativa
  unsure (1)..(626): unsure at all n locations
aatgtgattgaatcattggaannnnnnnnnnnnnnnnnnnnnnnnnnnnnnnnnnnnnnnnnnatctgtggtgagttttgttagggcgaatttgtggtgagttactatgaatccttgtcagtgtgatgtataaagtagatatccataaccagctattttcccttttctcaagttgttcctattatttgtctttcaaatgataaaataattggaggactcactcttttcgggaaaagagttaatttctccagtgggatcgtgttatgatgattttttttcaaaaaaatattcaccatgtttgcaggttcttttttgtgagagctgggatgatggcatggttatttatcaacctatctttgtttgcaaagagctacctagctggttcagccaatctttcagtcattctctaccaattcttttgtgcggtattggacatggacatttcttcttttgatcatcatatactccatagttcatgatactagctatgtttcttcatgcagtggtatattgcagattacttccgtcatgaagaattcatgacttcaacgtagtatatcattttgtcctataatataaagatatgttaatatcaatccagtgtgcctgaatgatcatctgaaatg

SEQ ID NO: 10359 - DNA, 630 bp, Oryza sativa
  unsure (1)..(630): unsure at all n locations
taggtcgattcattcnnnnnnnnnnnnnnnnnnnnnnnnnnnnnnnnnnnnnnnnnnnnnctccggaaaaagtacacttaaaaggacttaaggttcctcagcttatcatcgagttataaaattgtccctaaccacaaaaactagatatttgacatcctccaacttacaaaaaccattcactcttggtcctcgggtggtttttaccctggtttcgttcgatatggcagctgttcactcttggtcctcgggcggtttttaccccggtttcattcgacatggcagttgagtaagcgtgagacccacatgccaggtgacacgtcgtcacctctatttcccctttctctctttactcctctctgtcttctctgtgtgggtgaggcggggcatgtcgacgaccgagctccaccgccgcacccgacgatgacgacaacgcacaggtgcgagcctggccggagaaggggcggcgggcaccagccgcagtgtcagactccgtcttcacctacgttgccgtacccgacgatgatgacgacgacacacgtgcacgaggccgggcggagaaagggcgatgggctgtggaacggcggaaggcaacagccgcggcatcagccaccgaggccttcgtggggagag

SEQ ID NO: 10360 - DNA, 633 bp, Oryza sativa
  unsure (1)..(633): unsure at all n locations
ttgttcgnntccattnnnnnnnnnnnnnnnnnnnnnnnnnnnnnnnnnnnnnnnnnnnnnnntgctgccgtcgccgtatacgaggaggcgacggtccccatgtggccgttctcctcgagactagaatttacagtcaggatcctcaagtttgatgaacctcccagcatgcatttccaatatgtgattcagctaccaacacagggaaggatgacgttcttatcaaaggttgcagccagtcggagatctctatcagtaaaggatgcagacaagtgaagtgctgcatctcatggataacttggccaaccagatgttcatacaaggaatatcaacagatctgcaattagcaacaaggtcaaaattacgaactcttaaataaaggtgacccagtaggcaagcacacactccattgaactatacatagaaatccttatgttctattatgagctgacagtcaccacaaacaagccattctgaacagaacttagtttggccagcaaccggtaaccggacagaataattctaaatttacatatgtaaaaattaatatattttttatttaaatccatatcattctggccagttactaccccgtaacctgtccccggctccagaccataacaagctagtaactgc

SEQ ID NO: 10361 - DNA, 627 bp, Oryza sativa
  unsure (1)..(627): unsure at all n locations
tgtgtcgatcatttnnnnnnnnnnnnnnnnnnnnnnnnnnnnnnnnnnnnnnnnnnnnnattatatatataacaaagtaaatacatctaagcacttatgttactcaatgatcaaatgatgaacttacagtcctagggttcaaagcatccagccgccgccctgcacctctatcaacagctgtcctgctagtcctctcaatatcatcaccagaatcggaaattgtagtagtcttggccccagctcccagtatcccctgtccctgtacagaacgaggggagaatagaatgaggtgaaaaaatctcacgagtgatgtgatagtataaagcagcagttacaatgctatgaacatatctatattttttcaatgggagcaatatctatcagtcttgatacgatactcaggatgacaagagcattgaatagctacatctacaaaaaaaaaaaaaaagaagttggcttgccttatttggctgctggagctggtgccttgcttacaaatattttgggttcacatgaatgctgtgggatggacgattggattgagaatcacgctttgatggtgcagcgcctgatgatccattagtagatgatctgaagccaagttccttctcaatcacttggagtgaa

SEQ ID NO: 10362 - DNA, 631 bp, Oryza sativa
  unsure (1)..(631): unsure at all n locations
agtgtcgattcatnnnnnnnnnnnnnnnnnnnnnnnnnnnnnnnnnnnnnnnnntgaccctccctttctttttcacttaaacattatagtgtaccgttgaatgagaaactaagagaaactatcatgtccatccatgatcattcagaatgaaacgccaataccacaatgccatagttgaaataaggaaaacaaatgcaaactgtttgaagccagttacatgcatactgcaagtacagaaattactgtgtacacaatgaacatgagctgtaactaacataggaaatcaggttatcttgagcttcaacaaaatgaagaaaatgttgaggggaaatagggcaatttagatagagagagactcacgtagcgatggaacatctccacagccttctcagcctcctcaacggtgctcatggtgacaaatccaaatccacgactccgatctgtttctctgttgtagatgacctgaacacgcgaaaatagaggttcatttctgatcaaaagaacaaaaccatgcatatcctaatattttgtctaactgcctctatacggttcacataataaataaatgaataccctaaagacgggaaggtaaatatcaaaggcatctttcataacacaagtaggatgcccn

SEQ ID NO: 10363 - DNA, 12625 bp, Oryza sativa
  unsure (1)..(12625): unsure at all n locations
taggttgaactacccatatagaaatcatagatacgccactcagcaccacgtcagcgaaaacacctacaatattgtcttggagttgggactatatttggactggttttaaaatatcagatatatgttatattcagcattacaagtaatgaatgtaattcaaactcaatgttttgaacgtgttccttgaaaagaaccgcacgagttagctcgtctatggctgtgtttagatccaaagtttggatccaaacttcagtctttttccatcacatcaacctgtcatacacacacaacttttcagtcacatcatcttcaatttcaacccaaatctaaactttgcgctgatctaaacacagcctatgttgtgggctagcaaacaactatagctacctgcagcctagccgtgcccgtaaccggtcggccactggtccatttttatctgtctatcacgtgggctggcctgttttagataaatttgtgctgcaaatagtgttcaaacagttcacactagatttgtttttttcctcaatttgtacattaaatcttgagttgattttccgtgtgttactacatgtctgttacacatgtaggatatttctttgcattttcttgtacttttcggatacagttttaaggctgagttttttctttcactttcccaactcacatattttattttccgagcacacaatttttaaactactaaacaatgcattttttttcaaaaatttctatgcgaaagttatttttaaaaaatatattgatatctattttaaagtttttgctaatactttaattaatcgtgtgctaataaacaaccttgttttccgtctttcggaatgcagcctaagcgtaacacgatagcatagcactggtcggtagtaaacaatgtttacaaaaccacgtggttattacgtgcggtaaatcttcttagtttttaaaaccacggtatacctcgcgataaccgtacggttttcacggtaaccacgcggttaccgcgataaccgccaaacggtgggggtgacgataaccccacgcaaaacggtttgctaaggcctacgaccgatattctgacatgctgctgcctaccgtgccgcccccggagggcgccggggccgcggtcccgcgctcgctcgcggacgctcgcacgcgggcaacgtgcggccatcccgcggatcggaactcggatgcgtgtggttgattggcggatgtgctgtgctgtgctgtgctgtgcggctgtgccacaccgctgcacgccacgagtgagctgcatgtatgataaaatataaacacactagtacggtacgtgtggatgagagagaaccaaaacgtgcgtggaaacggagctgctccctccgtttcaggatataagtcattttagtacttcccacgttcatagtaatgttaatgaatttaaataaatctagacatatatatctatttagattcattaacataactatgaatatgagaaatgctagaatgacttacattgtgaaacggaggaagaagctctgttgggtggccaccgctaacaccgacgaggcaccaatattggcatccatgatcattgttgaccaaaatccaactcggcgatttgttggttgcttgccgtactctgctcgccatctcaatctcctcttcataaactagtacagtacacaagaaattaaaggggcaccaaaccggccggccggagcttagctgttctcatgtacagggagaatctaagccgacggctcgcacttctattccccttcttctgaacgcggcgtcttcgggcagtagctgattcggttttgcaatattgcaaactatgcaagatcgccggcaaatgtgttaaaaatattaattaaaaacactataagcatggagtgttcattcatatctcgtagtagtattctctcgacgattgctttgattggttgcttcccgtactctgctcgccatctctctctctccctcaagtataaaagaaaaggggcaccaaaccggccggccggagccgttcgcttgtacagtgtcaacgcctcgaatttcacaaaaccagacttctaggcatagtgtgtataattctctatgtaaggaccaatcaaagtacacaaagaaaaagttgacaaataaatccatgtcctacatctctatctctatctctatctctatctctgtctctactacttaaaaaataagaggtgttttcatcgtccgtcaaaaaaaccgggcgaaaaaaatctgtccgatccaaaacaaaacggacgaaaaaaccggacaaaaaaccgggcgaaaaaaagaaaagagaaaccaaatcgcgaaaaaaaggaaaagaaaaatgaatccgattccgcggtaaaaaaaagggcgaaaagaaataaaaagggaatatgtctgattcctaaaaaacgggcgcaaaaaaaaccaggtgaaaaaaagaccggaaaaaagcgataaaaacaaaagatcagaaaaaaaaaagtccgactcctctagtggaaaaaagagagagaaaaaacaaaaaacgaagagaaaaaaaaacttccattgcaaaaataaaggctctaaaaaaatccgactcctcggtggagaaaaataaaggcgagaaaaaacaaaaaaagagaaaaaaaaacttctactataaaaaagaaaaaaaacgtccttcgctcgctccgtcgttccgctcgcttgtcgccggagagaaatgggatcaagagagagggatttgggagctagggttttgccctctccccggtcggcgcttcatccggcgcggggacgattggagccgtccattagatcggacgactcagattcgcccagcgtcaggccgttgccgccgttgattacgctgcgcccaatgggccgtggaagtgcatcggaccgtccccgcatatgtcggccgcgctcagctgctcagcttgcgggccatcgaattgactcaactcgccggagatgggccagcccaagtttaggccggcttgggaagacctaggccgaaagcaaatttgatcaaacaatgtggctcacatttttcaaattaaagtccgttggataaactcttaagtaggctcgaaaaataaatctaaaactaaatcctaaatcctatgttaattgatcaaattagactcggttctacctatttattaatatatcaaattagacttgatttttacagatttgaggttttcaaggtgtcacactatcaaacggtgtttttgccgttgcaacgcacaggcactattgctagtaactataaagaggtatgcagaggcataaaccacagtctaatagtgaaaaggtaaaggctaaaacaagataacgaggtggcttcaatttcacgggaatcatgacggtagcgaggaagcctatgccacctagatgtcctactctgagaaaaagaaaaatattgcaaggttgagtatcactcaccatgcttagcaaagtcataccaatgatgcatcgtgcaaagggaacaaatgaaggtttgtgttagacatttacatttcaaaacagtaaaatggctcattattattcaagccaagattaatcaatacttaacaatgttacaccatgttgctcaacccaaagcaccatctaaactattaccatttccaacaagtcaagttatttaatactgatatcaatcgtggtgaaattcgatcagccatccataaccgtagatatggttgtttgaatatatttactttgatcaaaggggtaacaccgcggcaacatgataagagagattgtgacataatccttcgcataacccaccctaaaccattcacgtcatgctgtgatgcatccggcctaggtggcccaggtggccaaggcccaacaaattaaggttgcctggaccccaacatttagcacacccactcggggaaagaccgacctcaacagttcttagacatacccactcagggaaagacccaatccccctaaaagatccaataggggaagggtggcttcctcctcccaagctaacaagggcccagctctgatcccaattaatccatccggcctaggtggggttgcctagatcccaacagttcttaggcacacccactcggggaaaggcccaatctccctaaaagactagttcaataggggaagggtggctctctcttttaaggtggtttctacctcccaagctaagcaaggtgggattattcagaggctcacacggtcaccgcctgactacaactgcaccacttggccacttattgtgtctttgccagcgggtaatagtggaggatgtcctcatcatgctgagattgcacctcccgcacatgtcgcacccaacctaccaggaaggctatacccccttgcgacacggtagatctgacatctgctcagctagataccaagctgacatgacttcataacacctacccttgttaattgttcctaggagagagacaagctacactacaagcctagtcgttgcgtatgctagcttgtggtaagtacagaatgtctcacaatatgttccagtagcactcattgaggaaaaagtagtgactgagcatctctgggacctaggaaaggtagaggagtgttagggaggagtagcgcaatctggaacgatagcaaaatacgacatgaggaaggttgcccaacggccttacctcgcacggggtggtgatgctctagggtgaacgggcttcgagaagactccgatcgcactcctcgttgtcacaaagctagtggtggcgagggcacagctcgatagcagctagagcagcgtcgagcaacgggtggaggtggctaacaacagaagtgctatgatggtcgttgtggggaggcgatggagtgcacggagggctcaggcgaatgcggaaaaaggagaagatgagcatgggaaggggtcatataggctaggaagggaagaatgtggctaacaaggcaacattgtcaatgagagagggatcacgatgatgagaccgaagtgcatgtatccatgttagttctgcacatgagttggggagggtaagaggaggagtgggtaacaactgatccgacattttgaatgaagggagaaggtgcaaaattggacagaaggggtggtttcgaccggtggtggtttcctaggttggggtttatagttattattcaaggcttttagggtttttaagcaatttcttgaaattaaccaggaaagtagcacgcgcagatacatgggcacctaaaatatcataaattctattaccactaaaatttttataattaagtttcattaacttttacttggaatattatttgataattttattatatcaaactatgaactataatgggtgtgaaatctataagggttgagcatgtagtttatataatttatagtgtagatttcaatattagctttgagtgattaggagattataggagaggaagtgactcgagcaatgtccgcccgaaaaaagccatgacaaatggaagcggcggcttcttcggaggtaaggtgtccttgtgttcacaattgcacagatggcgtgaaattgtaaggtgggcggccatacggaacccatgtggtatatatgtgatctctgagttaggtttttttttcttttcttttttagggggggtggggggggataggataaggattgaagctgtcgtctatttggtaagaaatgaggagcatatttttgaaatcttcataaatcttatttaaatttcacaatttttttaccgtgaaaatttaaaatagactaaggaatattatattttatatatccaactgtgtactataatggctatgaaattgaagggttaaagtctagctataaactatgattatatatggtagaggtcccatatgttatagaacttttttatactgaaataggagaacaccgatgtgatcgctcatatatattgttgatgcaatacttgattctttgttttttatgcatctgtacggtcagatataatcctttgtaagttcagcgaaatctatgtttctcctaattatttgttcggcaccgcttatttagttttgatgcacatgttagttacacatccttagtggctacacgtccatcaacaaattatttgcattaattacattcacagcaatagtatttttagagctgatcaatttagcaaagtaaacattcacagatacccctccctccgtaaaaaaaaaaaaaaaaaaccaatcctaactacgaacctgacacgtagctaagattgatctttttttttttttacggagtagtaacatggatagcccttcctagcagtgaacctctacttcgcaaattgcaacgctatctccctctaacaggcgtgcaacatctatctcaatattcaagatttcaccgtgcaacatctatctcaatattcaagatttcaccgagtgcggtggggttaattgtccggtttattttaatcaatataatctaatccaacagtttacaatgttggacccatagatttaaataaaaatcaaggatagaatttttttttcttttttcctcggaattttttggattttctctaactagaaaaatacccgtgcgttgtaatgcgagaaggttattttaatattattattattatacggtttagttaagatgaaattcactgtgggaattcgcttggagatatatttttctagaaaatcatgagctgcaattaggagtctgaccttcttaagttagtatgcgagtttttttaagagatatcttatacgactccttctgtattttcaaaaatgaacgaacttaaaacccgactcaaatacggatatgtattttcaaaataatatgaacttaaagaaaacaactcatacacaaatagcgtaccaaagtaccggcaaaaacatcttcaatttttataatagtagagatttattagagtgtcacgtgatggcttagaaacgtttgtaggaatctgacggagctggtggctcctcaccgggggaccgcgcaggcccccctttgccagttcggccgggggcttagggtgaaatctcaagctctcgctctctctctgtatgtggaaatatcgtccgccagccagaaacacgagacaccggcgatctatacaggttcgggccgctgagaagcgtaataccctactcctgtgttttggtggatctgtgtatgaatgggctacaagtgtgagctgacttctcccccgttctaagctcataatctgggaaagaatcaacaaaccccccactctatgggcaaggtcctccttttatacttcaaggggataccacacgcacccttctctttccaaactggactgttctttttctcttgaatgggcggagatcagcacggttgctgtccgaatgacgctccgatgggacagcccacacctacctccacttccgccgggagtgagcgcgtcgtgggaacatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcttaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatacgtggcgcagacttcctaaagggggcgggggtgcccccggccctccgggccagggcaagcgcaacccgacccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgataggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgccatggcatggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcatcagactacccggggcggtccatcttcttcctccccttcgcaatggctgggctggtcccgccattttctcatttcttcatggatgtcctggagttctacgatctccagatggcgcacctcacccctaatgcggcgatgacattggccatcttcgcacacctgtgcgagatgttcattggggtgcgcccctctcttcagctgttccggtggttcttcaccgtgcagtcggtgtcaccgccatcggtggttggcggctgctacttccagccacgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacaccgtcctcgaccgcctggcgggcctgcgatcccaggggctcaccggggccatggtgtacggcgattacctccgtcgccggattgcgccgctccaacggcgcgcccggagcgcttgggagtacactgggcctgaagattacatgcggacccatcagggaaccagatgggattgggctcctgaggacttcaagatcgtagtccaaagggtgcttaatcttagctccgcggaggcgtctcgccttcctcaggagatcctccccctctgcatcgatcccgaccgcgtctccattctatccattatgctgggggttggggcctcagaggagagagcccctaagagccacgatggcgcgggcgagagccgccgggggaaacgatctgccccaggagggggtcgtgcttctgggccccgcgtcgggggctcggggaccagccgtcctgccgacgccccggggaagaggaagctgggaggaacacctcccccatctcctccccgagggggcggggcggtgcgtaccagcggtcggcgcccggagggggccgcgccgacgtcacagcccgagggggagcgcaagaagaagcgcctccgcaagatgggggagacggaaccagcccggggaaacttaatttcccctccaaggtggtcattcaaccgaccccctcgcaggttcgtctcactcttattgcaaccatctttctccaaaaagaagttttttcttgctcattttgttcgccttctggttttttcttctgcttcagcgatgtcccgtcgcattcctcccgccaccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaagctgctcgggaggaggccgcccgggcccgccaagccgcagaagctgcccgggaggaggccgcccgggctcgccaggctgaggcgacagcgtcacttgggcccactccctcgggcggccctcgggcgacatcctccgaggcggctcgcgacgaggccgcgggcgcatcgcctgggcctacctcaccgggcgacgcccaggaccgaacgggcccgggggacatccccgagctcagcgtatcctccggggggccaaaccgcgtcgccttttctccaaggcggcttttttcctcatcttccgtcgccccggtgagcgccgagcccattatgcaggccttggccgccgcaaacaccgcggtgctggatgggttcaacacccaggtggaggccctgcgtgcagaacgagcggagctcgaggccgcatgggcgcgcgtcgaggaggggcggcgctcggtggacgccatggtgaaggtgggccgtaaggcccatcgccgccacatctcggagctcgaagcccgcaaggcggcgctggcggagatcgcccgagaggtgaaggaggagcgagaggccgccctcgtcgccaccaccgcgatggtcgaggcgcaagacgccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggcccttgaggcccgtgccatggcgctggaagaacatgccggcgccgtggagaggggcttgatggaccgcgaggccaccactgctctccgggaggcgacgctggcggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgcgccgagagagccgcgctggagcagcgggctgctaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccaccggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgcaccgcacctcaacaggatggcttgggttctcgagcgactccccgaggagctcgagaagaccattaaggcatcctcgagggacctcgcccggggggcggtcgaactcgtgctggcgagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggctcgcgttcgcccccagctccgacgaggaaggcgacaccagcagcgaggacggcggtggcgacgaggccggcgacccgggcgcatatgaatgagcccccaggcccccgccactataatcttttttcttgttctttcttctaaggccttcatgcctcttttttgtacaattttaacttaatctgcaatgagaaatgatgaaaaatttttgtgttagttttattttgctatatatatgagctgaggatgatctgtgccatggtccttttgcgacttagcttggaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagtacgagtgacattatttcaagtcaagattcttcaaaaggaaaaaaacggcacagacacaacctttaggaaattgaaactgcttttattgaaatgctgaaaggaatatatgtgcatgtgtggtagcccccggctaaccctgcacacccgagggggggtgcggggttagcccgagccgaaacctgacacccgaccccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagtttgctcaatccgggtgcgagactcgaatgtcattcatnggggcgcag

SEQ ID NO: 10364 - DNA, 726 bp, Oryza sativa
  unsure (1)..(726): unsure at all n locations
gggggtnnnnttttgatttgcatatcnnnnnnnnnnnnnnnnnnnnnnnnnnnnnnnnnnnnnnnnntccgaccggccgccgccgctcgtcgtcagctcccgccgcctcccgctcagctccgccgcggcgccgccacggccgcccgtccctcctccgcctgctccctctcccggcgccgctccgtcctcctccgcctgttctctccgccgcgtccgccgcctcatccgcgaccagcccccgccgctcgaccgctcctcgcctcgtctccgcgcccacctccacctcgtccgcgaccggccgccgccgctcgtcgttagctcccgccgcctcccactcggctccgccacggccactcatccctcccccgcctgctctctccgccacgtccgccgcctcatccgcgaccggccgccgccgctcgaccggntcctggcctatntnccggccccggctcggcttgtncgcgaccggcttcgggaccggccgcggcggtcgtggtaagttccggcggcttccggtcgggttcggtggggggtggcctttctttcgttggggcgacctggttcttcggccccaattttaccggccgtgaaacaatggccattccatnccaacctcatccctttttcccaaccaaaaactataaccattctttaccacaaaccaaaccccacaactgggaccattccattcaaaaaaaggggaataggcctaccccatcccac

SEQ ID NO: 10365 - DNA, 2617 bp, Oryza sativa
  unsure (1)..(2617): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttcaagtcaagattcttcaaaaggaaaaaaacggcacagacacaacctttaggaaattgaaactgcttttattgaaatgctgaaaggaatatatgtgcatgtgtggtagcccccggctaaccctgcacacccgagggggggtgcggggttagcccgagccgaaacctgacacccgaccccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggtactccaaaacgggccgtgatacccttaatgaatttaagagcagagtgcttatcgatcttgacaaccggataagcctcgggccacttagtgaacttgtcgatcgcaacatacagatactcaaacccgcctggggcccgtttgaacggtcccaggatatcaagcccccagacagcaaatggccacgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcggagatccaagcaatcaatctaagggagcttggagcgctcccttcgggtcccgaggcctggactccgacgggcctcgggtgccggtcaggcgcatccgtctcccctaaggggtcgggtcgcgccgacggctgggtaagcctttcttcaaaggcgcctggtggggtctgggctcgcgaggacgcgagccttgagagttcatcggcaatcatattatcccgtctgggcacatgccgaagctctatcccgtcaaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcggaagtcgagacggaccaaatatctgaggacgtctccgttcggagaggtcaacgtgacccctgcaccggcgccctgaagagacagagaaccgtcaaactgcatcacccagtgggcggtttgaggcagctgtgaggggttcgtgctggcctcgggtattgagacggtctctggagccggggtccactctgccacaaaatcggcgagggcctggctcttgatagcgtggcgtggttcaaagtgcagatcgaactcggaaagctcgattgctgtcgcgaccgggaaaattgcctttttccgaacgcttgtgtattaatccccgtcccaggaaaagccggggtacaccatacaaacatgatataaaagacacatctttattatatcgataatatttacattattacaaaggcacttaaggcctgacaaacaaagataaacagcagcggactagcgggcctacggctccatcttcacaggcgctcaactggagtataagccaggannnnnnnnnnnnnnnnnnnnnnnnnnnnnnnnnnnnnnnnnngtatcatgtcacaatngggcgct

SEQ ID NO: 10366 - DNA, 18380 bp, Oryza sativa
  unsure (1)..(18380): unsure at all n locations
ngagggagctgggccgagaggggaggaggcccaagagtaggagggagagaaggagagaaagagagggaggagagggagactttgaactgggcttggcccaaaggaggaagaggagggatttttagcttttctttttaataaactttgatcaaggttgttgttgcttaataattatttccggtgctctgaaaattcaagtaaaatttgagggctctttttagaccaaggagaatttaacaaaaattctccgggccacattggaatttttcttgtacgtattttagtgtttgccaatttcttttcgcattttaattaattctattatgccttttagcgaatgatttttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatagggcttcagttccagaactttgcatagttcatatctttggagtcaacctcatacaagttacccacttcatgtcatgcgtcgagatcagctcgtcattactaagataccatgcttgtcatcatttagcattcaaagtattcccttacacattcagccctgacgtattctttttagatttctcttatcaatcacctttcgacctacttctttgcccgataataaacacctttgctggtatcttctatcaataaccttttgaactttgtcaaccaagtactcttcactccaagagttgtggatgcttttggtgacgatgcggtcctttggtctgctgcctttcagtgaaaccttcaagtgttttgccaaaagctgtactgactgtctttgtctttgatccgaaaaagacacatctgaaattcttaatcccaacaaatgtctctttggttaatcgcttgattttcttttccatcctcaggttggttattagttcgaggttagaatatagttcctctggcacgagaccctaggtctcctttgtcagtaaacaattatacacatgatcacatatccgcatcttccaaaagaatcctcttagaacttgtttttattaccaatttctcccatattacatgaatacaaggcactgtcttaaacaaaaagggaaggtgcttaacatcggtacattgtttcctctatgggttagaattaacatgaggcctcacaggtacggcgtttgctccagtgaccacaaggcgagtgacctgtcttcttcttgcataatggccggagtgatggcgcaggttacgcttcggctgtggacaatctctggagaaatgacctggttctttgcagttgtaacaaatcaacgtcttctttgctgagctgtccatctggggatgatcattgtgacttggagttggaattggtggttggaaacccttgctaacattggcatcagcggtaccatcgttgctatcaccattggagtctttctcagtgtcaaaattgctaaggttgtcattctgggttccaacattgatactatcgttgacatcttggcgaatgctaccgacattgcacgctttattcgagtggtcactaatggggcaagaaccatggttgttggtggtatcatcattattagtattgctagtgttgttgtctgcattgcattcatcttcttggggcaggaactcttgatgcacaacaggagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgttggttgcccctgctgggttgttccgattctgtaagagttgaaaggctgttgccaacatgttggtttggttaaccacaacttggattagctctggtgaggtttcgttgatgcttttctcattcccattggcttgggttcttgagtcatcggatccatcattcccatagcctttgttaccagtgttatccatctgtcacaaggtaggggttgagagaggaagcatacaaggaaagaatagaccagagctagggacaggaccttaaaggaactaactctttttgttgatgtgttgtgtgttttgcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggagaaggagaaaaagaggaactttcgcaaataattttatttataaaatatgtccttaggttttatccatttggcttatcctacagtcgagatggctctgataccagcttgtcgcgaccgggaaaattgcctttttccgaacgcttgtgtattaatccccgtcccaggaaaagccggggtacaccatacaaacatgatataaaagacacatctttattatatcgataatatttacattattacaaaggcacttaaggcctgacaaacaaagataaacagcagcggactagcgggcctacggctccatcttcacaggcgctcaactggagtataagccaggactccacctaagacatctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccaactcgtcccaagccaacccaggccaaccattccatattttagttgttgagcaaattttaagaattataacactgacctgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgagccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccaccacaaaccaataattccatagtgtccaaatgatatgagaattcccaaagtctaaagttataaaaccacctaatgttgcctaattattcagcgaagcatctacctaaatttatactagtggaaccatgaacagagtacccactagttggggttttatttattctagggtgaacaaggtaataataataacaataacaataataaggtcataacaaaggtaattgggcatggctagataaaacagtgataacgcgggaatttaaataaagcggtaatgcaataatttaaatcaacataattttacaaactgggattcaatatgttcaaggatgatgtgacttgccttgctcagagagaacggacttccgatccttcggcgacgaccacgaaccacgcttcgggaacctccggaacgacgaaagctacgcgaagcacacaagcaaagctacaagcctataaagaagcaataacaatacataaaaacaaagcacagggttctttaggttatagcaaacattaggagacttgaacgggtcgattcagagttcgtatgaccaagatatgatcatccgaagtttaatgctgttatatggagatttgcggattattgtaattaggttttgcaactataaaacatgtgtaagcgctagcctggaaaagacaggaaggctgcgccgttgacatgcggaccccacatgtcaacctaaaggaccgcggtagaccgagtgcacagagacggtccacgggtcgacggaagcggatcccgtgtgtcaaccgaggcgagtggccgacaaacggactccactggacaccacacggactgcacacgtggaaaccacgcggctaccaagcgggcacacaaacacggacactacacggtcaccacccgcacacgtgaacgactaccgacaccggtacacgggtaccggggtcgacgaccgcacaacgggtacggggcgacgccgaaaggacgagggcggggaagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacggggcttgacgacgcggagccgagggcggagacgaggacggggctgcagcggctcgcttgacgaacgcggacgacggacgagaacggctcgacggagggacgaacgccacgacgaccgggaacgacgagaggacgacgacgacggcgacgaccgggaccggcgaggaggcgacgaggacagccggcagcggctgcacggagacgaggacgacgtgggacacgccgctgcgatgacgatgacggaggcggcgccgcgagacgacgagccgggcgaccgacgggacgtcgatgacgagaacgatcggagacgacgatgatggcaggcagcagcggctgagaggaggaggggacagcgtggaacacgccgctacgacgttggtgatggtggtggtgcagcggggcgacgagccgacgaggaggaaggagaggccggcgcggagacgacggcgttccggcgaagttcgggcgaggaggaggtggtgccggggatgagagcggcgtcgtggagccgaggaaggtggtggcgacgtcggccggcgctccggggacgtggcagaggcggccggaggcggagaagtggtggcgacgccactggacgccggcgaggacgcgtctccggtgctttccccgcgaaacggagggctgaccgagggagagggagcagctgcgaggccgaggacgacgtcgcggctgcgatgccgaagatggtggtggaggtggccgaccggtacacggcgaggagggacgggcggccgaacaactccggcgaggcggatgtagaggttcgcggcgacgttccggcgaaaccgagggcaggccggggtggagggcgatgcggcgtcgccgagggaggagacggcgacgtcggccgacgctctggcgcggcgaccgggcagccggaggagatgtcgacgaggaggaaggtgaggccggcgcgggcgacggtgttccggcgatgttcgggcgaggaggaggtgataccggggatgagggcggcgtcgcggagccgagggaggtggtggcgacgtcgaccggcgctcaggcagggagatagaggcggctggaggcggccggcgcgaaggaaagaggaggacgacggcgggaacgcgcctccggcggtcaccgcgcgaaacggagggtaggccgagggagagggggcagctgcgatgctggaggaggcgacggcgcggccggacgatgctccggtgaggagggagaggcggctggaggccggccggcaacgtgggagagagagggcgacggtggggaggtggctagagaccacgggagagcttgggaggagaccaaaacggtagaacgcaaagagggggttctattttataggagaggagagggaaccggccacgggggaggtcggaacggcggcgagaaccacggccggcggcaatggttggtggccggagaaaacgcgagcgttcccggcgattgggggcggcattcaagggggaaaacgggggaaatcgaagaggaatcaatggggattaattgcccctaatcaatttggtaagagccggcttgaatagagcggatttagaggaggaatggcgctagggctcgctcgggagagggagagaggacggccgggcgggaggaaggggacgacgcccgcctgacgcgcgggccccacgcggtcgggcggcggcgtcagcgcgcgcacgcgcgcggcacgtgcgggaggggagcggctcgggggctggggcggcttgggccggcggccggcccaggaagagaggagggagaggcggcttgggccgggcaggccgggaggggagggggggggaagaggcagcccgggagagagagggaggagggagctgggccgagaggggaggaggcccaagaggaggagggagagaaggagagaaagagagggaggagagggagactttgaactgggcttggcccaaaggaggaagaggagggatttttagcttttctttttaataaactttgatcaaggttgttgttgcttaataattatttccggtgctctgaaaattcaagtaaaatttgagggctctttttagaccaaggagaatttaacaaaaattctccgggccacattggaatttttcttgtacgtattttagtgtttgccaatttcttttcgcattttaattaattctattatgccttttagcgaatgatttttatttcgggatgaatttatcaggacgtgacaattgcccattttaccactcgtcctgtaccctctcgattatgcaagatttgaccgagggggtaagacgtaaccacagcgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccgtcttctgtgccgatgacctcggggtcggaagacgacaggagcggccttcccacagtggcctcgggaccgtcctgggggttgggggctcctggtgtcatcggacaagcgggcaaagggccaactccggtcgtcaggggccttaggccaccgttcggctcgggggcctcttctccctgctctctcccgggtcgaatcggtacagggttagcctcggggtcagagagtgataggtgcggcctccccgcagtggcctcggggccttcctgagggtcgggggcacccgacaccgtctgacaagcgggcggagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcagggactcatttggctccggggcgactagaaccggaggagagctaagatacgccttcaactgggcgagggcattttcagcttcctccgtccaagtgaacggccccgagcgcttgaggagcttaaacaggggtagcgccttctctcccagccttgatatgaaacgacttagggcggccatgcaaccggtgacgcattgcacgtccctaagtttgctgggggggcgcatccgctcgatagctcgaatcttctcgggattggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaagcttgacgttccggggcttgccgccgcactttctgccggaccggccttgcgcccggccgcacagcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaagggccaagcctctcgtcaccaccctcgggcttggacgcagcagcgaggcggtccgcgcgctgctcaatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagctcacccgctccgtgcggaagttggcgggtccaccgaaggtgaccggtaggtcaatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcagtctggtcgaaagtgagagcgacctccgaccaccgcgcccgacgcatcgcctcatgggtaggggccatggccagaagctctcgcttcatggccttgaagctccggcgagagacgtgagcacacgcccctccatcgacggtggcaatggtggccccaggttcttggaaacctaggtcatcatcaccatcatcaatgtcaacagcgggggccttctgcttggcctcacttcgccgtttgccggatgggaccgccggggacttgccctcgcggcgttcctgcctcctgtcctcctcccacttcctcgttcgctcagccaaatttttgactgcgcgacagtccgcgagatggtggagggaggtgttgtggacggagcaccacctgccggcggggcgctccctgctgggtgtaccagccccgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcagattcattagccaaccccgcgcctgtccttttagggccatgggaaagaagttcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccaacaccaccggccgggggcacggagggctgatcttcacgtccatgtcggagtgacactctggacgaggaggctccctccgttgcacggggagtacgccggctattacaccgacgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggttgaacaagaaaaacttggggcacacggaagagtctgagagctctgaaagcacacgctgagccccctacctggcgcgccagatgacggagctggtggctcctcaccgggggaccgcgcaggcccccctttgccagttcggccgggggcttagggtgaaatctcaagctctcgctctctctctgtatgtggaaaaatcgtatgccagccagaaaacacgagacaccgacgatctatacaggttcgggccgctgagaagcgtaataccctactcctgtgttttggtggatctgtgtatgaatgggctacaagtgtgagctgacttctcccccgttctaagctcataatctgggaaagaatcaacaaaccccccactctatgggcaaggtcctccttttatacttcaaggggataccacacgcacccttctctttccaaactggactgttctttttctcttgaatgggcggagatcagcacggttgctgtccgaatgacgctccgatgggacagcccacacctacctccacttccgccgggagtgagcgcgtcgtgggaacatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcttaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagaatcccacgtgacggcttgagaatatttatatgaagtttaatgtaattttagtacattaagaatttaagataggtcaggggaaaactcaggacgttacacaggacgaatccaagctgatggcccaccttctattcccttcttctcaacacgacatacggcgtcttcgagcagcaggtgattctgatcgacttgcaatgcaagagcgccggcaaaagttgaaaaacaataagcatgtgtgttcatatctcgttttctgtcgtgtaactagatgtatcgtcaagaagaatctatatatataagcattctttaaattgcaacatatagattagtattattgtcaacagcttcagatcagttttaaaattgtacgtgtgattgccctacttgccgatggtacatgtgcatttatgggccggctaatcatgtggattattctggtttgtttactagtgtagtatattactattattctctgacaatagtagttctataaggttgatataatatattccaccaactcagtaatcatatgaaactacagtgattgatattgatgtttcatatgattacaatatcaaactatagcggttccctaatcttaattgtagtaaacttagccgctaaatccaacggcgtaagcatgtatatgataaatgtatactaaacataattaatatagaagtgcagttgtatcatactgtattatttaacaaaagtaatattttagtttcacctcgcgaagtgaaaacaaaaataatttttatctatgaaaaaaaattattttatataaagcaaaaaaataatatttttaccattaaaaactgtatatatcgcatattttgttatagtagtacgaaattttttataagataaatcttgttatgcaagataaaaattatttttgttaaataatatctcataaaataaactcataaatataatagtcgcatataataaatttatacactccataaatatagttcataaatttatattttcttgatagcaaagggtaaaatgaactttatgatacgaatttaacggtcaactaacggttaactgacggaaggggtatagaagggatccaagctgaaatttaggggtatggaaggaaatgagcaaatctcagaggtatagaaaggattaggcgaactttcaggggtacacggggaattttctcaatataaatacaatacccttgggaatactcatgagtaaagtgctacatcggtttgcgaatttatccgtgatcataagaaataccaacaagcgacgagcgacgaaggtggctctcctcggtctctgccggcatgtgccccctcctcggcctccgccggtgcatgcatgactgcccttgccgaacttgctaccgagccagtcgaggtgaagcatgcggcgggtgaaggtgaagcccgcaatgagatgtgaaaggcggaagggcggcgacagatggtggtgatgagatcacaacgattggatctagcccccagagcgagctcgacagtggtgaagccaccgggggtgccggggtgggcatgtcacccccatcctcatgcgctgcaaaccccccacccccgggtgataagccatctaatccatacaattaactcattaattagctgcaagttgagcctatacataactgtccaatagattttagctttacgtgattatctgagttaattaatgtaactaagcaatgtagttgcaagtctccaaaactaaaaaggatgaatagaaatgatgtcttgtcattaatgtattcagtaaagttggtgctatttagttccctaattttaaaaaaatgattcttttatgatatattaatgtacattcggacatacaccctccatcctaaaatgagttcaattttttacatgaatctagaagaatgtgttgaaatatatccaaagtcatatcaacaatcattttatttatatattagtgcaaaataaccacaaaattcaatacaattatacgaggggcgactccgcatattagagcgaagaggtgaggccaatctgcccctctataggaactaagccaccaagatccacaccattgtctaccgaggcacttgtgagttcttacatctcatggccagcacccctatcactaaatcctggcttcgccactggagctcgacctctgccccgctaagatctgcctccattttgcacctcggatctgtgcctcgttggatccgcgttgcctccttttggccggcttggagcttcggaggaagtggtgcggggatgtcgtttgtggtgggggcaacaagccaaggacgtggaccgtgccacctccgattcgttgctccttcagtcggtcatcggcggtttggttgaggggatttgtcgctactcggttgcaacctttgctgagagagagagagagagtaggggaggggatggcttgagggagagagataacaagtggtcccatggattttttattctattttctttgctgattggattgccacattgacgtctcgtgtgcaatctcaatcaaaaccacccaaaacaatgcttagggggttatttgtctggtattaatagttaagggcaaaagatatatattttttaaacgagggataattcatactcattgaatagttcaggggtaatttggattttttttctttaaaaatatttggtctaataatatattatagaaacaattcataaaatcattgaactctagtagattctctctcgttaccacttactagctttgtcctttgtttagccccatcgttctctccctttcgttgcaaagggtgtatttagtgttgattcgtaggtaagttgttgattttatcagctgatgccggttagttagggaagggataaaatcccaccggttttcttttcctaacaagagacaactaagtgataaaatatgttttgtttgatcggtacaaatggattcgaatttaattagagataaagcccctgagccccaccagtgtcggtttataaggaaaaggagagaggcatattgttggcaactttttgtgacaagtcaacaagcacgattgcagcacctaaacaccttgcggtgatactagagtcgccaaccaccctaacccagtaagcgctaagtcaagatgggttttgatagattaaactggctagcggagccgatttagatgaaactatggataactacccatcttgtgagcaaacagaaggttttaaggacaaacctacaaagaggtgtcgcactctcgcagcagcggcggacgatttacggcgcaaatcgaaaggtggacaaactaaactagaactagaaagcaatattgaaaaaagcgattcgattgattgattgtaggataccttacaattgaacaggccttgtcccttatataggggttggtcttgccctctataggccctcctccacgtccaactcggggtagaaaccaaaggaaacctgaaacataccttcccgagcaaggaaaactcgagacccaacaaaacagactcagactcggactctgttggtcagaccggccacatgccggcggtctaatcggagttctggccgcagcagtctgaccggcctatacacgacggtcaggctggccttctagaggaaaacaccggtagattccaaactttggcaatttttcctatttcaatcctaggtgtcaattttaggtgtaaacacatatgtcacggccgaactatctctaaccctaaaaccctatttcaatcatccaatctattcagcactggaaggggttcataaggtatctcgcaagaagaagaaacagagaagaaaaagaaaaaaagaagaagaaaatcgaaggattagatcattggattaaatggcttcacatcaaggtcagtgaatcgatttattctccacataagaaaggtgattatgcctaggctaagaactcaaattaattaagtggattaaactccacaaggtattccttgatccagcatactccaacaaggtaaataaataaggagctaaaagtaaaacctcgatttatatagttgaatattgacggattaattaagaaatgctcatgggtatgtcgatccacacagtaatcttatcggcagataacaactcaggagctttcggccttatcttttcgcttatgctttacttatcagccaaaatttgaattttcaatcttaaatctgaagttgattttgatttttttttatcgaagtttatttttcagcatttgcttttagaatgctaaaaacacgtatataaaagttttattcataaatcatttttcgtttgcaaatatgccgttacgcttatgcttaaaatcagccaagtgatggcttcctttgtttctactagttaagatttacaaatgtcggtccaaagaaattgcgctcgcaattcgcgtgtctctccatttgtaaaatcaacaacagagagatcgagcagcagatcgatatatatattcaggtaacatgcatacggcaagctaggtcaacttgcagctgcaggacgtcattccttaaagctggcgagttctgttcatgtgattgcatcaaagattgttggggaacatatataatgttgtttaattatgcaaatcgcctcgcaacaaaaactgtttgtttatgcaaagcatactaaagggatgctcactagattaataactggccagggcggcacatagctagttatattatcatcctaatccgatgattcgatctgcgtttatttggttctttaaggtagtgtttggtttggggaccaagtgggatgggttagacctatcccctttttttggatgggatggttccagttgtgtgtttggtttgtggtataggatggttatagttttttgtttggtagaagggattgaggtgggatgggatggacagtgtttcacggaccgttagaatgggggacggatgagcaggtcggcgcgagcgaagcataggcagcgccgcatcggagccgaacgggaggcggcgggagctgacgacgatcggcggaggccggtaatggaggcggtcgcgcacgaggtggaggcgggtgcggagatcacntgagtatcggtcntggggtaggtgtnagtgnaangctatcaaatnntnnntnnnnncgcctctggtgggggaggcgtgagcgtgagcagtgcatagccctatcgctcgcgcatagcggttacagtacngttagtttgagttggaaagcataccgcttcagatacacatagcatatgcgtacggctga

SEQ ID NO: 10367 - DNA, 16929 bp, Oryza sativa
  unsure (1)..(16929): unsure at all n locations
nacgagctgttggtccccttcatcgcatttcaaaaacagacagctgtatctgacgacgatcgccggcgaccggtcaagaagacagttgaggataaggcggcggccggtcgcggacgcagaggaggacggagcggcgccggggaagggagcaggcggaggaggacggagcggtgccgggggagggagcaggaggaggagggacgggcggccgtggcggcgccgcggcggagccgagcgggagcagacgccgttttctccgtcgaagtgggatggattggtccggccgattttggcggaccgtttcgtcccggatctgggaggaatattcctctccagggaccatcccatcccactcacctctcaaccaaacacccctaaaagtgggttcatcccatcccatcccatcccatcctctcaaccaaacactacctaagatcttgttatctactggctcagatatcctcacatgcatcggctgtaccaaaagctaagcctctgctgcatgcatggtgtgatcttgatttttaattagttcttcctccatttcatattatttcatattataagtcgttttacttttcctagttatgactaactttcttgaaaatatgttagtatttccaacacaaaacaaacatattatgaaaatatattcaatgttagatttaatagtactaattttatattttagatgttgaacttttctataaacttgatcaaacaagtttgattagaaaaaaaagataaacatcttattatatgaaacagagggaggagtaattagatctatcttaatttccttctttcacaacccatcggagctttggaaggcaagcgaaagctttagctggctctattgttggcgattgaaatggcaggttaattatgctccatctgccatatcatgtggtgctggctagtgccctttcattttgctacagtgacacagtacgaattcagtagcttttccatggttcatcatcggaaaacgacgagggaacagctatgtttatagcatcatatttaataatatcattttgtaatataaattacctacatttttacatacttactgtactgcaaattatacatgagagagatcaatcaaatagggaaaaaaatttagcaatcccgaaacaacaattacggctatgagtttgtagtatctttttggatgtgtatatgagagtagttgatgtggttgacgatgtaccaccagttgaagagctaattgctactagtatccttttcgcacactactctatggctgtgtttagattggtccaaagttcggaatttggttgaaattggagacgatatgactgaaaagttgtgtatgtattaaagatttgatgtgatggaaagttggaaatttggaaaaaaaaaactttggaaataaacacaccctataacttgaacacgaatttaaattattattttctcacgccatacttggcggacagttcgatcttctgtgattggccagaagtattacttttatttttttataacaaaacgatttaaagattaaaaagttcccctcgtgcaccatgacccggcatctcgactgttggccggcacatgaaatatgaatgcatcatgtgcgactgtgcagtgcagctgccttttgccttgtggcgtccccattgcgtgggtcacctaatcagaatgaacacgtctttttgactctcttttttaccttctagaaaaaaaaaggccagaaaattcgttgatcttttcctcatcaaaatgccaccagccgatttaatactcataactatatactaatgaaataatgagtatttggcgtaaacatagggtttcttgaaacattttaccccaaaacctgagattctctaagataaatcataaaacctgggattttagtttacatgtttctcaaaacttggtttcgtaaaatttactaaaatatatgacgaagttgatttatttaccatgatgtttgaacaacgttactaatagtaaatatgttctacgtttactgaggcagtagtagtttccaaaatatgccgtaagaactagtgaatcggataaaccagtactcctcgggtagccccatttgactgtgattgttatcttacgtgaggtccgtgtagattattgtttgaagcacccgtaagaaggttccaaaaactgctgcaggtggcgcctcatgtgattaggacgttcgacaacgctatggtccatgatgtagctgagcgttgcacaaatgtgtagagtcactgtggttttttctctcatgttcgtgttatatattttgtctgttctaaaatctaaaatatatctattaatttataatccaattagatatatcctatattatgaatctagacaagggcattaaaaatttagacaacctcctgtttagattcgtactaccaagaatcctctatgggtccttgtgtacgtagattcatagtgttatgatatatccaattcggttctatgttgctatattttggaatggagtgagtatttatgtatattgtatcagttcaaaataactttattttttaccatcttatttgctccaaaacaacgactttatacatgaagcaatcattgcattagagtttatgaaaatgtgagggacaaatgaattgagactagataaaataagacacaattgcaatgagatttaataaaatggagtgtattctagttttttttttttttgcttttgtattagtatgtgtgagatgagtaaaaaataaagttagttttggatggaggtagtaattgcttctagccaaggttaacatggtatgtataagttcagcacaatcatccagaaagaatctatgggtctgtttggggagcttaagattgtagttcattttcaggattccacaactatagttttttttagaacttgaacgaaaagctacattgtttctaggaatttctgattgtgaaaaatgctctcctaaatagaccctatataccacaactagttaggaatatttgacgtctacactgctataaatagagacatcgatataaaatattctttgattggatgaaacaacttatataaaaaagtttgccaataacatatcccttccaaaaaaaatcaacttctaataataaacctatattagcatttgtttaaattcatcatcagaagttggtttttgagtatgcacttaacccaactctatttagggtgtgtttagttcacgccaaaattagaagtttggttgaaattggaacgatgtgacggaaaagttggaagtttgtgtgtgtaggaaagttttgatgtgatggaaaagttgaaagtttgaagaaaaagtttggaactaagtaagggcttaaggcttttcttgaaacatactctaatagcgattttataatatttcatacaactatttccaaactacaaaaaaccatcaaaaatgtctccaatcatagaagaggccagtaaagaatcacatagtaaacctcaaccagatttttcacctaaggggaattacacacgcacgtgcagccacttcgctcctactccctctgtcccacaatataagagattttgaatttttgtttgtaacgtttgatcactcgtcttattcaatttttttttacaaatataaaaaacgaaaagttgtgcttaaagtactgtagataataaagtaagtcacaaataaaataaataataatttcaaaatgtgtttgaataagacgagtggttaaacgttgcttgcaataactcaaaatcccttatattatgggacggagggagtatatacttatggatgacctatgggtttttttttcacaatcttacctatccctccaaaataaatagaaattcagtccacctcattttaaaccctgctttcaaattttgtaggctaaaacattgatccttttccccgtaaaaaaaatatattgaccccttaaccataaggctatactacgggccaatttgatagagttccaactcctatttaactataggagttgggtctaagttgaattttggagcatcctaagctcagggcctgttgtgtacagctctagctccatcactcctggagctggagctcagccaaatagttttagctccacctaaaatgggagcagagctgggtggagctttctcacaaaatgaactagagtgccacaactccacttcagacccaactcttgaagctaaatttagaatttggagctctactaaacaggccttcagctccatctctctagttcatttttgtgagagcgcatcatccgactccactcttattttagatggagctgaaactatttggttagtccgagctggagcaaaacataagccacagaagatccctcctacctctccaaaccaaaccaaaaataattctcgcccgctagcaagtgggccccacatctaatcatacatgatccatccgttcccctactcctattaaagaggagggggtaaagccctggctttcctcccccaacaactcggccaaattcaaagcaaagccgccattactgctcctcttccattccactggggacgtacgagctccgcgcatcccttccattccattactgaccttggctgctgcggctgcagtgcagagggggtttggtggtgcggttgatttgagcaataaattctctaggggggagggaggtatcggtcatggctgccgctgctgcaaggaggggctcatcgctgctctctcgctgcctgctgtccaggcccgccgccgccgcctcgcctgctgtcccctctgcgctccgcagggcaggtatattgattgattcatcatcccctggaccccttgttaattccaccgtacttttttttggttgtacagaatcttggttggtactagaagtaggtattcgtggccaagttcatgtgttctaggaaaaaaataaaaaaagttcatgtgttatttgtgtttcttggtgggtaaaattattttttccccaatgttgttggggggtgtcttggaattatttttcccacctttggttgatgccacaccgttgtagggcggcttctgtttgtctctttttgggtggtggtggggttttggatcttggagggattggccggacctgactgatctgaattccagggttggtgtgttgttgtcactagtgccactgtttaattattggttcatgacagggcttaattattgggtgcttaaaaacattatctcttgctgtatgggtgactgctctgatggcaagattcaatttggtactagaactcaaccatgtttgtatgaaaaaaaaatggtattgttgtagtagcttgtaatgattcttgaatttgctttttcacccagaaattcagcctctagagttgatcttttagatcaggttgtgtcctcatcttttgggaaaatatccttcattcaacgttgctgtcctccactactttctgtgtagtatacctatttgtcagctaatctggttgtagtgagaaatccctgccttatcttgacccggaaaatatggggtttctaggatttttggcgtcagatatgagtcatgagcatgagcggcagattggacctttcctcttttcttcggtgggctgtgatattttctttccttgacatgataggataccagtttttcttcagtccttatcagtgccatagaaaatcttaggtttttggttccaaaccgttcttgtttgctaatgtcaccatatatacagcgaaaccgatgtgaattgcctcgactatgaaatgacaagcagataccataaaaattcaaaacactattctttatctgaaattactgattagtactagtttactagttgccgggcagcacagtaacactcctggacattattgagtggtcattcagtcaaaaagaaagggacaagttgtaatcggctttcttatctgcgctacactgaggcacaattttaaactcttatttttcccatcatccttcaggccggtcaagatataaactagtttgtacctataagaaacatgaaataaatttagttccctagaattacagacagacggggtaaacacatgtaggacagtattggcgatgtattatacttttcagtcctgtgtgcttgtttttcaggttattttcctggggacaaatttatcacttacgcaaattttttcttgaaacgccagttttgaaaaataatgtttaagtatgtttaaatgctcctttcttccaccatgtgtggaggcatttgatctagggaccatatattatttttgtaccatttttgaggggcatttactgtcccattcagacttcattgaatacatgatcttaggaaatggatttactccgtaccactgctactactgtagtactcgtactattcctgactatgcattttctgcttgcagatgggacacaaggattgttgccgggaatccttcagaggttcagcactgcagcagtagcagaggagcccatatcacccccagtccaagtgaactacactcagctcctcattgatggaaaattcgttgattcagcatctggtacacttcttcagctcagcccttcctatgaaactatttcaactcaactagtagtaatgagattggattcataaggctagtttggtgggcttcagctgttctataggcattgaacaccacaaggcccatgaactgagaaaaatagattggttttaaatttctttttgtgacagtaagttgagctcataattcaaattgtgcattgcaatttcattaggcaaaactttcccaactctggaccctcgtaccggggagctgattgcccatgtggctgaaggcgatgcggaggatattaaccgtgcggttcatgcggcccgcaaggctttcgatgaagggccatggccaaagatgactgcctatgtaaacacttactgacacttctgttgctagctgctactgttgtattgttctgaagtcatgctcatagaagtacacaatttattttcttctacaggagagatcccggattctgttgcggtttgctgacttgattgagaagcacaacgatgaaattgctgcattggagacatgggacaacggcaagccgtatgcgcaagctgccaacattgaagtgccaatggtggcacggctgatgcggtactatgctggtgagtaagcttccttctgacatcaacagcaatgatcaacaaggtgcctatgcaggtggctaatattgttccactcgtgctgaaatgtttgcaggttgggctgacaagatccatgggcttgtcgtgccggctgacggcccacaccatgtacaggtgctgcacgagcccattggtgtcgcaggtcagatcatcccatggaactttccgcttctgatgtttgcgtggaaagttggccctgctttggcttgtggaaacactgttgtgctcaagacggctgagcaaactcctctgtctgctctatttgcttctaagctgttgcatgaggttggtgcagtgatcattttcgtaatttttgttcaatgagaggaatccatttttaattgctccatgctatttggacatttattatgattactgagaatggcctgttgttggcttgtgtagttttgggattgcaaaatattataattagttctaaagcaaccattttgcaaaatatggttactgagaattgcattttacagaatttcttgtcctgcagtctagtgatcaagaagcaactgcaagttcagatcttcccgaaaggaagggatagaaacaacccattctagtgtcaataatccttttaggtctaatatccaagacctagagtgaaatgattcaaatttcattgcatgatctgtttgtttagttctttgtcaatgcagccatcaattctggcttgcttcagtgcaaagaaagagtgcatttttgactaagtctgaccagctgaagcattctttatattttctagtctacagtgaacaatgttctatatcagctacacattattgaatcagaattgatcatcttaaatgattaaataggctggactcccagacggtgttgttaacgtggtatctggttttggacctactgctggtgctgctcttgctagtcacatggatgtcgataaggtaaacttgtggttttcttgtaattcctgtattttacagataatggccagaaaacagtgcaatatttagatttatagtattaaaatatttaaattcagttgcattctaagattttactttcactttcaatatagattgcattcactggatcgaccgatactggaaaagtcgtccttgagttggctgcaaggagcaaccttaagtcagtgacactggagctaggaggcaagtctcctttcatcatcatggatgatgctgatgttgaccatgctgttgagcttgcgcattttgcactgttctttaaccaggtaccacatgataaattatgtcaaagcaggcacaacaactttgttcattagtttgaaatctctaaatgatttttcttgacttaaaatttcaagggacaatgttgctgtgctgggtctcgtacatttgtgcatgagcgtatctatgatgagttcgtggagaaggccaaggctcgtgctctcaagcgtgtggttggtgatccattcaagaatggtgttgaacagggccctcaggtacatagtactgactagcacattcagccttcatactgcctgtccttcagttatccatcacatggccatgcattgatgtggtataatcatgcaggctttacattaattaccttcaatcgtattgtcaagtatccagtcatcataacacattcaggttttggactgatgataaccttgcaaattttgttttaatacttctagattgatgacgagcaattcaacaagatcttgcgctacatcaagtatggtgttgacagtggagccaaccttgtgactggtggcgacagattaggtgacaaaggttactacatccagccaacaattttctcggatgtacaggtaattaagcttaggataacgtcaaagaatgtcagcacagattgtccttctcctttgttgcctcatcttcttaacacttattgtatggtgattgcttcaggataacatgaggattgctcaagaagagatatttggccctgtgcagtccattctgaagttcaagtgagtaaacactccatttcacatgcatcctgtcccaaactcttagcagtaaccaaattaatcaagaactgaaccgaagactatatatattttttaagataaaggaagcttttattgatctcagacaattacatcaagttgatacaaccatactaagaacatttctggcctctacataactaggatgcacataactgacaaaaccataacgcaatttatgctatgtcgacagtgatctgaacgaggtcatcaagagggcaaatgcaagccagtacgggctggctgctggggtcttcaccaacaacctgaacacggccaacaccctgacccgcgcgctcagggtcgggaccgtgtgggtgaactgcttcgacgtcttcgacgccgcgatcccgttcggcggatacaagcagagcggcatcgggagggagaagggcatcgacagcctgaagaactacctgcaggtcaaggccgtcgtcacgccgatcaagaacgccgcgtggttgtaaacacatagatgtttggacatttcagaactggggaagaaataggtataatcttatggacggatgcgaaaatggcgataaattatggcgataagattatgatgatgatgatgaagaagaagaagaggaggaggaagaacagctgaaataagcttgtcctagcatggggctggcattgtctctaataaaccttgtggttggtgctcatgttactgatggagtatattgtagaagcagatttatgttcattatgaaatatatatcgcttgtttgggataattctaccgtttgtgctgctctcacaattttctcacaagctacttatgaagctacttttcagcgattggacattttttggtgcattcaaaacaagaaaaatcagtaaaacatgattaatctgaatcaagtattagttattataaaattaaaaattgatttatttgattattttaagaacttctctatatatagttttttatgaatcatattgtttagctattctaacagctaatacataatgagaaaatagatgtttccagaagcggtttagagtgctccctggttgttgaagaaagtaacgttgggtcatgaaagcggcggtaaggttgttcaccaaagttaatacagggcctgttcactttgttgccaaaaaaaacttaccaaattttgatattatttggcagtaaactagatgtagctattttttttttacaactttaccaaaatttggtaaggttaaaaatagcatcgaagtgaataggccatgtagcgaagcggcgtatatcgcctgtcgtcattgttcaaggtcacaactaaaaaagcactaaaaggtccgactgtgcttttgtatctcgaccatgagaacacgctgggtcaataaatagtaaaagtcttttgactggtcatggcacgtcatcaatgcacgattgattgctataaattcctctcaattacttcaagttcccgcagagagatcgctgtttacacgagggatgtctcctttctctcatccactttttatttaagggattagataaaaaacaatcggaaacttttaaatataactataatataattatattataatctctatataatttaggtataaagttgcatatattattttagtacttatattggctatgtatattcgattggatatttgggatgtagaggccaagtttattctattttttaaaaattattataatacttatacaatatagtgtagtgtggttatagcatagttatagtgaaattatattacaactatacattaggttagatttaaaaaaaatcactcaaaaaaccatatgacagtttttttaatgatatcttaatacttgtgtattcttggcacggcattcagcgccagctgacgtggcgttgaggtgtctaagttcagcgccatatgatttggcgttgagcagaagggtcagatttgaaataagttttggcagcggttcatttgtaaaaatagtttttgcaaagggtcaaattgtcaaaatttgtgcagatctgcgctggcgacggcgaggatggaaggcagtggggctcaacggcaccgtgggtggtgccgaggtgcggggtccgccgtgcgaaggccccggggctggtgctgctcctttgccggcgtcccgcagagccccggcctccgtcctatcccttcttccacctcgtcggccatggcgtcttccctggcactgggaggagtgggtggggtgcggccgggaggaagctgccgcccaattccccctcgatctcgtcgtttcacagctcgccgacctcgtcgaagctggccgggcttggcggcctcatcgacccccgctgcatcctctcccccgcccgcatctcgcccatcaatctcgacgactttgtgtccccgctcccgccgccgccggtgatgcccgcagcggagacagtggtggtcccggcggagacggcggcagtggtggcgccgttggtggtggtctcgaaggaggcggattcggcgggcgacgaggcgctggatctgaggcttttcctgcaggggagggatgggaggtgcgtggtgatggagctcgacttcggggtgctctgcgacaacatcaccttcttcgtcgccatggcgccgcacccgtcctccccgccgccgcctctgttgtgcgtcggcggccttcttccctcggacagatctgggagaggagagaggaggggatgggagggcaggggtggcgccgccacttccttcctctggcgtcgcccagtcgccgaacccggtcgtcgccgccggtcaccgccgccgtcaccggtgggggtgtcgagagggaggagaggaatgaggaagggatgtggagagaagaggagttgatttgaagagaagaagaggagagggtgtggagagaaggaaaaggtggtaggtgggtgattttaaatgtgaccgaatgttttttttgtgagagctgggttttcaacagcggttctgttttttttggccgccaggaaaaattcgaccgctagcaaagattatctattttcgctggtggcgcacctaagtgaccgaaagcaaaaatagacatattttcgctggcggtcgtattagacgggcggtgccctccaccccctcgttacgtatttgccagtggttatcacatttttcgaccagcaaaaattataagacaacgccatgaaaaatcatttttctattagtgctacttaaaaaatggactttcgcaagcagccagaacccatttttgtaggcagccagaacccgtgtttgtgaaaatcaacacctttccaaacgggtaggttgccgctccagttgccgccgccaatcttgttgtccccggtcaggtttggtggacctgtcactacagtgtgcaccggtgcgtggcgggatccgtccagtccgggcctaccgccaccagtccacggattgagtgagtctgtcgttccagtgggtgacagtggcaaatccgaccagtccaaggccgccgctgttgctcccaagcccacgcgagggagtcgttgctagatccaaccgccgtggacctgaggaagccgctgctgttgaccccatgcccgtgcgagggagcctcatctgattcggccaccgcgagcctcgacgaagctgccgccgccgcttcagttccgcatgaaggagccattgtcgccgccgccaccttgtccacctcttgaagtgctcgccagcgtggccgccttcactggtctgtgaaagtggaggagaggaggtggagtggggtgaggggaggagaggatgagggaggagaggggagatagagaggggagatgataagggttagatttttaagggagagtggagtgggcggctagctctttgggcttgtagcaggcggtccacttaacaagtccacttgcgaaaataggtttattttcacagacgagcctattaagaggcccatctgaaaattgatttttcatacaaatctttttttttcattgcggataatgttatacggtcagtctggagactaaaagggggcttgtccataaaaatcgattatgtaatagtgccgtgacactccctatactatatatcatgtttaaattttggtcgtaaatattaaatatgagagttttttcaatcgcaagatcaggaaggaatttattgttggcctctatgatcctatttggagaagtttctagctgctgcagctattttcagaaactgtaactgttcgaaacataatctagattatgagagaatctatggctatagaattcaaaaaataaattagaagttgggttttgcagcttctctagaccctcacagtctgactagcagctagctgtttctgaatctgagactagcaactaccagctaactgcatctcgtgatctttaagtttttcaaactagtcctatgtatttctcgtgttggttagacagttcacttattgttggtagctagtgatctggaacttatgtaagatggtaccatttttctcacgttggtttagacagtgcacttattgttgcgcatagtgggctggtgcttacgtaagatgagacttaggtggaggttggataagagacttaactttagtctctgacactaatttagagtattaaatatagactaattacataaatgaaagctaatttgtgagataaattttttaaacctaattaatctataattagataatgtttactgtagcatcacataggctaatcatgtattaattatgctcaatagattcgtcccgtgaattagtccaagattatggatgtgttttattaatagtctacgtttaatatttataattagtattcaaacatccgatgtggtagggacttaaaatttttagtcccatttaaataggtcttataaaaaaaaggatattctgaacttatatagcgagcgcgaatgcgaagacggacgcacacaaacgccccaaaccaaataaccaattcgcgagcctcttacggacgaacggtacggtgtagctagtgtcgtcggtagccgatcgatcgatggcagctgcttcgccggagctccgtcacgtggccatgctgccgttcatggcgaagggccacgccatgccgctcctccacctcacgcgcctcctccttgcccgcggcctcgcctccaaggtcaccttcttcaccaccccgcgcgacgcgcccttcatccgcgccagcctcgccggagccggagccgccgccgtcgtcgagctccccttccccaccgacgacggcctcaacgacggcgcggcgccgccgcagagcatggacgacgagctggcgtccccgtcccagctcgccgacgtggtcgccgcgtccgccgcgctccggccggcgttcgcggccgcgttcgcccggctcgagccgaggcccgacgtgctcgtccacgacggcttcctcccgtgggccgagctcgccgccgccgacgccggcggcgtgccgcggctcgtctcctacggcatgagcgccttcgccacgtacgtcgccggcgcggtcacggcacacaagccgcacgcgcgcgtcggctcgccgtccgagccgttcgaggtcgacggcttgcccgggctccggctcacccgagccgacctgaacccgcccatcgacgagccggagccgaccggcccgctttgggacctcgcgtgcgagaccaaggcaagcatggactccagcgagggcattatcgtcaattccttcgtggagctcgagccgctatgcttcgacggttggagccggatgtcccctgtgaagctatggccggtcggtcctctgtgtcttgcatccgaactgggccggaatatggaccgggatgtatcggattggctcgactcgcggctcgccatggaccgaccggtgctgtatgtcgcatttggttcacaggctgacctaagtcggactcaactagaggagatagcgctcgggttagatcagtctggtctagatttcttatgggtggtcaggtccaaatggtttgattcagaggaccatttcgagaataggtttggggacaaggggaaggtataccaaggtttcatcgatcaagtcggggttctaagccataagtctatcaaagggtttttcagccactgcgggtggaattcggtgttggagagcatctctatgggtgtgccaatacttgcattcccaatggcagctgagcagaaactgaatgcaaaatttgtggttgatatgctaagagttgggctcagggtttggccacagaaaagagaagatgacatggaaaatggattggttgcaagggaagaagtgcaggtgatggcaagggagttgatatttggagaggaaggaaaatgggcatctactagagtaagtgaactcgcagtgctttctaagaaggccatggagattggtgggtcatcgtataaaaaactagaggagatggtccatgagatcagtgagctaactcgtgataagagtatgtaactatggttatcggtgtttgctagtatttcggttttactaaatgtcacatttttcacttaatttcaatagactttttttcttgtgtgattgctttatcttctatacgcgtaatcatgccttatatctctcatatatacttttctatatatacaacaaattgtgttgatttatgatccaaatttatttgtacatgaataaaggtcagcttcggatgaaacgaagcgttgtgcacccgggtacggatcgttattcttttagggtttcaccttcatatatacttcttttaagccgtcgttcggcgttgtaacctcatcccggtacagtgaagatattttgctagctggcacccgtgggttttttctcctgctctgggagggttttccacgttaaatctcgtgtcttctatgattgatttattgtttttttattgtttcctaacaagttgaaaactgtgattgcaatgtaattgtaattacaaaataagttttgaaatttacaatttaattataatgcaaatgtagtaaatttacaatataaaaacgtttttatttttttaaaatatgatgttataaatataattactcgactactattttgtgaatttataaatttgtgctcgggcttaattttcacccataaaataaatggatattacatactccatctatcaaaaatgataatctaatactccctccgtatttttaatgtataacgccattgacttttcgaccaacatttgaccattcgttttaatcaaaatttttgtgtaaatatgaaaatatttatgtcatgcttaaaggacatttgatgacgaatcaagtcattataaaataaatgataattacataaattttttgaataagacgaatggtcaaatatgacaaaaaaaagtcaatggcgtcatgcatattggtagtatgtacgtagcctatataaattcatgttcatgtatatataagttgttttttttactccgacttttatggcggatgctacaccgaccgttctcttggctctgtgttcgaatcctgcgctgtgatgtcaccgttatcatacatacatgcatattctcttctttagcaaaggttgcgttcttgcagctttaaaagaaaatgctttaattaatcctttctccatattttaatgtatgacgccattaaatttttaaccaatgtttgaaaactcgtttaattccaattttgtagtgtcatataaacccacaacttttgtggataaacccactgttgatgattcgtcaagtcataaaaagattgattaagataacagtcattttcgacttaattataatatgagcggggcagtagtaacttactattcttgcatactaaatgtttgggtacgagatgcnagntctacctntnaccatg

SEQ ID NO: 10368 - DNA, 5072 bp, Oryza sativa
  unsure (1)..(5072): unsure at all n locations
ntattcgactctccaatttgagcctttccaccttgcaaaattctatctaaaattaagctccaccatgtttgtttacttttgatggagtggtttcttgggttttattagagtttttccttgttttgcgtgccagcatgtagttcccgtcgtttcgaaagtccgcggtcgccaggaaaaaagttcggaagatcaaagtgaagaatcaaggcaagtcacacaatcccattgagcatattgagcctattttataaatgttttaccgtttgcaaataagtatgcatgttttgctaattacatgggatccgggtattatctatctgctcgcttgtgccatgtttacttgatatttgtcctttgtcaaccgggggtaataaatcgactagctcatgttacttatgtaacctagctagaactatatgcttagccatgcttaattaccactagctcagttgatgggataattacagtattagacctttttagtatcagaatgagctgcgtgctcgagacacctggcaatgcttcatggtcgtaattatccaactaaaatgtgactgaatagtgggctgtgggtgcatggttttgctagtcgcacccatggcaattaaggaccggttcgcgggaaaccctagaagaatttatcgtgcttaccacaagccagcgtgggcaacggctgggcttgtagtgtagctttcctctagccgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttaggggcggtcgaccagattcaccgtaattagtcctaccttaataaatcgacccaatgcactgtagtttaggtggattggttgggcctgttcaatgtggtgtagcgttgatcagtggagatttaatgttactttaattactcaacagttttacagttttgctcaataaaatgctttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacgaagttagaagaccaaggctcagatcccaattgagttttgcctgtggagtggagctgaagccccgctaggatcgccttttccgctgctgctgcttttgtttcggtgtgaggactaagtgcctcttctgtaagtatttacgctttatttacgtttggaactttatattacttgtcgttttgtgtaccctggctggtcctggacagggatttaatatacaaaatagtctggaaatttgggctaaatttctggacgtgacaatgaacctggaggctgttttataggagttaatgtttgtagtgggtatcaactatataggaagaaatgatttgaggggcgtcgcgtgagggcgactggacaagtgtcaaagtataaatgaactgtccgttgatctttccttctcagcttaatcgtttaggttaaattggttaatatatgcatgcaactctgatcaggtggagctgggtttagcatgcttgccaaggtgggcgcttcaatcgccttaatttgttaaaacttgaatgtgtagctagtttgcaacttggatgtggatttaagtgccatttggacatataaccattcatggagtgtgtactgctatatatgttgttttgttcccttttgctagacctattgaattttgtggatcatgtttacatttagctgaaaaaggatggattgagggttattaagctagctagaaatagtttattaagctagctagttaagggttatcaaaccatcacaaaatacaaaatgcatggggaattttggtggtttggtcagtgtagtccacggacggaaccgacctacacaccaaaattttcaatgcattttgttttctataattctttgataattaaggacatttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatatatcctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctgcccaatgtgttccttgttaaatggccagtgatgaattgctcaataagaacagattatctacacttgttcatttttttgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgcttttttttaaatttgcatgattgattcagtggttatatacctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgctgtctatgtgaatttccctctgctgttgctgtttatgtgaatttccaccctgctgttgctgtttatgagaatttccaccctgctgttgctgtttatgtgaatctccccctgctgttgctgcccctgtggcatatatacccctactgctgttatatggccctgctactgctcttattgctgctattatatggccatgctgttgctactgctctaatttcctgcacttgctcttttctttatggataagaacagatgaactacacttgttctattttatggataagaacagatgaactacacttgttttattttcttcatgcaaatgattgtaattgatgcatatttctcagcaaaactgaggccatatctttcatagtataccccatattacattggatctaatgctatttagtctaatggtacgaaatttataatctttttcgcgaaagttaaaccatgtcaacgcccggcgcaaacccgccctccccaacacctgcgaggatcaaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggattgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcatttcaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaacagtttagggaatcaagcgaggcacatcgcgtactgcaacaacggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaattgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgtgcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatataggaaacggaaagtctccaaggaagagagggacgctcgtttgaaggccgaacttannnnnnnnnnnnnnnnnnnnnnnnnnnnnnnnnnnnnnnnnngcacgtcaatcattagggcgcacg

SEQ ID NO: 10369 - DNA, 10725 bp, Oryza sativa
  unsure (1)..(10725): unsure at all n locations
acatgaatataccccgagtcacaatacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccaatccatatctaataaaagacatttacacattccaatattaaattcaaactttcaccttatgcaaggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccgatgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaataagtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaagacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttgggacccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaagtgtgcgcctttattcttgcagaaataattaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctgtttttcagagggcatggctagcaaatcctgaggctagccaatatttagcatttatttttttctggaattaactcattagtgacgggtcggaacaaaaatccgtcaaaggtaaccttacctgtgacggactagcaagtaaggcccgtcagaggtgacctacctgtgacgggcctttacttttggggccgtcacaggtagatcacctgtgacagcttctaactacggagaccacaacctctgacggcctttatttaaagggccgtcagagatgagtcacctgtgacgggtcctaactcgccctaggctagcggagaccaacacctctgacggccttctagtaacttgcccgtcagagatgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtaaccagtttccataatttgcggcacaagcaacgatcaatttcctacttcctgcaagaagattgaagttgatgtgtttgcacttcacaacattcttttatccagtcatatccaatacatctatccccaccaattaactactccctccgtcccaaaatatttgatgccgttgacttttctagaaatgtttaaccgttcgtcttattcaaaaaaaattaagtaattattaatttttttctatcatatttgatttattgttaaatatacttttacacatttcacaaaagtttttaaataagacgaacgatcaaacatgtataaaaaagtcaacggtgtcaaacatttatatttagggaaggagggagtattttcctatcctcagttagccacgttaccttttattttcatccattggatcgaggtgcttaacacagcagattgcttattttaggacttactttctttactagcaatatacccgtgctaacgctacggagccattatatttttgaaaaaaaaactatgaaaaattggagaaatggacatttggccacgttcaaaaagtggtttcgctgaaataccatcccgaaaacacgctttgttaaaatgccaatatggaacgcgcgctcaccgccactttgccattttggcagttttgtgtattttcaaaaccatttttgttggaacatccggtgatgagacagaaatgccctcaccggcgtcttcgacagagctgaaggacctcaggtacttgtacggccccggcgagagccccttgtcgtcggtgacgacctgccacctagcgtccacgaccgcccagcaccaccgcatccacaccctgtacgccttgacaccggccgacggcaagcagcgccgccttgacaccagccgccctcccgccgctcgtcgtcgcctcctccaggctcctcctcttcctccgcgaagtccacctccatccccatagccatggccttcggcagcggcggcagcagaagcgcacaggtgagggacatggcggacgggccaaggaggactacgttacagccatggaggctgtcgtcgcggcgaccccctcgacgcggcccatgcgagcgtcggcctcgtcgcggagccggcgtcgaccacgtgggcgggcgcgtggctccagcgcctccctcagctgtgccgccagctcgccggcgctccggccgtgcccccaccctcctcctccctgtggctgcacctgcgccccacgttctgctgtcgacctacaaaaagagcgcgtagcaactccttcaccgcccacctcgccccccatgcggccacggaaggtattggacgctgatggccgcagagaatgcagcagtggcagcaatggcgggcatactttctcaggggactgaaggtgctggacgctgacggtgtcgaagctggaggtctggacgtgtcccatgatgtgactcgtccatagatggtggtggttggcaatgaagaaatccagaacaacaagaacgggatgagcaatgacatggtcctgatagagggagaaacgacaacgacgagctctggtggtgaacatgaccggatgagtgcatcaaaacacattcctggacgagaggattcgttttccttgaactcgcggaaagaacaaaagatggagaaaaaacgactaatattgttcatcatcttccctagccaacacaagaaacagaataggagggaagatgggcgatggtgctctagtgaccacggcggtgagtaaggtggccggacgtgtcccacgatgtaactcgtccatagatggtggcggttggcaacaaagagaacaagaacaatgggaacgggccggcaacaatatggtcccgatagagagagaaacgggaaaggcgagctcttgtactaaacacggccatgtgagtacgtcaaaacgtgttcccagacgaggagattccgcttttcttgaatgcgcaagagggagggaacgcaggggagaggagggatgccaaggagaagatgtcacgggagaggaagaggacgtgcggtgagggagagatgtggggtgctgtgagggaggagggaggcaggagaggagggccgtcaggagaagaggggctgcgggtagggggagcgtgtggagatcagggcaccggtagggggagagaggcggaagcggagaggggaggcgaagggggaggggggtgacggacgaaaggggtggcgaaagccttacgtattttttaattagttatagatttgattgacatatgggcctctcatattttgttttaatcttttttagttttcaattttgctcttttattttttttatcaaactgccacttaagcgccacgttagtaccatatgggacgaaacctagtcaaaggagccacgtagatatcacatcagcaaaatctggaaacaatattgctaagggaccttgtttgcagtggttttttagatgcactgtatctggttttatggttgttaagggatacaaaatgaacctattccacatctcacggtcgacacacagtattcaacccctgtacatcccaactggacatatatgcccatagcagcccagcccaaattcccaaatgcacacgaccctgttgtctcgccaattgttgttggctggcccccaaaagttgaggaccaccgatcctagagcatgttttagaagataaataagaagagagaagagcagcggcctatagatttatagcaagttgtagtacggactccaagacgcagtgtgtgtatgacaggtgggaccaggtattaatagtatagtatataactattatatgaataagctattagattggttatagttgaattggaggtagtagttggctatactattaaacttgctcttaaacttgctcttagtgtgctgtcatgctgtgcataactagcgatgctccaacaacacccacgctaattgacactcaccacagtccacaggatgtctcgccgccgtctgcagctgctgcttcctctcgccgccgtcgtgctcgtccacgccgccgccgccggctgccgagcgttccagatcgaggaggccaccgtcgacgacatccagctcggcttcaggaacggcagcctcacctccaggcggctcgtcctcttctacctcgaccgcatcgcgcgcctcaacccgctcctccacgccgtcatcgaggtcaaccccgacgcgctcgcgcaggcggcgcgcgccgacgccgagcgccggccgccgtcgtcccgccgcggtggcccgctccgtacggcgtccccgtcttgctcaaggacaacatcgcgacgcgcgaccggctcaacacgacggccgggtcgctggcgctgctgggctccgtcgccaggcgggacgccggcgtggtgcggcggctccggcgtgccggcgcggtggtgctcggcaaggccaacctcgacgagtgggccaacttccgcaccatccaaggcaccggcggctggagcgcgcgtggtggccagggccgggtaagctcgtcggtcttggtttcttccatcacaaagtcaacgttcaactttggagcaatgagcttgtatattctatgccaatttgttgcagacttattttttcttagtaaatttcttaaacccccacctattatggtccaaattatataaaactacacggattttggtacatggcacataacgctaagtattatggtagtaaagtttcataaaaactaccctgcagtggcgtatagctagctaggtggcactgtggtccatgtaccacctaaaaatttgatcgatattaaaactataatatatgtgctagtcaacataataaaaattatatagtgcaccacccatttaattgacctattacatatagatggaccacctttactttaaatcctagctacgccactgacacactgttagctattttgacatactccgatattaaaattttgaaaagcgaatgtcgcatttatagatggataaaatcctcgtaggtttgagatgcagctgtagaactcaaaagtgtgatatattaaagtcaaaatgatcagtagtgtgattttagaaaactttagaaccataatatctaagattatgtgtcacatgaccaaatcgccttggttttatataatttggactataatatgtagagttttatgaaatttactcttagaaaaataaccattgatgccattggctgattactacattagtgtcaaaatgaccatagctgtaaatttttctttagcttatcaaaacatagcttactctaaaacatgagttatttgacatatccttagggcatcacccatgtatattgcctaagttggtaataaggtgggcccctttaacagtaggtaatagttgtttcaattgtcacaatgtatactagtaggagatggtagtaaggtgggccacattgcaacaaaaaaaatattgtgagaatgagagagatggctggtggaatggagagaagagagattgtaatatttgtttaatcatacaaccgggtagtagtgctactaccgaatattactactacccaccttgatacctatctccacaatgttgaaccaggtaatagggcctcctactacccactttttaccacattgtggatgccgtaagaaacttatcacttattaccttggtattttgcggacaagaaagcaaatttttgtcgctgcaaaacaattcaaaattcgagctcttatgccagtacattactaaatatttggcatgcatatgcagaatccatatgttctatcagcggctcagtgcggttcaagcacaggatcagccattgcagctgcagccaacatggcggcagcaacacttgggactgagactgatggatccatactctgcccatcatcgttgaattcagtggttgggatcaaaccaaccgttggattgacaagccgggctggtgttgttcctatctcccctaggcaagacactatcgggtaatctagacatactccttcgttgccaaatacttgtcgccagatattattcatatttaaaattggatcgtttatcttttttacgaaaattttatcaaatatctaaattaagatactacgttagtaaagtgcgttacatctttcatttaaatattattagtgatcaaaattgcaactgtggtggtcaacggtgacaactatggagatgtatatacataccaatggacgtgttgatttaatttttactgtcacaaactcacaatccagttgtgttcttgtgtatgcacgagatccaaagtactctattttaatttcttataatgtaccaattggacaattgacttggtaaactcaatcctatcaagtcaatgtcaaagctattagacgaaaattttcaaatagcatatctgatgttcacccttaaaaggtactttgactaacttgagaaatgccatcagacatgagcttggtttgaaaattgccatcccaaatatcttgtatagaaaaatgtcatttgacatgttcaaaaatatgaaaaatatattgacatggaatttagatcaagctgtcaatttttttccatcgtgaggtccattaacatcaaactagttagaaaatgtagtaaatgatagttttgcccttctttctttcccaacatagggaaaattcgaaattattttgctctagaataatctagttttatggctttgctataaaccactctagttttgtgtttctttatcaaaagacattccaaccattattttattatatcctcttccactagagagataaaactttacaaaaatgattttaaaattggacaagcttgcaagattaaaatttaaacacatttgatgaatttgaacatattttacaaaatttcaaacttgttgcaaataacggaaataaaaaaaacttgtagcgaataatggtaataaaaaaaattcagagatggacattcagatatttactacaagaaaaattgttttttatatgtactatttgatttagggtctaaaatttgatttatttgcctgatattatgaaactattttctagttgcctgatattattttcctaaataaaattcagaggtggactttcaaatatttactacaagccaaaaaaatgtttttatatatctactatatgatttagagcctagagttaattttatttgcttgatagaggattgctatggttggaaaagtttaagaaaacgaaaaaagggcatgggcaatatatcattttataatctttggatggaaaatgtgatggcaatgaaaagtggattattccttgtttgccacttgcaaattcatcactggcaaattcgcaagatcccttatttgcccatgagaatgagagcgcgcggtataactagttatgtatttaatggcataaaggatcttcgtgatggtattgcctattctgttgtggtggcaatgaacaaattaagtccatatacttcacttgttttgttggcaccaggggtcaaatgtatacccatgatttaacttggataatgacatggctttataagacaaggttttttctctttgtatatcttgctattattaatcttcaaattgtttatggtcatttagatcattttaccagttaacaaataattaatatcactgacctctgtttacaacctaactgcattcatcacgacagagtccttgtatgaagaaaagaatagtttggaagctggatgctctcaattttgaaaattgaaaaattaaaaaaataacaagaatataaatttaatagcattaaatagttataggaaaactgaatctactgctctaaaatatgttaatcagacacaacaaatcgatggaaaatgatcatactgtaaaatcatcaaattcctagtatgaatcttatcattttaaaatgcaggccaatttgtcggacagtagcagatgcagtccaagtactagatgctattgtcagttatgacagccgtgatgcgaaagccacaagggcagcatccaagtatatcccacctggtggatatgtgcagtttttgaaacctgatggattaaaaggcaagagaataggcatcccaaatggatttttcaacttcccaagtgggacagtgcagcagattgtttaccagcaacttctcgacacagtgaggtatgtatttaccagaattttcacgaaattatatacattggtataggatataagaaaaattgagatttcaatttgcgtttcacagaaataaaaattactcatctggtttaaaaattaatgatgtaagaccctacaattatatgaaacggagattctatatgtgaatcttggttgaacatcgacttgtggcggcagcagcaagagatgagaaaacagataattgggaatgagaattgtagattgaatctccttgctttattcatccgaatgcagcctctaaataggcttacaattggtaggcggtgactagggatcggtcgcccgattcaaatctctaaaaatcaggcgttgacgtcagcatgacgtcagcgtcacacatatgtgtaaaaccactttaaactaatttttctcttaaattatttatcccgattgcaccattaaattcgttgcaattaaatctttaaaacaagatcacacatggatatattccgacgaaaaaatagcttattattgatttttttaaaaaatattgcacgatgttccaccaggtatatcggaattgtttcattaagtagatcgaaaatgttttagtcgttaaaatcgggtgttgtttcaccttatataaaaacaatgtttcagcaaatagcgaaagaatgtttcagttcactgcaacattagatccatacatagtgaaacactataagtacgctaggtgaaacatttttttgtggaacaaaaaatgaaacgaattnnnnnnnnnnnnnnnnnnnnnnnnnnnnnnnnnnnnatggtgtttctcagnnnnnnanntccccaca

SEQ ID NO: 10370 - DNA, 14476 bp, Oryza sativa
  unsure (1)..(14476): unsure at all n locations
ggatggcccnnngttgtttgacnctgatanacnnnnnnnnnnnnnnnnnnnnnnnnnnnnnnnnnnnnnnnnnncagttctatgcaacactagatctatacatagtgaaacattgtgactgcattagataaaatattttttgtcgaaaaaaaataaaccaaattcccttaatagatggtttccaaaatatgtgggtaatttgttgtaatagagttgtgtgtggacacgtggcgggccagggggagcgcgtgcgtgcatgggggcgggggagcgcccgatttctgctccccgcccgatcgtccgacgggaatcattttcccaattggtaaccaaattgctaagaaatagctaaaaaactgataaggaaaacagctaacaaactttatctaatttgcaagcggatagaactgttggcgtccggcacggccgatcagacacgacgtgctgcgctccctgcggccgcatcctgctgagccggcgtgcctctgcgacgatatgttatcccgaccatgacaattatttggaaacaaattgaaacatctagctttttattgtcatttaaagcaggtgtaattttgtgaaatttaatctaatgtttattggactttttggagcatcggtattctaaattatagcagatatgaaccagtttaggtaatatgccttgcactttacgtgtggcaatatggaaaagccaatgtccttgatatctgacatttacatcctttttttgaaggaaacaaggggcagttgtgattgagaacctggacatagcaaacctgactgttatacaagatgtccttaacaatgggcagcagattgtgttaccagcagagttcaagtcaagccttaacacttatctgtcagacttatcctactcccctgttcgttcacttgcggaaataattgctttcaacgatgcacatcctattgaggtctgctctagttcataaccttttttttctgtgtgtattctttcgcagttccacagttttacatgccttcatattacgagaaaaggttatattgtatatttttcttcaaatctgaagaaaccatccgttatttgttatcagatgatacacagaatctagtacttgttgaagttgatcctttcatcaaaacatacgtaaaaccatttatatattctttccatcagcacaaaaggtactgttagattttgttaggagaaatatttaagacgacatatgattagaaaattttctgttctgaagaggcactataaaatgtttctaaaatgacaaacaaaaaaaaacatagacttcaaacattctaaagtgcgtagctgatactccctccgttttatatttataaatcacttcgatttttttctagtcaaattttactccctccgggctgataatattagtcgttttagacaaggataaagtcaaactttaaaatctttgactacaaataatttttaaaatatttatcttaaaaatataaaaaccatatgtgtagattagtcttaaaaagtacttcaataaaatcatatatttgttgatatttctatatatattataatagaaaatagttgttaaagttaatttttggagaccgtgcccttgtctaaaacgacaagtattatcaacccggagggagtattaagtttgaccaaatttatagacaaatttaattagcaatatttaaaacaccaaattagtttcattacatctagcattgaatatattttgataatatatttgttttgggtttgtcaaagttaaaaaagtttgattaagaaaaaagtcaaaaacgacttaattataatatgagcggggcagtagttacttactattcttgcatactaaactttttgtgcatcacggtatatttatgttgttgcaggttatgaagtcaatattacttttattactatagttgattgcatttcatcttctttttttcaagattatgaatcttggtatgtaaactaaccagcttaaaatttcgaaaatgttaaaacagatcgctaaatcatattgccaaatatgtgtgtataacaggagagactaaaggattttgggcagctcatcttcctggtagctgagaacactactggcatcggcgcactcgagagagccataatccatcaactaaacaagctttcagctgacggactggagaagctaatgaaggatgagcagctggatgcaattatcacgcccaatgactcagtttccaccgttctcgccattggcggcatgccggcaatcaccgtaccagctggatacggtaagaggggagtccccttcggaatttgctttggtggattgaagggctatgagccgaggctaattgagatggcttatgcatttgagcaagctaccaaggtcagaaaagcccctaagttcttgcgtggaacattttagcaagatggcagacacgtctttaactagtaaagccaataattcactgggctgatcgtttatccactgctggggaacccatctttagtcccggtttataccttttttcgtataatccgggactaaatatatccatttttaataccggttggtaattaacaccaaccgttactaaagatgccacggtaacaccaaccagtagtaaagatggtagcatctgccatgtggcatcaggtggtaccatctgtagtaccgtggcatcatggcttggtatcagaaaggtccctaagtaattcttgcatggaacattttagcaagatgatagacatgtttttaactagtaaagcaaaataattcagtgagctgatcgtttatcgcaactactattattgagcttgggaatgcaatttaaaacattggtgagtgggctggggaacattttagcaagatgatagacatgtttttaattaactagtaaatgtaccatcgccgaccgatcgaggagaggcggctactgccttcgtgtcacctcgaagaggacggccgctgccgtcgcatccccggggagaggccggccggcttgacttagagaggtgacgaggtgaggatgcattgccgttgcatagccgaaaagatggaggagataaggttagaaagagacaaaggcagaggtattttggtctgggaaaaaaaattgagcaaaagcatttctatcaacaaaaagaacgaaaatggtattttgatgaacgcatctcagtttaggatggtattatagcgaaccaatttgaagcgatggtatttcagcgaaaccattcttttgtgatggtaatttctcgttcgcgtgggtgggtttggctttgtgttggtgggggtaccgggatagggttagaccgcgcgtgtcggaatatcaggaattcttttagttatctcaaaatcatcaaaatataggatacgtacgggatacgtatcggagcgtatccgataggtattcgtattcatcgccatatcagatacggatacgttaaatgtgagacgtatccaggtaatatatgtagggactaccaatatcatacacaggcgagtgctcattcgatcactactactgaaaaacacttctgtacaggttaggaactaaccatatgtgtcatatatcccagccggcactcagcatgcagcacccatgacctaggtcatcggtgtcaattattcaacactaactataatacatatatatatatgccggttttagtaaaaatcgacacctatatggaattataggtgctggttcttaaagcaattgtcatgtggctgccttatggcactggttctttagaacaaccagcacctatatgtaccatatagttaccaattgttcaccggcaaggacacatggtaagactatagatgtcggtttgtaataaaaaccgacatcaatatgccggtttgtagcaaacggttcaattcaataagcaagagtgaaacggagtgagaaataatgaaaactattcttgtagaaatcaacatccaacaacaccaacaaattaaaagtaaaaccttccctcctttagctagtccaaaaaatacaagaggtgtatactaagctgttcttttcttgatcagctcaagagaaacactacaaggattatgttgatacatgacattatccgtttgtcatagacgccctaagaaacgtcacaggtaactatccgtgagagtccagaaatacatcatagaatccccgtcataaaccttcttcatggaaaaaaactgtcacggatgcgctggatcggtgacgactgtgaccgtcatggaatagctattcgtttggttttcaggcagcatcagtgatgaaacggaccgtcatggacgttgtgccacatcagcacagctatctcagcatggtgaggtggaatctgacatggctgcatctggcacatcagcttggtgacgtggctataactgacacgtcagcttggtgacgtggctcaccattccatgacagcattttttttcgaaattttttttattagggtaccgaaatgtaggatgggctgggccgacataatgggctgggccgagatattttctgcgcggcccattttcgtttcaaattgtcctccaatttctttttatattgggtaattagccaactttattttaaatttggctcagcccatttcctcggcatattgggccggcccagataataccagcagcccaagaactcattctggaccaaataccaccacagattcaaatacatccacagattcaaatctccaaaatagtacatcacatcatagaagcatcagcacggtatgcttacatgtttactgaaatcactgtatcataccaaaagcaagcaccctaaacaggttcaagttcaccatagaatgagtctactgcacataatgtgctccaccagaaaagcatcactacaggagtgtacttcacaagttcaacaaaatgcagccatccaaagcaaccataccacacagcattaaattcttgcctgactcgatggaatcatggccatcaaacgcctaagtagagtatcagtttcggcttgcctctgcttcatctcctcatcattcttggccctttcttcttctgctgcctgcattttcttcaccatctcatccagctgttggcgctgaatgttcactagctccctaagatctgctgatgtctgcttctcctccaccagtgcggcttgtagctcgcggcgacttccagcactggaatcgacaggtaagctgttgatccccacattcacaagaaatttgttcttcttagttttgccagcaagcacttcagaaacagcatcattcactgacttcggttcacagccatcctcaacaggttctgcgatcttcatctccatttcagcctagcagtgcaagcgacaatacatggctaactgatcaatgcataccaatttaatctatcatttgtttgtgaactaattgacaatttacttacaatagctgattgtacagcaggagcgaaggctttcttcttgctgcagtggagctctttaaacaaatcaagcccatttggtggtgcatctttgtacttgtccccctaaacaatgaaagaaaaccaaaaatttgagcttgttacttcttcaatgtattttgaacagtgattacaaatctgtaatatctctaatattaattaacacttcatgcatcaactatctatacaagaggataacaaatcaatatgtattaaacaaacattaactaaattggactcaccaattcgatgatgtgcatgtcatagctgcgagaaccagttgtctggtggaactgcactttagctctgtttgctttgttcttttcacaaatcaactgcagcaacaaagttatgatcttaaggcacctatgagatccacatggtaaacttgaaatgaaaattattgccaagagcttaccatttttttttcatccttccagtgttcaacaagttgaagccactgaagatcactcatgcatgttacaggagatgttttcaacaccagatgaagtggataaggatcaaaatacttctttttgagcttatgtcgctgctggcaaacagctctcttcatcattgccacacatgcctttctcacaggaccagcagttgtgtccatatcaaactttgactgaaaacaggtaatgtcatagtcaattgctagataacgaatctaaaacagatattaggcagcgtatggtagttcaaatttgtgcattcaattaatgcttcagagaagagtaatgccttcaagcaagaccatccaaaaatgaaaataacatactcactaaattcaataacagatgcacaatgtaccctaattctcactcattcagagacacacacattcaaagacacatgaacttcagagaaattgcaagtacttgttagagatggtatgtaatgttatgttcacaaataaacatagtggaaagcctaaagttcagacactcaccccaactttgttgatgtaaaaccttaagagtttcttgttgtccttgtaatccttccattttgggaatatgggaacatggttcctgactgcaatgttgcactcggtggcaaattttgcagcaattttcacagagtttggcctcattttacctggttcaatgaccacaggaagtttgcccttctttgagcgggacatcctttcaagacctcttcctacattaggaccccttatccacctctcctcatatgcttctgcatctgcaaaggatacaattaacaacacttgtgtgggctgttgaatttagaaagggtttagagtgtcgggatttggagaagataccttcagaatcaccctctgcgttttcattgacgttggtgtcatcaagagtatgctcatcaaggtggggggtagtgtccatctggcaatcatcgttccatccaacaccttgaataatgaaaacagagtttgtgatagctatcaagatatggcatttgctgtgaatttaaatactaattactgttatcaaaaacttgttaaagtagcttgcacaaaccttcttcagtatgagcagcattaacctcgcttaaagcctgaattgggatttcagcttgagtgtcagcagcgagaacctcacttgtagcctgaattgggatctcagcttgagtatcagcaacaagaacctcacgtgtagcaagaacatctggtgccacatgctttttagacctcgtcactttaccaggttgcaatggtgcaacaactcttttgccccctatggcgtgatgagtcacagaggttacattctcagtattcttcttggatttcttggtagcaggctgcaataaatgaaataaatgaatatgtaaagtaatctagaactagtgaattattgacaaaggttgtaaaacattattgaatggagagatctagtaccttatgtttcaagcaatcatgtccagacttcatgttctgtaggtcttcagtctcaggtactaggctatcattactaacatagccctcactgagatcatcatcttcagcattggcatcaaagtcagggtcatcattgtccttattcttttctctatctcgctgggcaactgaatttccaaacacaatactggataatgctggtacccctagccgtcgcatcatagcattgttctgaagacacgttctcatccttttcagttcatagtcattaagtggggtttctgcattaacaagaacaattatagcctaatatttgcataaaccaaaaatctaacgagggctatattccctagccactgtcgctagcaaatcctagcacatgagggcaactcagatagctagtacagaggaaggcagagaaagtattcacctgtaatcttgggtgctgaccggggcctctttgcttgccctttcttcttcggcgccattagggtggtgttgcggtcgatgtccactgcggtggtgcagcgtcgttgggctttcggcggcatatggatcgcgtcctacgaaccggcggcggtggagattggacgcacatagggtttggggtgaacaatgtggtgtatttataccaaccaatgagtgcatgcgaaattacctacaagtcctcctatttagaagagtctaggtcatggcaagcgagggtataagagtcttttgcagcttcgaatacattttggaggtgcgcggagcgcgcgcaccaagcgaaattttgccgccgaaatggagttgggttgattggagttcaggcccagttaaggatataatgtttttaatttttctttcagtagcataaatacatttcatttaaaaatataaattataataaatatgctgattatgaaaaattcatcatcacaaaagttgtttgaattattgagatctagaacttttgtattggtcctttctccataggagttcgtttcatattgtgaaatttgaaatcaacaatatgagaagttccaaaattatttggggaccagaactgatttgaaatgaagaaatcataaaaaacaaagttgtagaactcttgggtgtgtactacttttgttttcatcatttttccaatttacattgtttgaacaactcaaaatttgaatttcaaaattttagaacttcgaatacaaaattgagacactaaatgacttcaaatgaaaaagtcaagaaaaccaaagttgaataactcatcaaaatctacaacttttattttggtcatttcgttatccgagaaactaatatgaacattattcacaaatttttcatctctctcatagttctatgaaacactatgagaggtttgtaaatttgtgaacaatattataatcacttgatcggatgaaaaaatgaccaaaataaaagttgtagatcttgatgagttattcaattttgttattcttgactttttcaattggagtcatttattgttttaaaatgatatttgaagttgacattttttggaaattcaaatgttgtattgataaaacaaagtcccatgaaaagatgaacaaaataatagcttcaagaacacagttaattgatagaacacgattttataaaattttagggaaaaaacatcaaatttgaagcaaatcgtgaatagcgttgttgttgaattgtgcaagtgaacagctactatgtatgttagtcagctaatgtatgtgtgtttctgtgtggttgtatgattcctgaaattgaattgaaatgaaatgtgctctgctcaaccagttcactacttgtgttatgtactgtaaaatcaattcacaggttaaatgacatgataaattcatcgaaaaaaatgacatgataaattaaatttctcagaactgagctaagctgagcatgtatgccatctttcacatgttgacaagcacatagacagttcaatggtagaagtatataggcatgatggcctttcacatgctgacagaatatataattcacacaatttggacaggatgtcacaaaagatctcagctcacaaagacaatacttgtcgcactgacttaagttgacaaacataagttcataaaatgccaataggggcatcacatacacatgtcacaacaggaactactcatcatcgctatctacctcaactggggcaacttcaccttcactccaatattccacagccgtgtcgtcctctatctcatcaccagacgattcaccatcttcagcaggtcgattttgcttcataagtcgagcaacttcagaagcatcaacaacctggcgagcttcatcatctcggttcaaaggcaggtcagataaattctcatctacctctggtcttctcccatcttcctcaatgcactgtgtctgttgatacggagatgcactaggtgcattttgttcatcaacattgtataaatgccgatgcttaaacatttggacaagctgccaattttcgccatgcttattatctggcaggtagaaaatctgtttagcttgagtcgctagtatgaaacaatctttcttgtaccaaaagcttccagtattgacgcttctaaaaaaaccatcatcttttagtgcagtcttcttgccatctagcttgtaccattcacatctaaaaagaaccaccgttcttgtattcccatcatccttgctgttgtactgcaactcaataatatctgtcaactttccaaagtaatcaattacccgaccattatgtattccagcacacgccactccagagttttgagtcttcttatttatgtcacgctcagcagtacagaaccggacaccattgacaacacatgaagagtaagatcttactctcaggtcagggccacatgctaaggcaaacaggtcatcatctacaatatctgaattgttcaacctccacatctgcaaaagggattgcggattagcaaatcattaatcaaaacacaacgtatatcgaaaacaaaatgtgaggcaactaacatggttcctgaaccaagtagcaaatccaagcctagtccttctatcaatatcagctgcttgcacccctgcttcctgtaattcgccttgaaacattctgtgaacaaacagatttcagcaattaaatcaaaatgcaaatgtgcaagagtacaagatagagaggttagaacatactttatataatcctgggcctgatcgcaattatataggatataccaaaccatttgatcaaaatcttcagagtaaccatagtcacatgcaccaatcagattaacaccgtgcccaaaaacatcaatattgaaggccgatggatctgagaatcctggatttctcggtgctcggttaaacctagtctccacatcctccatatacctagagcagaatgtgagggcttcatctgcaacataagcctcagcaatcgagccttccggtcgtgccttattcctaaccgacctcttcaaagtgtacaatcgtcgctcaacaggatacatccacccaaattgcactggccctcgaagcattgcctcgtcaggcaaatggacagcaaggtgaaccattacatcaaaaaaagcgggtggaaatagtttttcaagcttgcatagtatagctggtatttctgtcttcattcgaaccaagatatctttgttgagtgtttggctgcacaattccctaaaaaatttcccaagctcggcaatcactaaacatatatcatcatccaaaatacctctcataccagcaggtaatatcctttgcaacagaatgtggcagtcatgagttttaagcccatgcaagctggttccctctgcagttatgcatctttcgatatttgcagcatagctatctgggaactttgtttctttcaaaaatttacagaatttaatctttttttccctagacaatgtgtatctagcttcaggcatgtgataatcatctccatttggctgcaactgcaattctggtttaatattcaaatcagcaagatcaagccttgcattaacattgtcttttgacttcccatgtatgccaagaagggtaccaaggaggttttcacaaatattcttttcaatgtgcatcacatctagattgtgtctaagcttcaaagatggccaatatggtaaatcccacaaactaaccctcctaccccaaattggcacatgtccctctgaacgcttccttttttgacctggtctaacatcatttaccttggccaattcttctaacagctcttcagttgtgaatgtacctggcttctctttgctttcatgtagagaggcatattcattattcgtgcgcagacgatgacgcctaggaaggaaccgacagtgaccaatataacaaagcttgttccttatggaatatgatagaggatttttgtcacaatggagacaagcaaagaaaccttgtgtggtccgaccagacaaagtactaagtgctggatagtcatgaatgcaccacaacacggcagcacgaagcttgaaatcttttcctgtcagagcatcaactgtatcaacaccagaccaaagactaagtaactcctctataagaggctggagaaaaacatcaaagtgcttcttcccaggcgatctaggaccaggaatcaacaaagccatcatgaagtttgattcttgcatacatgaccaaggtggaaagttgtatggaatcacaaaaataggccacatactataagatgatctcatattgccaaacggattgaaaccgtctgtagccaggccaagcctaaggttccttgcatcttcagcaaaatctggccagcatttgtcaaaatctttccatgcctctccatctgcaggatgggacatttccttctctttgggttccctattcaacttatgccattgtgcttcctctgctgttttcttggtagcaaatattcgttgaagcctaggtatcaacggaaaatgccgcaatactttttctggaaccttcttattcacaggatctttccatcttgatgcttgacaaactggacaagtatcaagttctgcatactcctttctaaatagcacgcaattgtttgggcaaacatgtattgacacataacccagtcctaaagtacgcagcattttctttgcttcttcatatgaattgggaagacaattgttctctgggaacgctttgcgcaagactttcaactgtgcagaaaatgctgagttgctgatcctgtagtatgacttcaaatggagcatcttgactacaaatgaaaaccttgaaaattgagtgcaaccaggatatagctcatgctttgcctcttccatcagagttttgaaaacagactcatggttactagatgggttgccatctccatttgctgcattattacaaggtacttgagcccccatgaggtctgttaagatatcttcaactctatctgcagcattgttttcatgttctataggattagaatgtggatccacatctactggttcctccaaaacatgaacatcattggcctctccatgatgaatccatcttgtatatgtactagacatcccattgagcaatatgtgcctctccacatctctttgagccatggatttctggttaatacaccgactacatggacacaaaattgcagcatccccaggaaatcgctcttcaacaaatttcatgaaatttcgaacaccatcaatataatctggtgtgaaaagtgcaccatgtatccatcgtctatccatctagtacagaaaattcaggcaccagattgacatcacattcatggctaaactccctatcataccctctaatcgaagtggatatcgaaatacataccaggccaatcagtggagctcttcaatggttgaactccaagggaagccaatggagctcgtcgataggcgagccacgccggaggcaggcagactgtagatctcgacggcagagtaccaggacaaaccactgctaccgcaccccccccccccctccatcgctgctgtacccagcctccgacgctgtcgcacctcgccttcgccgatgccgccccccgccttcgccgatgccgccccccgccttcgccgcttccaccccacgccccacttcttttccttcactgctgccgcacagtcgccggcaggcccaggttttcaacttgggtattcgaaattaaaagagatagaaaaaatttcataaagtcatagatggatagaattgaccataaattgaatgcgttaagcatattaaagtacaatactaaactattaattaacaaaacatttcaaatttatagagcatacaaaatgacaaaatgataaaaaattaacaatttagagaagaacttttcgtttcttgatattttgaaaatgattgatgatgtctttttcctacaatacaacaatatagtatattcaaccatgaatcattaatggatcaaattctaaataaaaaatgtttaaccatgaacaatatcctagaggctagattcaactatgaattaaatcctaatatcttatattcctatttcctaatccaaaatgttcctacttcctaattcctaaccacatgacatctaggtgactagacatgaaggggaaacttagtcattattgctatttatctgtggtaaactggtaatgtagaagtagtaagttcctatggtactccattactccaagacaacttaccttcagcgcgctggcgtccagtggcggtggcgggctggtgcggcgccgtggcgtggcattctggcgtcggcgtgtcgccggactagggaggcgacgagacgggatgccgggacgaccggacgggcggcggcacggcgcgaaatcgcgagtcagcgagtgcacggcgggccgcgccgccgcgcgcaagggggcggggcgatggccgacgggcgacggggcgggccggaggacgacgggcggtcgggcgccgggcgggcgcagggcgaccgccgaccggcgacggcgaggcgactggcgctggcggcctgacgcggcgccgcgggcttcctctccctggctgccttgcggctggcggctggctgctgagaaggttgtgaggaggaaaggcagatcacgatagggttccaatccattttgggccttcttttcctattgggccagtgggctgaaatggtgaggagagaaaaatggtgggatggtgagttcagtctgggcttttttgagtgggtagaccttttttctttttccggggggtcggacgtgtctaccaagngagccccaca

SEQ ID NO: 10371 - DNA, 22778 bp, Oryza sativa
ttatagatactcatgctgcatgcctgcattttgactctagaggcatccccttttcgttatatatatatatacatatgaaatatatccttcatatatgtattttttctgaaaaaatcttgggtattcatttgaatacccatgaataactgtggccccgcccccctcgtgccttcattcaccgatgccacaccccgccttcaccgcctccatttccaccaccgccgcgccgccgtgacacacgtgttatttgtttttagggtttgattttcatatgatgacgaagggatgtgtatgatttgtttgtataaatatgcagtgttttaagtataaagaaatgaatataccgtttcaaacattcaatcacaagttccatggcattgcagtggtaagccatttctctctggcctggccgatcgtaaggtcgaatcctgggttggccgcctttttttttttcttttctcgctatttaggctgctgtccatatcaccgtccacgtcaccatgacatccacgtcgctaggggtcccactgtccacgtcaccaaatatccatctgtgatatttattcgaaagcgtcatagataattatgaaggtgacaaatggttgagattgtcacagagttagcatctaattctcaaaccgtcataggtgtactacgcgatgacaatttcagaaaccgtcaccagtaaaccgtcatgtactaacatatttcttgtagtgaaagaggatgagctatatactaagatcataggtatcggttcttaactagaaccggcatgtatatctgaagccatataggtgccagttattatagtgaaccctccaatggctacttccgatggtgaagatcttaaaggtgtcggtacttaaatagaattgacacctttctcggatagcgatgttggttctaaaataggccccacattttagaactttgatgagatagaaataaaccctacactttttatttatgtcctcatatcacttaaattaaatttgatggtaactagttatagtttaatttgtttttttataacttgtaaaagttaaaatttaatttacatttttataacgatataacacatgttaatacatcatctcaaatatttttaaattttttcataactgtttgactaacatacgaacaaccagaaaacgtcccctccagttgaaaatccactgtccacgcgcccacacgaaacctagctaataaccatctatctttcggcgacgatctcccccgtggcggggctactactcctccctgccacggtggtcttcacggccgccgccgccgccgccatcttccgctccccctccggcgcccgggcaaccacgtcggcgcggcacacggggcaccaccggctcttcctcagccacgagtccacgcacggcgcgtggaagctgtgctcgcaccgcggcagccgccggcaccggtccccggcctccagctcctccaggcacaccgcgcagtccccgccgccgccgcccttgacgacgtcgtggcacggcagcgcgccgatctcgtcggcggacaggcccttccctcctcctcctcgggctccaccgccgttcccctccgccgcgcgcccgggcgccgcctcctcctcgccgcgcgacgccccgcgcccgcgccgcagcgcccagaagacgacgacgatgtggacgaccagcatcagcgcgacgccggccaccaggaggaagatggagatcaccgacgacgacgacggcgacgccattatattctagctaataactaagctacgcagctcgtggacctccatgtgctgcagccatggatgcatcgtctttgcttcttccgctgctcttgctttggatgtggagacagatagctagatatatagctagcgttggattgttcaggagaaaccaaagaggagatgacgacgacgacgacgactgtaactgttaattactcaaccagatcagcatgcaaattaagctagttgaggagggaagctaggcatgcattaagtgaagtagttaacacactcatcgtcactgctgataattcaagccaggagtgaccgaaacagaagggacaaacataacagttcagtgttgcaagcccaaatgtgcatgcctgttaattggggtgttttaaatgtgagcttagagcatcaccaacacttcccccaaattccaaatccaagaaatctttttaggaatctctaatcaggagttaggatttttttaaaaaaactcttatttttaatagtttgcgtaaaattagctctctaaaaaaaaagtatgcccaccttcaaccccctccatgctattgtcctctccatccgcgcgatcggtccctccccctctgcttcacgctatcaaagattggaagtggttgtgcgctcccaacttgtggagagcttaaaaattggataaggggcgttgaaattttcgggaattgattgggggggactgttggagcatgatttttaacctagaaatcatataatttttgtgttgggagctgttggtgatgctcttagttaataatctgtactcaccctatagcctataacataagtaaggtgttttggttttcttactggttaaaattttctaacttcgataagtttatagaaaaatatataaacatataaaatcaagttagtttcattaaaatccaccctgaaatatgtcttgatagtgtatttatttggtatattactatagatgttaattatctttttacatggtaaaagtagaaaatttttatttaagataaaattaaattaaaatgcctaacaatatggaactgagggagtatattgagatggattatagttacttgtttgatgtaattgcctttaacattttaatatttgataaacaacaactttaacctatgaactggatataacgtatttttttctaaccttaacttgatttgcaaaactagttataatgattatagatttaattttttcatgactataaaaggtggccaaacatggaggaacacaacaaccgtgaattgagccataataatcgtctctctcatgcctatctcgttctacatactactaattactccctccgtctcataatattagggattttaagcttttgcttacaacgtttgaccactcgtcttattaatttttttttgaaattattaattattttattcgtgacttactttattatctacagtactttaagcacaacttttcgttttttatatttgcaaaaaaaatttgaataagacgagtgatcaaacgttgcaagtaaaaactgaaaatcccttatactgtgagacggagggagtaattgttttgagaagatgcatccatgatccatgctgaattaaattgtcataccaaattgcagatagaattcctttaagaaaaggggaaagatagacgacaaagtagggcagcagggggcagggtatatactccctccgtctctaaataatatttgatgccattaactttttttaaaacatatttgaccattcgttttattcaaaaacttttgtaaaatatgtaaaactatatatatacataaaagtatatttaacaatgaatcaaatgataggaaaaaaataataattacttaaattttttaaataagacaaacggtcagacatgtttaaaaaagttaacggtgtcaaatatttatggacggagagagtatatttcagttcttaatcggataatgccattggaaaaggtaaaagatattgtgttcaaaagcggcatgttgtgtgtgcattgttccaatttgattcactactacattttttttattatgatctttttgattcgctactacttgtcttgctaccgatggataatggatatgtatggaggagtagctacctaggaaatggaccgctagtccaaattttatatgggaaagtttgtgacattagacggacctcctttcgtcagcacgatatgaaaggatgtgcccagcccgtgacagtcacactttaacggtgcatggttttgtcacccaaaacagggggactatgctacatcgcatttgcagccgacaaaattgatgagctgagatgcaaagcacggtcaagctagttaattacttcctccatttcatattacaagactttatagcattgtccacatttatatagatgttaatgaatctaatgtgcctaaattcattaattaacatctatatgaacgtgagcaatgctagaaagtcttataatcttaaacggaggtagtagttaattaggtgcgatgcaaacaacgacgggagaaaggcagaaagctagctcacatttttttttaatctctatgatcagggctactgtcaataacttcctggttaatcagggattaatcatgagctatgcaagctacctaatcctcaggttgaatttacttacttactgggccaggatatttgttaatcacctggttattgcaagatcagtgtcacttttgaatggatatggtcactatgagtatatttggtcgctcatatcctccatgcctatcctatctctctaatcctcgctaagtttaatctagtgaaggacatacacacgtagctattgggtttttcacatcggacaaacctagacacaatgagatgttgtttggttggttgcattaaaaataccaaatgtagaagagtttatttggttatatggactttcagaatagttacttctctatttggtagggtgttgatgcgaaaaacacacactggactgggagatctgtttaactccagtacaggttctaaatcttgctcttgggttcaaaggcatgccagttgatttgatccagcaatcaacaagaaaaaaacacaaagaaatcgtagttaaatccataaacgatagccgatcggttagggccgatgacgtatcgttcaaactctgagccgctggtattgataatagattggcgatgaagaataaaggaatataaggttaaatctactcgatcggctgtagatattaatgatatataatcatgttaataaaatatatttaagctaagcgattgggatatatcgaacagtatgtcgagacagtataaatcacttatactcaaatgtactttaagatgacaattatatatacatttatagagccgatcaaatagatctaacatgtatcggctaatactccgataccactctatattaagatattgaaacaaataagatatatcagacagcacacctgatatactttaatggaacaagatcttaatataaagggcagatttagcatgtcaatcaagcatacaataaataaagtagctaaatcaggtaagatcggctgaaaccccgatgctatcttcgttagagatcataaaacaagccagatattgcagttacgaatattacttaatagatcgaactcaaccgatgcagcattaagcataaggataaatacaagatctaagcaagatgatgaaaaccttagaaagatggtagatatgctatataatctagattaataacgaaatcgaaccctatcggctactctccagtgatagatactagccgatcatagattaaatcgtgaaactaataaaggttatgaaacatatatgataacttgacgattcacataaacaagattagagtaacatgaagatgcaagcactaatcccgagaacgcaagctgacataacaagtttacctcttgttgaagattgaaatcgatgcagctcaatccgaaagcaagaactcgtcgaaaacattgaaagtagaaaagggtggcgatgcgctgaaagtgttattgaactgtcgtttttaattacatgggttcgggtcatatttatacccgagatacatgataggtccttaccggacacgactcttatctctaacaaactctaaaatacaaacgaatcttcacggcggactcttgccgaaacatatctctaaagaaactattcaaaatatcctaattaatagatacaattgcctatctgtgagcttacctctatcgtggcaatcctgatgtagcacgtcgattgattccggaaacggtttcataaccatctcaacgaaatcggccgtatcggctgtatcggctatcttctgtccgacccatctcagccgatgccctcgcagccgatacgtactctgttttctgaacacaatccttcaccgaatctacttcgattctgatgtcgaacctggttcatggtttactaaatttggtcgttaacaagggttataatatatcatttttttaagaaatatattaaacacccaatataaccataataactcaaacgtcgattcttttttttttaaaaaaagagtatagtgcatggatgacctctaaacttatgtgaatgcatgtgtcatataggtccttgaagttgttatgtgtatcatataggtccaaacgggtttcaacctattccgtacgctgacgtggtatgctatagtagcacctatagtacgtgccggtgagatccatgtgttagtcacatatagaagcaaaattagaaacatatttttctcctctctctctctctctctcgcactcttaatttattatctttctatgtgactgacatgatatgtgggtcccactgacacgtaggcaatactgtaacatgccactttaggacacggagcgggttggaacctgtttgaacctatatgacatccaggacaagtttggggacttaaaagtatattatgaaatttcagggacctatataacacacaagtttagagaccacccgtgcacttcacccttaacaaaaaatacaatagtgtttgaccctcaataatggagcggccctttttacaacaattaggtggaaaaagaaaaaaaggaaaaagggaaaaagaaataaagaaaaaggagagaggactcgagaagagctttgtctcatcgtcgttggtctattcgcctgttcgccatttagcaccactcaccaccgccagaaccaccagatccgatgggcacgagctcaaggccactagatctaatgttggcgagctcgtggccatgggatcctgcatcgcgatggctgaaagagaggacaacggccactagatctaatgttgaaggcggcagccggtgagaaagtagtgaagtggcgtcagtagtgtgatggaggtgcggtagcgctcctcttcccagatctagtagtgatgggaagcaatgccaaccagatccagttaggcgagtggtggggcgatgaagatgacgggcgtgcctcgatgaagatgacgacaacgaccatggagcgatgggaagacaccgctgatgtgcctatttacccatcgcagccctccgcccaccactcctcgctgcattggatctggcggccggcgacagaagaaggtgcgggacgatggtggccaatgattgaaggtgcgggaactacttgaacaggagggatgtagcagcaaggtggatccatcgtgcaccattccctccatcaagctcattgtccccatcttcattgcctcatcgcttgctggggagaaatgaggagtgtccaggagcaaggtgttgaccccatagcctatccttgcacatgtgggcctggccgagtagcgaagctcaaattgagcattccaacttagcttgactcggggtggtggtgtggggggggggaggggctttttgcatccgttcgtccatgctaggagcgacatgcatgcaaccaaatgacaacccattgcatccgtgcatgcgagccaggtaccatgcaggcaaccaaacatgccctatggtttggtcccttacgggcccaaccttaatatgtaataccacccccgccttgccagtgctagcaaggcccgccgatcaccacctccctccatcctactctgtatgtgttggggcatcttcttttattcctcaagtcaaataagaacccaatcccctacttctcatcctctgtcagtctgtctctagctgcttttttttgttgggggtagtacactacccctatctgtgtcccgtcccttcccttgcctcctaaccacttcgacaacaagtagtcgctagctcacactagcttagtgctctcctcctatactgtggctaaggtggctccctaccacctggctagctagcaggggcacaaatccaaaaaaaatggccaagtatccagaggcggggaacgtgccgagggtagtatgggtgggtatgaaaatactgaattcggtcaatttgtctagtaccctcggttaagcaaatagatcggactgagcagatgagctgtcccccatcccgcatcaccttgctgcctccattaagcaccttgtgacatcctggcccaatcaggatgaggcatgtgtagcccatgtgagctgtgtgcgtatgtttagtacaaccttgctagtttaacaagggtggaaccaacttacaaggccgtgtccctccaactataccactcccagattaacccttttacacaaagcgagaacgaaaatgtaagtgtggtggtatgtgtaagtgggtccgcccgtcggatggactagctatgcggttctgaagggagggctgttgcacacccgcaccacctcgttgcccccatctagcaccggtgcggtaggccactaaccacatatccaaccttcctcctccactcctccacatcacgtgctcccttacaacagtgtgttcgcaggacgccgctccgagccttcgatgcttgcgtgtgtgctggcagtagcagagatccatgagcgatggctggagatgggttcatgtgttttgtgatttttgacgattgtgtgtttgtttggttttttgatgatcttggactctgtgtgatgcttgcatccctagatgatctttttggataactctagatgattttggtcatgatcgagaccgtattgcttggtcctaacttttttttaatgtaagtcaatcttaattttgagatgaccaaaacttcctcaatgaccgaagactgagatggaatccctacccctagaggataggccccctcctacatattctttttatgtaggattatttaattaaatcgataattaacataaatagtgtattaggcactctccatatctcttacctctcatcttgggtcagtagatgccggtgtcccatacatgtcactatatcataactaaacttcttgtgctctcaacatcaagcacttctatatacttttgtttctatatcattatatgctatcatttaattaagattgaatagttagtttggtccttaaacttttacttctgagtcaaattagtccttgatatttcatagtggccaaaggctgagtgcctgtttagatcccctgataaaatttttcaccctatcacatcgaatgtttgaacacatgcattgagtattaaatataaacaaaaaaaaaactaattacacagattgcgtgtaaattgcgagacgaatcttttaagcctaattgctccatgatttgacaatgtggtactacattaaacatttgttaattaggcttaataaattcgtctcacggtttataagatgaatctgtaatttgttttattattagtctacatttaatacttcaaatgtgtatcagtaaatccaatgtgacacgctgaaactttacacctttggataaacaccctcttagacctgaagaaaggaccattttggaaatactatattattcactgggatccaattcacgttcgtcttgcaaatttcaggaccacaaaattaatatctgtcaaatccaaggggctttctaagaaatgtcaggatcaggatcggttagtttggtatcatctgagccattggttcgaccggccggcgaggagttccacgcgccgccgccgccgcttctcctccagccgccggcggggcctcccttcctacccaagcctccgccgccgttcccatctcctcgtcctccgtgccaccgccggcgcctcttccgctgaatccatctccacctcctcacctattcgctaacgccgcctcccatcctctcttctctccgggctccggctagatccaagtcggcgtcgagatccagggctcgaaaacccctcacctatccaaggatttcaggtagtgatctctgcgaattccttgaaactgcatgcttttttaaaaaaaactcctgtggacactttaacaatccaaaatgataaagtagttaattggcttatttcctcacttttctatctaccaattggttcgttaattcatatagatatatcttaattgcttagtaaagattatctcttggattgttgtgtactcgtcgatttttgatattatcgagccgtcccgaaataatggctatagtttccatcttccattgggtagtgttcattgttgtctccgtttcagcgttataaatcaaacattgtgcaaattgtagatagaaaaaattgtgaagattgaggaaaactatcctacggctcaatgagcagagccggtatgtcagacaaccagtgaagtccatgtcttatgcccaatgcttgcactcaaacctcattcctttcctaggttaaagtatgctgttttattttggccttggtgcacatttaagcaccagatcttttactcccattttcatgtccgcaaattcatgaaccagcagattaatcatacatgtacaccaattaaatattgtaacagaagagatatatattcatattcaacatatatgcatagaggtgaagagtaatcggttactgggcatgttgctggtgctattcttgttattcttaacgcccgatgtagataaggatgccgagaataattcattcttctgtgtacagcgacgagggctatggttcactgctgggcattgctgcctgtctttgctgtcgatttgacatagtccttcctaatcttcttcagcatcacgaccacatccttcatttccatcctttgctctggggagtcagccgagcagagcaagcccagctcgaagactggcttaaggaatccatcaatgctactggtagaacaagaggtgtcctgtagaagctggccatcgacaacatggacaagatctataggaaatgcccagtgaacccactgcctgatgctcagatctcccacaaacatggcatctgtgggtctcttcctagtgaacacttcaagtagcatgatcccatagctgaacacatcgctcttccgtgacgcttttccaagaaccccatactctgcacaagaaaattagattaatgacaactgattgcaccacttaattgttgtgaaaagatcaactgggttgagtaagagtacaaaagctactaagtacctggtgccatgtaaccaattgttcctggcatgcttgcagagatcgtagagttatcatcgcctagtaacaacctcgcaatgccaaagtctgccacatgtgccgtcatttcatcatcgaatagcacattactaggcttcaaatcacagtgtacgaccacctcatagtgctcatggtgcaggtattccattgccattgacacatctagcataatatccaacctctcgagaaagcctaactgcatcctttcttccgagtgtaggagtgcttctaagctaccctgaggcatgtactgaagaaccaatgctctgaactccaggttggagcatgtgttcaatatctttatcaagttgcgatgtcgagccattcgaagcacacgacactcagtatcaaagcttctcatggcatgttccagatggttgtgtataacttttatggcaaccaccaaaccgctactcaactggcccttaaaaacttttccgaagcttccagatcccaacatattgtcttcactgaaattatcggtagcgcgaacaagctcatggtaggagagtaattggtggctgatcatgtcaagcataccagaagaaatattttgatgcttaactttctttctaattattccatataggcaacaagttaccgctgcaactactatgattatacccgggagtaaaatatactttagtatgtgtcgatttcttttgggagaggttgtttggcatggagaaaatcctaaacggacaacaccacatagccctgagttccctgccaaggattgcaacgtgatgtttgagaagacacctccttctggtatctgaccttcaagcttattaaaagacagatttaggttagcaaggctggtaaaattggccaggtattttgggatggtaccagaaatgttgttatgggatatatccaaaatttgcaagccagataggttactgaaagagtctggaatggaatcatggaattcattgacagataagttcaggtatcctaacatctgaagatgtccaattgaatcagggaggctaccgacaaagcggttcatatagatatccatgtagttaatttgttttatattgcctatatcaactggcaattcaccactgaagaaattttgagatagatctagcaggatgagcctatcaagatgaaataagctcggtggtactgttgatgataattggttatgacctaatgctaggtgctctaacttggtcaaattactggggtccaattgtaagccagagaacttgttggttccaatgtatattaattcaatattatttagcatgccagtgtttaatgggatggagccagacaagttatttgtctccaagttaaggaatacaagattcctcatcatcatgattgattctggaattttaccatgcagttggtttcccccgagatctagcacctgaatcccagttaaattcgaaatcatagctggaagttcaccggtaaagctgttctcaaatgcagagaatactcgcaacagacttgacagattccctacactgcctgggaggctcccggtgaaatgattcgagtagatgtaaagggtagacagatttatacagttggaaagtatggatagaaagtaaccgatatctccctgtaggttgttttgtgcaatactgagttgcttcaacgagttcatgttaccaattgttgccggtactgagccatccaactggttctctgccaatgaaaggattgtcaatgctgataggttaccaagacaagcaggaatgggacctgttagttgattggttgtaagatccagcactgaaagttggcctagttgtccaatacccacagggatggcccctattaggttgcacatttcaaggcctagtctggttagcatggtgaggttgctaagtgcagcagggattgggccagcatcaaggtgattcctactcaaagaaacatcactgagattcgtcgacttggccagccacgaagggaaaacaccctcaaatagattgtcaccgacgcgaagaacttggaggtacggacacgctgcgagtcctggtggaatttgaccggtgaatctattatgggagattgagaaccactgcagaaccgggaggctgaaacttgtgttgcccgggatggagccggtcaagctattaaagccaagatcaacaacagttaacctagacatgttgaagatggcttgtggcactggcccagtgagattattgtactgcagctcaagcaactcgagcattggcaaagagccgatgcaacctggtataggtcctgacaggctgttgttgccaatactgagataagctaacaaaggcgtgttgttgaatagactgtccggtatcgagccagtaaggtaattcccaatgagatcaatgctgcgaaggcggcgcaaggcctgtagttctattgggattggaccggatagctggttcgacgggaggtggagtagttgaagcctcatgaggttccctatggtggctgggatgccacctgaaagggcattgtggccaagatcaatgagcttgaggcgatgtagccttcctatatcatccggcaccgagcccgtgaggccggtatcggtgaggttgaggacggagaggaaagaaatgttaccgaggtgaggcccgagctctccttggagaggaatgcccggcagctccagggcggtgacgcgctgccggtggcggctgcacgagacacccacccactggcagaacggtgtgccagcggtccagttgccggcaaggatgttgtcaggatcggagaagtgcactttcaaagccagaagcgcagcgaggtcggtgtcgctgccattgctcttgctcagacctagagaagaagcagaagccacaatggacagagcaatcaacagcgcaacggagatccataccggcaatccaatcgccatgtctgggtgtgtgtgatgcattgacaaggagtgaagtaacttcactggacgaacaagttgtggttttatttagcaactcggtgctttcaacgtctaggacgaagaccttgactgttgctctcagaaagtgcaagaaactgtaacacttttgataattaggaatgctagtaccacagacttgctggaaaataatgtcatcacagactatatattcaaccgatcacagcgtgcacgacaagctagatatgagagctgtctctctctcagccatcagccatacactcactgaaaaataattttctgtcaaacaacttgaaggcaaccttagtctttgtcgattgggtggttagtggcgggccttatcaggaaaaatgtctagtacaaatttagaaactactgttgggtacataatagatgtctgagatttgtccacgtcaccctgactatttttttttactccaaatttgttactcctagacttatctatgcgtaatctttttacttcaaaaatgtgaacaaatctcaaacgtctatttgaatatccaacgatagtttttacgtttgtcctacatatatatatagagtttacactacatatttttccgtcttgttagccttaacaagacaggatacacggcctgttcagttatgtagttatcatacagctgtcaggtccgttttgcgtgacagcgtgaagatgtgcaccctgaaggtctgtgatgctgttgtcttttggaccatttgaatgtttttgtttacctggaaagtttgtgtaagtttctctgatgatgctgtgccgacttattatcagctggaatgataatttaatttgtcttagtagttctgatgctctgcttatactcttaggaatgttttgtttgtgtaaagacttcgttcatgctccttggctttctccaaaacccgggtcaataataagaaaaaagtgctctttcacctcccccctgcacgcacatataatcatgcatccaaaccaatttcatgtaggtgtcggtatcagtttactaaatcgatcagacgatggtagcttagcttatgttcattcaccagtgtgccttcatcggcagcagatgaacacaaccttagctcggctgtcttttaatttgattgacatactgtgcccatagtcaggaaactgggtcgaattcagcgttccttaacccgggactgccatcccccgtcttagacacacaggtcattttcatttccccaccttataaaaacatcttacaagtagcgtatcacggtttctcgactctgtcgatccgggaactttgtgagtgcctaatctagtatgctctgcaaatcgtagccgatcacgtacgttctctccatccacctgcacccacttgcacttatctacgcaccacaatctcactgcaacatcaatggtatcactactacagagaatctaaaaggggttggttgaaaatctcatataggtatcgaatttcccaacaagcatctcgcagacggtaccaatgagaaagaatcaaaggtatattggttttggaaccggcacttataatacctacaacgagaaaagaaaaatgagtcaactcgatgaatcgagctaatgaattgaccccatcatcactccaaatattgcagttgagatccacattaaaggcataaaaatcgagaagccatggaagaaaaaatcaagaacattcattacatttcgctcaaaaataaatcaagaatattcatcacattgcacacaacaattcatgtttggatccaacatgaacccatatgccccaaatcacgaactcctgcatatttcccttctcaaaaatcaagaaaccccaacgcaaaaacagaaaagtgggcaccggcgtcatcactggtgaatccccgcagcaggggaattcgcagttgaagtagtccttctgtggatccatcatgccatcctctctcgccgccgtggtgatcccgagcttgagggctgtcggagctggcccccacagccccgtgtctcctcctcgacctcacgggagagatggaaggatgagccggacctcctcgtcgccaccgtgtcaacctcccaccgaccggatctggtggccagggcgggacgacgtaggggagagggagaggggccgacaccgctgcgtatgggagaggcgtggttcgggagaggagaagatgaggcacgcgaggtgataagagcgtgattttttttctcatgctccacgcccatcggctcaattcaatcagtattggtttttttaaaacaccagcacttgtacgtactcaaaggtgctagttttcaataggaatcaacacctttctctgacaggagtcataggtgccagttcgtattaagaaccgatacctatctctttataaaggtgtcagttctaccggatggcgccctatgggcatgtgcctcggacgggggtttgtaggtgccggttttagtatttccgatacctacagcatcgtcactgttgtatatttctgtagtaacgtgtagggatgatcgattagtcgatgcacacaatatatcgtcagataatttaggaagggatcaggaataacttaagctagttaacctcgtgtaacaccttgaaaatttcggttttaaaatacgaaactaaaaattcggaataaccaaaaatcttttctaacttccttgcatgctggaatttattggatgttatttcctgttttcctgttatgcatggactaaagaacgaacgtctgagaatatgtttgtattttgattttaaaatattatttattcaaagaaacatgattatgaaatatgttaatatttgcaaataccaattgtcttcctaaaaacccttctctatataatagaacccctctgacatatttgctctataaataaagttatatattactatttggatggacaccctctatgggatagtacattaaaacaaatactatttcacaaaggaaatatagctctgactattttctaagaattcttaaaagggaataagccctttggaaaatgacttgcaaatgatatctactagtaaagtatttgttaaaatcctatttgtcaaatataattcctaaaaggctatttttaaagaaaaggctttctcagataaagtctggtttctctctttgagaggcctagcccagcccacataatggaatttttaattgttgtgtgtgtttagatttttgagccaaagatctcgactaaaccttatctcctaaaaggatgccctccgttcaacgtcctttcctttcattatcctcccggtctgatttattaagtgcttcggtactaaacaaatcaaagacccgaaactctctcctcttatcgcaatattatcactctctcaaactcttatcctacggttaaattaaaaccgctctattgatttgaattcgataattccctcgaaaaatctacaatcgttcgacagatttatttgtcgtgcgtcgattcgaatatctccaattctatccctatttttgaaccctaccgcgtcgattggatttgtatgccatgcgtcgtccctaaaacccctttgtgttaccgtcgttcgttcgtgcaagcgctcacaaagaaatcgcggtgtattcagccaagcaagatgcaggaaaagctctatgcttgacccttgctcatccaaatgccaatttaaattcaaaagctcacagttccagtccacatatacaatccatgtgcatactcgaattcaaatgtccaagttacacagtcccattacaattatacagtcccgttacaaatacactgtccatttacaaatcccagaaaaatactattacagtggaccaccttttccagcccaagcccactgccagcccactccctctctccttctcagccaactcatcataagtctgttttgcctccctgcatcaacacagccgaatcagccagcatgcatgcacaaaacatgctcgagggaatgcctacaagccacagcattgatttgcaccaaattttgccagccaacaaatgcctgggtcccctcccccaacaacatcccatacacccatgctcccaatccacagaaccatcccccaaaacacaggaaatacagtgagatgagtccacaccgaaaaacaacgccaagtccaggaaacaaagctcaccttggctcctacctacactccaaccgccgagaacgtatataagccgccgccaaaaaccatcaccccctgcacctcctcatttttcctctcctctccctactctgcatttttgttctgccactgcctctcctctgtccagcgcattggctgccgccactactacagaatcggtttttgcatacgggcgaacacgatcttcgcatgcggtcggccggcccgcatgcgcgaaatggtctgcaaagatcgccattagcgcatgcggccggtctagccgcatgcaaagatcgatcttcgcatgcgtctcttaagacggccgcttgcaaaaatacatcttcgcacgcggtccatttaagcagccgtatgcgaagatctatttctccatgcggtcgacttaactagaccgcatgcgaagatctattttcgcatgcggccatcttaagtagaccgcatgcgaaattcaatttccggatagcttaaataatatttattttagccttttggtgagatgtgtctcgtaattaatattaaattattgagggatttattatcgtatttcggaatagtaagcatatgacataagacaagtgccacagtaacaaacatgtaatacataaccataaattcaatcgtaatttacatacgaaatatataatacaagtgccacagttttttcatcatatgtataagtagtgtacatgtcattgcatatgttctttctcccactctctgagaggtttaaatttgtcgtccattgtgagttcactctggttgtcgtagaagagacctcttgcgttgcagacatcacgacggatgaatcggcagaggttagcggccacgttcaagatagtactgtcgttgaatcattgtacaatatatgggatttcagggatctgcgcacagaaaggaaaataaaatggtactcagtgagaagtgtgtgctagatgggtttctttgtagagaagagttcgctgacttactcggttactggttgttttgtacctcccgtttactctgagcatctcgcacacgtaataaccgcacaagttggttcccggtggttgtttgtagcactgcgatataattgtgagggaccgatctcactagatataatttagtatatatgtattgttctataattagttgtatcggtatagatttgatagtaccagccagccagtcctggcagataactgcttctaggatggaatatgtactggtctgcctcttttgcggtagtacttgtgtgctctgtttgaagaaaacaattgttttttcagtagttagaagactagggatcgacctaaacaatttatattaatgaaatgtttatcacttacaaattcaaaatagtgaggaattccataaatgtctccttgtcatagtgtgcggggtccaatgatatgatcaattgatcttttggatatacaaggaataatatgtagtggtctctgcatataagataggcttattggagacataaaattccgaagaagataaattaattaaacaaaaagaagagaaagcgtacgtgaacgcgtatgggaccattaagacatcttcgtcagcgtgcgccaacattgctattgctaagtatgttgctacttctagcttcttcctcttgtgcaatgtcttcacatattctcccttctcttgaggggtcttgccaaccaattgctcgcagtcctctctcagctctacgatgtgttgtgttttgcatattcttgttggatcgatgtatccaacctttgctccagttctatcagcttcgtggaattgcatactgtacaatgaacaaagaagtaatgagatttggtttctttgtttggaatgatacgtgtaacatgtaataaagagttcagacttacagacagaacgccgcaacgtgattaacgtccattttatctagcttgtagagggcataaaggtctcggaaagagataaaaaatatcccattaggaccactcatgaaagcgccttccgggacggcgacgcttatgaaaccgagacccttcctagatgccttgatataccattcgtgcattaccctcatttcccatggtagcttattcataagataagttggcaagaatggcttgccatactcataagtttcaggcacaccggcagataaccaggattgcacttcatcttgggccgctagtactgacttctgggagtctgacatgacgtgagcaagttcttttctcttctcagaattcctgaaagctaaaaacatgaacttctccttatccttgtcaatctcctttgggtcgtatgtcgatatcaactttggaattatacgacgaggttcgaaaggattagacttcggttcagatgtagtaccttctggtatgtgcacttgttctactagagcagattggggtgtaggtggagaggcttgaactgagggcggagccgggggagcatgctgtttagctggggacgtgggagaggcttgaactggttgcggagccggaaaagcaggctgtagagaaggggagggtggtggtgtaggttggcgaggcggtgacctaagcgatggtggtgatgccggatctcgaggtgacggtggttcaggaggcgacggtggtgcaggagcggcagctgtccttgcttgcgatgaggatggagttgaagatcctactgctggaacggccgcggtcaggattatgtctctgcggtgccacaagataaactgattcactgcatcaccgagaagttcaatccccttaggtgcaggtatgtctagttccaaggaaatgtggtcgctatggaccttggcgacctgtacccttgcgtaatcctcagggattgccgtgttgtggaattgatgtctgggtatcgctaaacccgttgcaacctccttagtctttccagcgcggccgataggtacgacgagactgcacggagttggtccagttatactattcacagggaagggagttgtctccactgagcctacactactgggtacattagttgtttgctatgcggattgtgtgggttgctggccatcagggaataaccttggaaaggctgtcgggtttttagctgccaacgagtagaagtgttccttcacttgcgcatagattttgtctgatagttgttctttgtatttgtctctcttcttataacttggtgcgtcttgtggaaaccctatcttccaactcgtctttgaggacaaaccccttacacgttcagagtgttcggcggtccccaacgtcgctgtaagctggtctcgctccctccgtgggacgaactgtcctgctctttctttctcgactatctgctgcaaattagtagtcacttgttctatgtctagagtctcgaatagtatgtctccctcatccgagacttgacctgtgctacgcgccaaaacagagttcttgctacgttccgccatggggtctaccaacagaggtttgccggccgctgcaaatctttgctcggtctcccgccactgatttacgtgcccagcgtatccgctcgaccccaatctatggggatatttgttcttcttcgcgaggtctgacatttttttactcaaagccaatgcttcatctgttgtatgatctttaacaaacgtatcccagtcagcctccgatatatgtccatattccgtgaacggtgggagattcttctgaacataatcccgatttagatcggacttccactgtcgccatcgatctcccatctttttaagtgcgtaatctctcctcctgacctctgatccaggagggtacacaaaatacttctgcaactcattccaaagaagtgtcttgatgttgtcgtccaccgtttcccataacttgacattaatgggacaacgcgtcctgactagagtgccacaggtgttgctaaacttggaccgcactatcagtggctcgacgggcttcctatcctgatcgagagcaatcacgttgtaaatttcctttggtaatttatttttgcttctctcaccacgtctttttttcccactcccgcctgcacttatagatgtatccgtacgttcaggtgcagacgtagtagtgtccatctcaacttcttcctctctcctggtcctcgcggctttgcgtttcgagcggcgtcggactaccatctgcacagtataggtaactctctacaccattaggttcatgtcacatcatagttagtaaataatatatggctaacgatgttcagcacttacggcctgttccataggtatgtagtccggatcatcatcgcgagggacgacttgtgttatttccattggaaacgggtcacttggtgtgcgccatgtttcttcactagaagcgtcaggctgcttgttgctaccggatttttgatgagcgtaaccttcttgaggcgttattggtgcgttcgatggaacctaatcgttccacattttccaacttaacgttaaaaaatttgacataagtcccaatttgacgtaagtcccaatttaacataatttgacataagtcccaatttgacgtaaggggtaccgaatgtcatcaaaggggcggcgcg

SEQ ID NO: 10372 - DNA, 712 bp, Oryza sativa
  unsure (1)..(712): unsure at all n locations
gtgttcttatgtgatactgtgttaattgatttcttcgtctacttatcttttgtcattttatttttgnaattatatcttttatctccncnccccccgtgggggccgccttgattgttatacgtacctcgnaccgcagaataccctaatgattttgggaaaaatcattaagttaaggtggatacacatcttgtcatatgatcaaatggtttcgcgaaaaatcaataatcagacaacaagatgtgcgaacttgatattttacacgactctctttaccaattctgccccgaattacacttaaaacgactcaacagtttaacgttggcttgccacgcattacttgactgtaaaactctcactcttaccgaacttggccgtaacctgccaaccaaagcgagaacaaaacataacattaaacgaatcgaccgattgttaggtaatcgtcaccttcacaaagagcgactcgctgtataccgttggcatgctagctttatctgttcgggcaatacgatgcccattgtacttgttgactggtctgatattcgtgagcaaaaacgacttatggtattgcgagcttcagtcgcactacacgggcggtctgttactctttatgagaaagcgttcccgctttcagagcaatgttcaaagaaagctcatgaccaatttttatgtcgaccttgggagcattctaccggggaacaccaaaccggttatt

SEQ ID NO: 10373 - DNA, 614 bp, Oryza sativa
  unsure (1)..(614): unsure at all n locations
ctagcaactaaactttacctgttgaaaattcgaacgcccaagcaacttgtttaatatctattcgaagcgaatgcagattgaagaaaccttccgagacttgaaaagtcctgcctacggactaggcatacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagctcggtacccgttttcatcgtccgtcaaaaaaaccgggcgaaaaaaatctgtccgatccaaaacaaaacggacgaaaaaaccggacaaaaaaccgggcgaaaaaaagaaaagagaaannnnnnnnnnnnnnnnnnnnnnnnnnnnnnnnnnnnnnnnnngatgatcacaaaaaaacngcgcgca

SEQ ID NO: 10374 - DNA, 695 bp, Oryza sativa
  unsure (1)..(695): unsure at all n locations
gtggcccaattgatgaatgctattcgaaccccggcgggacgacggcggccggcgctcggcgtcggcgcgcgccgcctgcgcgagcgcgtcggggttgacctcgatgacggcgtggaggagcgggttgaggcgcgcgatgcggtcgaggtacaagaggacgagccgcctggaggtgaggctgccgttcctgaagccgagctggatgtcgtcgacggtggcctcctcgatctggaacgctcggcagccggcggcggcggcgtggacgagcacgacggcggcgagaggaagcagcagctgcagacggcggcgagacatcctgtggactgtggtgagtgtcaattagcgtgggtgttgttggagcatcgctagttatgcacagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10375 - DNA, 725 bp, Oryza sativa
  unsure (1)..(725): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgaagtgttaattaatattagagatattacagatttgtaatcactgttcaaaatacattgaagaagtaacaagctcaaatttttggttttctttcattgtttagggggacaagtacaaagatgcaccaccaaatgggcttgatttgtttaaagagctccactgcagcaagaagaaagccttcgctcctgctgtacaatcagctattgtaagtaaattgtcaattagttcacaaacaaatgatagattaaattggtatgcattgatcagttagccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10376 - DNA, 1498 bp, Oryza sativa
  unsure (1)..(1498): unsure at all n locations
cttgtagactatcgagctcggtacccagtgtcaacgcctcgaatttacaaaaccagacttctaggcatagtgtgtataattctctatgtaaggaccaatcaaagtacacaaagaaaaagggtactcggcgagcttctcattttacgtggagcctaaattatttggctgacgtgcacgctgacgagccaggggcctacagctgtaaacaccaggccgtgcgcttacgatgcgctcgcctgggccgcccggacccccttgctgcgctgcgtcgatctcgtgcgccgccgccgcccatgcgtgccgcctctcccgcgccgcccatcggtcgccgtcgccggagaccgcgctaccgctgcgccatggctcagctaggccggctttgtgccgtgctgtgccccagccgcgccgcccctggccgcccgatcggcttgggccgatccggaccgtcggttcccgtggaccggcggtggaccgccttggtggtcccggtccacggtggaccggcgcccttgtgccgctgaccggtggggcccgcttgccggcgccgcccctcccctttgatgacgtcagcaaccctcttttcctttggaaaaataaatgataattgcgtcataattcgttaataattatagaaatccattaaaatggctcaaaacttctaaaatccatatctaattcattcgaactccaaattgagccattcaacttgcaaaattcatctaaaattgagctctacatgtttgtttacttttgatgtattgttttcttggtttttattagagtttttccttgttttgcgtgccagcatgtagttcccgtcgtttcggaagtccgcggtcgcgaggaaaaaagttcggaagatcaaagtgaagaagcaaggcaagtcacacaatcccattgagcatattgagcctattttataaatgttttaccgtttgcaaataagtatgcatgttttgctaattacatgggatccgggtattatctatctgctcgcttgtgccatgtttacttgatatttgtcctttgtcaaccgggggtaataaatcgactagctcatgttacttatgtaacctagctagaactatatgcttagccatgcttaattaccactagctcagttgatgggataattacagtattagacctttttagtatcagaatgagctgcgtgctcgagacacctggcaatgcttcatggtcgtaattatccaactaaaatgtgactgaatagtgggctgtgggtgcatggttttgctagtcgcacccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10377 - DNA, 1142 bp, Oryza sativa
  unsure (1)..(1142): unsure at all n locations
gagatggggntgntattgattgatttacnnnnnnnnnnnnnnnnnnnnnnnnnnnnnnnnnnnnnnnnnntacggctccatcttcacaggcgctcaactggagtataagccaggactccacctaagacatctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccaactcgtcccaagccaacccaggccaaccattccatattttagttgttgagcaaattttaagaattataacactgacctgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgagccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccaccacaaggggatcctctagagtcgaccttagtcagcgagctagagangtctcaannnnaacccccc

SEQ ID NO: 10378 - DNA, 6721 bp, Oryza sativa
  unsure (1)..(6721): unsure at all n locations
gaccccagtaatttgaccaagttagagcacctagcattaggtcataaccaattatcatcaacagtaccaccgagcttatttcatcttgataggctcatcctgctagatctatctcaaaatttcttcagtggtgaattgccagttgatataggcaatataaaacaaattaactacatggatatctatatgaaccgctttgtcggtagcctccctgattcaattggacatcttcagatgttaggatacctgaacttatctgtcaatgaattccatgattccattccagactctttcagtaacctatctggcttgcaaattttggatatatcccataacaacatttctggtaccatcccaaaatacctggccaattttaccagccttgctaacctaaatctgtcttttaataagcttgaaggtcagataccagaaggaggtgtcttctcaaacatcacgttgcaatccttggcagggaactcagggctatgtggtgttgtccgtttaggattttctccatgccaaacaacctctnnnnnnnnnnnnnnnnnnnnnnnnnnnnnnnnnnnnnnnnngggggtttcgttgacggtcgttattgattagtttcgaccgtcaatattgccaaaatagaggagaactagtgatgcttacaatgcataattacgttagaataataatattccactagtattaggtatactaacattttgcagagaatgacaataaagtgaaggagaatcgacatcaacacagatgataaatcaatcggacgatgtcgacaatcaaactaatgtatgaatgagcctagaactcagaattgacacgatgaattgggccaaaattcacaagtctacagagtggagcaatagaggaggccaccagccgaaattgggctggattgggccagccccaggttcggccgaacctgatggttcgtgcgaaccaatcctggcgccgttggatctaggttttggcgtggacgtccaggattgcatcccaatgacggttggagggcacttcagacaattccccttccacaaccgtcataactacctttatataaggagctcactctcttcacttcaacacacacctcaagcaatagcttagtttagtagtatctagctggtggaataggaatagagtagaaatcaggagtccggaaatcttcggaagagttcgggtatggctctagcagcttttctcttctcttttgtaagccttgtacttttattagaatattcttctaaatacatttatggtattgaaatactttccgagtatattagtacatactttacattatgttcttgttatactgaatatacggctagcttatctgggagatgctttggtgcgggtataatgtttgcttatgcaattactctatgtcatgacgatgatattagaattactcagtacgggtattcctccgcgcctatatgaaatcctaagttaatttcctggggagggtattcctccgtatttagccccgattgtatggtcatgatgggctgtcgtaaggaactcgacagtcaggggtggcttcttgaaataccaggagggcatcggaaagagggtattagctagtatatcagttaactaagatgtatgtatactatgtatattagaagtataggaatatattatcttccttttttctttccacttagcttagataatatattatgagaatgagtagttaatgcttgtgtgtcactctacccttggattatcttaaaccccgcttagaatatgattattacatgcaacatataaattattagtcaagtcctctctacatgatcttcccacgggataaaataaatacgatacgcttggaatactctcgggtaaatgctacaatggtatatccgtgcgcttgcggatgaactctgtaaccataatatacgagaagtatttctgcgccattgctgggaattatatttctagtaatgtcgttaagaaataccaacatacgtgcggaaacatccaaaacaatatcagatgcaacattgacaaataacctactgaaacatcaggaaatatttattgaaacatccaaataatatattgtgtaacactagaaatatgggtgccaaaaagaaaactaaagaagtcatcggaatataatcacgttggatcttgttataataatttcattgtaacgaatttaatggtgttatcggatcacggattggacaaaaagtttttaaaaaaccatttgaagctaatgttgctcttttacaaggtggtgctagaaaataattgggctaggatttgcgaacactacgaattgaacatttgatacttacaaaatatcataaggtgtttcatcatgtgtaagtaaatgttttggataaatatatttcgttgtttcatcacttgaaaaaaattgtttcatcgtttgttagaaaatgtttcgaggagatgtaacattgaaaaatcattttatagatcgacgtttcgatcgtgtcattttatttgttataattaaatcttcacaccaacatctcaaatgattatattttgattgaaatatatatatgtcttcatcattataattcaatgtttcaggtatgagaaacaaatgtttcagctcgaactcgacaatgttacacattttttatgtttttttatacaatggatgttttttagtgttgcacacgggatgtttcaaataagtattttatgatgtttcgttatttcatttgtgaatgttgcaccagatgtttcttgcatgtctcaacaaatacattgtaggtaacatttgtaaatttagtagtgaaacgttgaaaaatacatgttgaaacatctaaacaatactatctgtgacattaaataaaggtccgttgaaatagaaaatttaaattctgcaacaaagtgaaatcctaattggaacatttatttctcacatgtgaaacatataattttaatgattgaaacatatatatatatattttttcatcggaatataatcatgtgagatcttgttatagagatttaattgcaacgaatatcatggtgcaatcaaatcgtaaatcagataaatagtatggaagaaaatgttgtttgaaaatcaagtttgtagttgtttctttgcatgtgtatctatctacgtcatcaaatatatctatttacgtagacatgcagtgaagccacgtgtgtctgatgatagcctcttgcgtcggacgctcggcgcaaagcattttcccaggttacgttcgagagttcaaaaggttcgatcattggttcattctcgcaaccgtccaaaggtgcgttcgttcgttcattctcgcaaccgttcaaaggtgcgttcgttcgatggtgcggtggcctacccatccctttgcccaaccgaagcttaccctaggccagccgcggcggagcaaacggagaggcgcactactacagaaacggattttctgtacgaggggggggggttggttccatgcgggtgagttgtgtcggcgcctggaaaaatcgccccccccccccccgggggggcgggttgaccagccgcaaaaataggcccattatcgcatgccgctagcctaagcagccgcatgcgataatggatcttcgcatgcggctggcttaaggagccgcatgcgatgattggccatatatgctcatccaggccgcgagcttgaccatttgaaaacgaagctttctctctcctaaagcaatctataattagggggggaggttttcaagtcaaaatttttgcttgaactctatacgaaaggggaaaaactctctcttctccatttggctccatttttgttatatttcgttggttgaatgtggagtttttttaatattttgacaaggtttgttctagctagttttttgcaaaatctagcttcaaaatatatgttttgatgggcaaattttgcatgtaatcacttgtacatactagttacatgtattgttgtaatttttttggagggacaaatgcatttaaacttttgtataaaatatctgctgtctattttttttatctgtaacttttttgtctttatataaatagatggatcggtcatcatggatgtatgagatgcggagaacgcagctgatatttattaaggcagcatctaaatttattgatcagtctaaggcgcatgctttgagggagaatatgacaaagatcttttgtccgtgccgtcattgcaagaatcataaattgttagtagatcctggtgaaatattaggtcacataatggagtacggattcaccgccaactacaaggtttggacctatcacggggaattcgccgatcccgaagatgacgatgaagagttaagtttcgagatgaatgaggcggagaattttataatcgaagacatgtcccgtgaaagaatgggtgtagatgtttccaccgatagtgatgatttcgagggtggttttgatttagaggatatgctacgccttggtgaaccagaggtggtagcgggcaggtcacgaggattggagaattggcaggcattagagaaggcattgaaggatcttctttacgatgaaacgaaggaatgtgataaggatttcacagtcttgcgttcagtgcttgaacttctgagattgaaggctaaacatggatggtcggacacaagttttaatgatctgatgagtttgttgcgtgtgtttcttcctaagcctaactttgtaccatcaaacacgtatcaaacgaagaaactcatatgtcctttatctcttggtgtagaaaagattcatgcttgtaaaaatcattgcatattataccataaagaatatgcagacttggaaagttgcccaacatgtggcacaagtcggtataaaacgggaaatgggcccgtagatacagagtgtaccgatccagattctgataagggtaagcgtagaaagattccctcaatggtgatgtggtacctaccaatcaaggaccgcctaaagcgtctgtactcaaacccgattggtgctgagttgatgagatgccgaaagacagatggtatgatttgacatcccgccgatgctcgccagtggaagacatttgatgcaaaacacccagaatttgctaaggatccctggaatgtaaggtttgcattgagcactgacggaatgaacccgtttggtgacttaagcagctcacacagcacatggccagtccttctcacaatgtataatcttccaacatggatatgtcagaaacgaaagtacatttttctcactatcctcatacaaggtccaaaccaacctagaatcgacatagatgttttccttgagcctttgatagaggacatggaggagctttggaaagaggggttacgactatgggatgagtttaagagggagcacttcaatctatgtgtgatcatattcgttaccatcaatgacctacctgcaaacttttcattatctgggcagattaaagggaagactggatgtctgatatgtttggagaaaacttcgtacaaatacctaacgtcgtctttgaagacagtgtacatgcgacatcgacggttcctaccacaaagacacaggtaccgtaagatggccagattgttcgataatacagtggagaatgacactgccccagaagcacgaagtggtacatacgtgtatgagataacaaagaagattaaggttgtatatggcaagggaaagaagaagacagtaaagatgaagaaagctgatggtgacaaagatactgcgttgcctttcaagaagcactcaattttcttcagatacttagattactggaaggacctagagattcgacatgcaattgatgttatgcacctcgagaagaacgtgtttgatagcaccattggcacattgctggacatcccgagtaagacgaaggatggattgaagtcacgtaacgaccttgtagatttggccatacgacatgaccttcacccagtagtgctgccaaatggaaagaccgagattcctcctgcttgttacccgttgacatttgaagagaaaaaagccttctgtaaatgtttacaaggggttagagtgcctactggtttctcatcgaacatcaggaagctagtatcaatgaaggatttgaccatttccggatacaatgcgcatgacttccataggttgctaacggtattactaccaattgctataagggcagttaaaccagtctataccaaggtggttataacaaagttgtgctactttttcaattgaatttcgcagaaggtatttgatcctctggaattaggtccccttcagacatttggtgtcgagaccgtatgccaacttgagatgtatttcccagcatcatatttagatttgatggagcatttgatcgttcacatcgtccctcagattattgaacttggtcccttatacttacatcagatgtgggcctatgagcgttacatgtcgatcctcaaaggctatgtatgcaatcgcgctcaccctgaaggatcaatgatagagggatacacaactgaagaggcggtcgagtgttgtatggattacataaaggatgctaatgccattgggattcctgttcatcgacacgaagggagattgtctggaaggggtactgttggtaggaagcagttcttcgataatgattacaaaaaggtgtccacggcacacaacagcattcttcaacagctcgctatcgttgagccattcattgagcgacaccttgaagaaatcaaagcctgcttcacagggcgagggtgcgagcaagcaatcaatctaaccccagta

SEQ ID NO: 10379 - DNA, 1431 bp, Oryza sativa
  unsure (1)..(1431): unsure at all n locations
aatgagtagacgacnnnnnnnnnnnnnnnnnnnnnnnnnnnnnnnnnnnnnnnnnncggcatcaacaacatcgaagacccctatgattacaaccagttcgacgatgtaccattgtttactgatcttcctatgtgaattaagaatgttgagagaacaatcgatgaagcgaatatgtcgtacgttcgagcagatggtgttgccaaggttattaagtcatagttattttgtaacctttagttgtcattgtgttccaaatgtatccggatgaatttaagtgccccttatgttgtgctcattagcatgtaacatttggtaatgagttttcttactgccaaaattatatggaatttttgttgtaccaaaatattaaaaaatatatatatgtacagtttatttagatgaaagaaaaaaatgagtttatttggtaaaaagatctttccatgcgggcgacttaagccggccgcatggaaagatcattttcgttgcggccggcttaacggcccgcatgaaaagatcttttttgcatgcggctgacttaagtcgcccgcatggaaagatcatttttccgtgtggccacttaagccgcccgtatgcgatgatctgcgcctatatatagggagcgcggggagccaaaattttctaagtcccggcgcccacgaacccaagcacgccaggctgccaaaatttcccccctcgccgggtcgccgccaccaagtcctccccgctacagccggctcctcctcaagacctccctttcgccgtcaagtcctccgccggctcctccccgaagtagtctccctcgccgtcactgccgccaggacctctcccccctcgccgtcgccgccgcgcgcgaagtcctccccgccaccgccggctcctccccgaagtcgtccccctcgccgtcgccgtcgcgcgaagtcctccccgccaccgctggctcctccctgaagtcgtccccctcgccgtcgccgtcgccgccgccaggacctctccccctcgccgcgtcgccgccgccaagtcctccccgccaccaccggctcctccccaagtcctcccggcccctcgccgccaaggccgtgccggctcctccccgaagtcctacccctctctgccaccgccgtcgccgccggcaatacctccccgccaccgccgcgccggctcctcgggtcccaagtcccccggtaacatttcctttaaaaaaatgtgaaatgtgcaattgtggattgtggattgtgaaatgtgcaattgtggattgtggatagtttaattttgagaatgtttaattgtggattgtggatagttaaattgggacttatgttacattgggtctgatgtcaatctcggaattatgttaaattgtgacttgtnnnnnnnnnnnnnnnnnnnnnnnnnnnnnnnnnnnnnnnnnnngtcatcaaaannnangcacac

SEQ ID NO: 10380 - DNA, 607 bp, Oryza sativa
  unsure (1)..(607): unsure at all n locations
ggagcgccntttgttgttgacattcgttctcggtaccctatctaattggattataaattaatagatatattttagattttagaacagacaaaatatataacacgaacatgagagaaaaaaccacagtgactctacacatttgtgcaacgctcagctacatcatggaccatagcgttgtcgaacgtcctaatcacatgaggcgccacctgcagcagtttttggaaccttcttacgggtgcttcaaacaataatctacacggacctcacgtaagataacaatcacagtcaaatggggctacccgaggagtactggtttatccgattcactagttcttacggcatattttggaaactactactgcctcagtaaacgtagaacatatttactattagtaacgttgttcaaacatcatggtaaataaatcaacttcgtcatatattttagtaaattttacgaaaccaagttttgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10381 - DNA, 608 bp, Oryza sativa
  unsure (1)..(608): unsure at all n locations
tggcgctcctnattgttgacattcgagctcggtacccatttttcttatatcctataccaatgtatataatttcgtgaaaattctggtaaatacatacctcactgtgtcgagaagttgctggtaaacaatctgctgcactgtcccacttgggaagttgaaaaatccatttgggatgcctattctcttgccttttaatccatcaggtttcaaaaactgcacatatccaccaggtgggatatacttggatgctgcccttgtggctttcgcatcacggctgtcataactgacaatagcatctagtacttggactgcatctgctactgtccgacaaattggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10382 - DNA, 1362 bp, Oryza sativa
  unsure (1)..(1362): unsure at all n locations
cccccccctccaacaaagaggccttatatggcccaaagagggcccccggggggttgaaaagagaccctctgggggttgtttaacaaaaaaaaagagagccctctttggtgttttgggacccaagagataaacacccttttgggaaaaaacacgtttgtggctcaaggcccccaacattggaaaaagacctgttaaacacccatttttcacaaaccccctacgggaaagggggtgccttaataccaaattttccaatgaaaaaatttttcaccctttaaatcacgagaactttttcccggaaacctccaagcaagttaggaaatctgcaaagtctgttgcaagatttcttggcaattaaaaccactttaaccgtgtacttccaactaatgatttggaattaatctggaatccaggtgttagttccgggggaaaccactgcaatgttaatatcccagatcatccatgatgatgaggaatctggtatcctttacttgaagacaaatacttgtctggctccatcccattaacanctggcatgttaaataatatgaatttatatacattggaaccacaaagttctctggcttacaattggaccccagtaatttgaccaagttagagcacctagcattaggtcataaccaattatcatcaacagtaccaccgagcttatttcatcttgataggctcatcctgctagatctatctcaaaatttcttcagtggtgaattgccagttgatataggcaatataaaacaaattaactacatggatatctatatgaaccgctttgtcggtagcctccctgattcaattggacatcttcagatgttaggatacctgaacttatctgtcaatgaattccatgattccattccagactctttcagtaacctatctggcttgcaaattttggatatatcccataacaacatttctggtaccatcccaaaatacctggccaattttaccagccttgctaacctaaatctgtcttttaataagcttgaaggtcagataccagaaggaggtgtcttctcaaacatcacgttgcaatccttggcagggaactcagggctatgtggtgttgtccgtttaggattttctccatgccaaacaacctctcccaaaagaaatcgacacatactaaagtatattttactcccgggtataatcatagtagttgcagcggtaacttgttgcctatatggaataattagaaagaaagttaagcatcaaaatatttcttctggtatgcttgacatgatcagccaccaattactctcctaccatgagcttgttcgcgctaccgataatttcagtgaagacaagggtaccgagctcgaatngcaaatcaacacg

SEQ ID NO: 10383 - DNA, 1244 bp, Oryza sativa
  unsure (1)..(1244): unsure at all n locations
gtgggnnnattgttgattagacattccagctcggtacccattaacctcgcttaaagcctgaattgggatttcagcttgagtgtcagcagcgagaacctcacttgtagcctgaattgggatctcagcttgagtatcagcaacaagaacctcacgtgtagcaagaacatctggtgccacatgctttttagacctcgtcactttaccaggttgcaatggtgcaacaactcttttgccccctatggcgtgatgagtcacagaggttacattctcagtattcttcttggatttcttggtagcaggctgcaataaatgaaataaatgaatatgtaaagtaatctagaactagtgaattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttacgggtggttcccgtattttatttatgcagaagaatttttcgctttctttttgggaaaagacgagtcttttttataaaaccatttttggcggggttggataatcttctctgggtctggccctttgaaacagttatggcgaacttataaggaaatcccccccccacactgtgttcccggcttgaaaagaggaaaaattatggagtttgttgggcccccccggtttgccgaaaatagaggtgggggggggcgtgtccacccccgagtttc

SEQ ID NO: 10384 - DNA, 1824 bp, Oryza sativa
  unsure (1)..(1824): unsure at all n locations
tggttattgaacttctnnnnnnnnnnnnnnnnnnnnnnnnnnnnnnnnnnnnnnnnnnnnnnnnnnnnnnnnnnnnnnnnnnnnttaaattaaacaatttcttcgaatgatttattttatgaatttagagtaagggaggggtacttcagggcgtgacacttgctggccttggaactcttcaaattcttctcctgcgaaaacggactctccggaaacgtcggaatctaaacagaaaggagcaaaacaccaaaacagcacattaacaagcatgaacagtacatgtagatatttttaacatgtagatctcaattttagaaaaatttagagacttgaaccaactaaatccgagctaagatgaattagttatgaattttcaaagattaaatcggtttaaaacacttatatagattttaattgaattatgacgcaataatgaattatttttgaaaaggaaaagggaattattgcgtcattggctagggttcgcggtgaaccgggtgcacggcggcggttcacaagattgggcggccgagatcgatcctaactacaacggacggccaagatcgatcggatccaccgcggctcacggatggacgacgacgatgacgtcagcgacgacgtcaccaccggcggcatctcgggcgcgcatgctcgccggcgaattacggcgcggcggagcaaacggatgacacctacgcgtagcgggcgacgcggcgaactcaccggtgaccaaaacgacggcggacgatgaccggacgatgtcggcgacgaggaaaaggcggcggcactcttcggcttgacgacggcgacggtgctccggtggttgacagcgacggtgaaggggcggacgaggacggcgacgcgacggcgaccacgatggcgacctccccgagcgacggcgacgactggagcgacagcggcgcacggctggagcggcggcgacgacggcggcgcgaggtctcacggggctagggcgctacggacgactagagacgaaggcaagggtggcgacgggtagcggtaggcttgggggtccttatataggggttggaaggcggcggcgaaggctcacggcgaccggtgacgcgaaggaaagtctagggttcggaggagagagatcgatccgaatcgaactcgaatccacggatttccaaacaaaattagccgacgattccataagagaaaagatagaagggatcccggggatcatttcccctctattaatttcaccggaaacggaaaggggcggctggatttggaaggagacgacggcggcacggcgctagggttcgggcggcggccggccggaggtagacgacaggcctgacaggtgggccccacctgtcaaccgcagcgagcgcacgcgtggctcggcttgacttgggccgacttgggccgaggaggagagagagagagggttttgggccgactttcggcccaaagccaaagagacttttaaaaaacctttttcaatttaaattattcatgaaatgcaattctatttattaaaaatacttccttggctcaaataaatcccagaaaactctaggaactatagaatcaagcaaagttttaataaaattttatctggccccattttatattggatttaataaattattagggaaccttctctcctaggtttttaaattaaatctaaatatttccatttaacacaccaattctatatattggggattttaaggtgtgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10385 - DNA, 8948 bp, Oryza sativa
  unsure (1)..(8948): unsure at all n locations
gtgggattgacatcgaatgccagtctctcnnnnnnnnnnnnnnnnnnnnnnnnnnnnnnnnnnnnnnnnnnnnnnnnnnnnnnnnnnnnttttgaagcagggcgagactactttagctaggagcctcttttccttctgcccagctccccgaaaacaannnnnnnnnnnnnnnnnnnnnnnnnnnnnnnnnnnnnnnnnnnnnnnnnnnnnnnnnnnnagattttgactatgattgggccgaacagtggtagaacctggtgaaccgggcctactactaaacattgattctctctcctaaccactcttaaatatgttaaatacactccatcgatcaaaaactacaagcaagggaatcagctcttattgccgtaaaggaaaaataacccctttcctttatatatagtccgccaagggccttcgccacctattccttaattacgtagtgggaaaatttctctatgtcaattcaaaacaaaacaaacggacgactgaatctaaagtctactagagagaagattggttcgaacgtcaactactgattgctctatccaaccagcacataccgtttgctatgatattgttttgcggatttgctcatattgttttcttgcccgggcattgctgcggaagagtgaaatgaaaaactcttcttgaagaagaggactcttccgcttgatcttttgatacgatgagggaacaggttttatgcgttctttgagcaaatggggaaacaaactgttgatacagaaatctttaactgaactgccgaaggcacaagagagactatagccaggaaggataagcaaaggaatccagattcaatcgattgtttgaagccaaggagcaagaaaacggatgcgcgtgctaacgcttttgcgctagtgcgctcaatccgttgcttgttctcgagctagtccatctttctatacgaatttcttgaaagaatacttctcttatgatctactacgatagtgtcaagcggaggtggagagcacaagaaaacagaaattgctacgttaagcaagtcacttcttcggctgggcatcaacagacaatcaagcaatattggattcaggacgccatatcggaatcaggaaatagccacttaagtcaatagccactttagtcagtccatcagtctttccatattatatttccagtcaagtcagtcaacacttctacaatccagtctcttaacactagctttacttgggaaagtagtgaaagtcctgctgctggataaagatactggaaaaagtctcaagttccactaggcgagatgaaaaagttcagaactgggatgccaaaaagagccgatttacaagcaaaatgaaaaaactaccaaattgccccatgctggctatcaagttttcaaaaatggagtagattttggagccatttacgagggagaagcaattttctttacttttgcacatggttgggacaaatgcttttcaaaaatgacccttgaaaatgccactttccctaaggaatgcaaaatagtaacttttcctactaggtcagatagaatggtgtttttctatactaaaatgagtcaaattccgataaaaaagcgaaaaaagttcttctcacctagtgcaccttggtactttcctgttccgcccttagaaaccgggtaagtaatctcatatgtttgaactgagagagcttcattttccaatagtgccaggacctgtgttccatatccattatcttttcattgtccttcttgtcgaatagaaagcaaatagatgttctgcgataaagcgtatgtcctgtatttctgcctttcattcatcttaccatacttcttatttcctctgactgtaacctgaaccagccagagttcaaattccgatcggaaaagtgaaacatatcttccttagtgaagtagagcgtttcaaaaattccgtgcatcgccggctctcaccagtcccgataatttctataatacatagtagataatttgtggtggtagtttgttcaataataactgcccgaaacgtttgtgttggtgtcaatttgtcatggtctcatggagaatgaatcggtttggactctaacacgcgtgtttttcagcgttaatcaagtcctaacgttttacgatttatcttgtaccaagttcgtagcaaacggatcagcgttttacacggagaagtattacgcacgtcgtccgcgtgacagcgtgatagctcagggtaccttaacttggaaggcctgcaaagatgatcgacaatttcgaggagaattgacaaacgaactagtgacctcatcttgagctgttatctcaagttctcaacgcatgaaaattttgttggaacgaattcaatgcgtggtttatgctggtaaactgaaattgaaggctatcatcaagtcgcagaacggcctgtcagttactaacaacaacagggcatgttttcagcttcagccacagatcattggaatttctcatagacagaatagcattactcactctggacgtttcaatttctattgcagctcgaaacggatgggaagaacaaccattgccaacctttgctttcctgctttttgtagccaacatgacgaatagctactgcaaaacaaacggatggcctgccatttaagaaccagggcgttattgaccagacaaagtttgtcattgtaatatttctgatttggtggaccatcaaagtgtccctacagcattagctatgagtagcattacaattgcaatggaaggttatctagcttattgcctttttcttactacagaaaagggactacatcagtgtgcttaatggagcacttgacatcaacttgaactctgaagtggtgtccaaatggatacctcctacataattcattccatattaactcaaaagaattattcaggtaggctggactcatcacttatcaatatacactactcgtctactccctctgtttaatattataagtcgttttgatttttttaaaaaaattaactaagttaagaagttttactaggtttatagaaaaatacagtaacatttataacattaaattagttttattaaatctaccattaaatatattttaatagcttctttgttttatgttgaaaaattattatattttttttataaaatttggccaaagctaaataaggttgacttaaaaaaaaagtcaaaacggcttatagtatgaaacgaatgttgtatatatcaatgtatctggtgtcgggtgccccatatccaatcaaacataaataagagagatctctgaatgacaacatacggagatacggacaagcccttatctgacaatgatgcaaagcggcatagacaactgcctgatctgaagacatcactagagagaagacaagttcactgaaatgcatcaatgcgagaagtttcagagaggtgaacaatgccactactgttggtgtcattatcatgcaacataagcaagtgagactggacttcactgttgcgtgcacacaagggacattacacaaatgcatatctataaaaaaaaagaaatgcagattatgcagccctacgtaattaaactatctaaaagcaagtagaaagtatgtgtttatgatctgtcattaactcttcctttaatctagccttgctagttgggtgagattaggggagcagaacatagaggcgacaaggagtgtttcactgacatgcagggcctggagcatgaagccgacaggtttagaccacattttagttatagtttagttgctggccagcgaagattagctagatggaaagcaaagacttagcgtgcatgctctgcagtgtgttcctttcagtgtcagaaaagggtcggcgtgttgatcagttgcagttgcagaaggcagataggcagatgcctcgctcttcgcgtcttcgttcggtcggtggaatgtgcaagttaagctaaggatggcgatgggtgaaccatcacgtaacaagacatcaactactagcttctttgcaagttgcagctaatggtgagtatcaagcttcgtcctggcaacatgtggtgtagctcaagtggtcaagccttcttgtgtccgctcatggcaagaatccgttgtgccagtgctgtttgctgaactgaagctgcatggttcaggttcaggttctctctatccaaaactccaaatctgtgagcttcttatcagcaaaagcaggcgtacgatactcagatcagagtctcacagaatgactagctagatctggatcttgggacctcattaattgtttagagattcttgctcatctgtaaagctgctcagggatgggcaagttggccacgcccttacctcttccaagttaaacgacatactactactgctagtacagtactctctccgtcccaaaatgtaactatttctagcacagtgtcttatctcaaaatgaagctatttcttcacctacctcctcctctcaaccaatcacaactattcttcttcacctactttctcttttcaactaatcacacacttcctccaatcattctcacatactttcttaatacccgtgccaacctcaaaaatagctttattttgggacggaggaagtatgtgattatgtccactccatactgaaaagtggcttgagcctctgaatgattttgttcttgctacatgacctggttgttcatacagagtttacatactgcccttgtgttttcactgatcttccagtgcgagagagagaatgaacaaatccttcctacttgtatcagctagaaattcatttcgtatcaaaccttcccacattaggattctttgtatcagctagaaattcatttcgtatcaaaccttcccacattaggattccttgttaatagttgattccgatctaatttcgtattaagctttatcgattccgacctaatttgaactttcgcgaaggtataaccaagagaaattgattaggtccaggttctcctaactttgtcttgatttttttccaactctgtattaactaaatttcaagtttgaacaaaacgtagaacggcccgggtttatgcaacatgttatacagctgaagacacaagaagcaggggttaatgtctagcaaagttccttaaagagagattcaaaaaagtgcacatcgctcagtataacaagggcaaaactgaaaagcaaagatcgccaaaaactgttttctctatatctttagctcatccttggagacatggaatacatgcagaacaaaacaaattcgacaggagctggtatcaggctatcagctagtagagatggcattcaactactgaaaggaacacatcaaaaaattcggttcccttttctctcacttctacacattccacttatttccttgctcaatataatcttaaacaccagcattatcggggttagaacaccctcgcaaccaattgtgtaaaacagtgtaatgcttccagcttaattgatcacataaatcaggtaataagataaattgagcaaataaaattgaccttcttcctttgggtggtggctattgagaaaattgccaaaaaccctcggtcaaccgaatccaaaggttattgcatgcaaaaaagttgaatctcatccgacttcgtggctgtccaaatgacaggcactttttctctggatggaattacatggtgcgctctctgatgactatattttgtggctgatcagaataatgtcagccatatttgttccaaatcagacagcagttgctctttcacaagctttgtagtaaagtgtcttctgcacatagaagagcatgtatgcctgagaggttctgacagtatgctcttcaactctggttacccaggcatcatcacatttgtaccagtgattgtttaacctgagatatgtcacataatggccagcttctagcttaccactatgcatgatcaccgcaaatatttcaaattctgatgaaaattcagaaactgaatctgcatcactagcttctgatggaaatatacggttcccaaatctgcttctgagtatagaggacgatagatatggcgccatgtcaagagaaaaaggaaactgtaaacagtgatcaaccttccttgacattttcttaactgatgaatgctcaaacctcttaatatgaaagcatgaaaccaatggaagcctccgaatggacatttgcttcagggactcttgcctctccttgcaacgttcacagaagaacttctgttcagcatccaaccgctcagcccttgtaaaccgctccaaacatctcatgagtgttgataccttggtattagtgccacctgagcttcgctctccattccgcacatgtacctttgggtttgcaacaccaagagaattgttatatccagcatccaagtctagagagatgtccatacagggttcaaaagttgttgatgtgaacccacaatgtgtgcaggtgacatctgatctcaagatgccagaaaataccctgtgtgcaatgcaacaatctccatggcctattagggaaaaaaatacacataatggttagatctataacagctcatctgcctcaatataaatcatagttcagcctatcaaaagcaagatagaatatgttctccactacaacaaaaaagagaaaaaacacatttgtccaatttgttccccaatatccaaatagtacaggactaccattttccacgacttatcctgttttcgtttttagggtgtagaacctactgtagagtcatcctccaaagaagagtaggagtgacaaataataaaaatagtacaaaagcagccacaaatgttcactatgcaccacactaccagcaacagatggatttagatatgctttttgcttcaaccaaaaataaaaataaaaataaaaataaaactggtattgattcattcttggctcaagggtgcactgttttcacaataaaagggtggatagagtcatcctccaaagaagagtaggagtgacaaataataaaaatagtacaaaagcagccacaaatgttcactatgcaccacactaccagcaacagatggatttagatatgctttttgcttcaaccaaaaataaaaataaaaataaaactggtattgattcattcttggctcaagggtgcactgttttcacaataaaagggtggatattcttcttttcttttcacatatcagttcagttgaatagatggaaaagctttaatttaaatagtagcaggagagaagctaactaccttgggcaagtgatttgtgttgatcatcctttatattttcatggatatggtcaaggatggagataaaaaattcatgtgcatcctgttgctcgtagctcgcaagatttgatgcatgctgccaccagctaacaaacataacgacaataatcagaagaaaaacaatcactttaattcatgaaccagaataaagtagtatgccatgttactgtgcaagtccaagttcgtcaaaccagatcagccgcaaaaaaagacttcacatatttaaatttcacatagatataaactaaagtttaaaaatattacttcggctttttttagaacaccattactttggcttgataattaccctttgtgtcacataatgtcacactatgatcacaacagtttgctgaatacccatagggcataaacaagaatattacgatgaacgaattgtaaaaacatatcctggtaaagtatcagcagtgctagcaataacttatgtacctgccacatacttgtacactatccttcgcagcagcaagatatgatgtcattgcagaaaattttaacttaaattatgcaattcactcatatgacttggcccatatccaatgatagagcaaatagcttcaaatgcacctgataagaaggtgctctgaagaattaaaaactggtcatgcattttggagtacttgtacttgatacatgaacatagctcaacaaattctaagcatgcgaaatgtacttaagaccatatgacattttatcaatcaggtcatgtgcatccaaacgtgaaaccgttaccctttctagcgaaacatatggaacagatctcgcccttttagtagcatatcttgctcacatcatcccatttcatgctaactgataagtagttccaaattgcaacctacataatcatgatctacgtcaaacagtttcaaggcatagcgtacaaacaacactatcatttgcaagagactgatacaattcgatcccaaactagttacaatacatgacgcacccatttcatataacggattcatcttaataactttccaagtacgcaacgaacccaacattaaaaaagcagcacgttgctcaaaaaacacccaacgacatcaacccaatgcaaacagagcgctagatccagacctatagaggaatttggcggggctgtagggcgtgcgctccccggaaaaggcggcggagtagatctcgtcgagatcgcacgccaggcacgccgccttgtcgtttgcctcggcggaacggcgcctcatgggcgtctggcgcgggcagaggtagcggttgtgccgatcgccgaggaagtagttccggagcggcggcgcgtgtagcagagcctggagcacggagttcatgaagcacgtgttgcctaggttgttgagcccgcggagccccgcgggcgcggcggcggatgcggaggtggtgggatcggcggagctgatgagcgcgaattcggccggatctggtgcccaggcgcggtactcgacgcggcggcgcttgcggggcgcggcgggggaaggggagggggaggcggatgccgatgggcagggagggaggaggactgggcgaggacgacggcgtggtcgaagtccggatcgtagacctgatccccgcacgccccgcagaagagctcggcgcggtcgacgtcgacggcgatctggtggccgccggatgtggaggcggaggcgtgggaggcggcgtgggtggggcagaagacggcggcgcaggagaggcaggcgtaggggtaccgagctcgaattcggcgatatagtcattgatttcacaccccg

SEQ ID NO: 10386 - DNA, 5244 bp, Oryza sativa
  unsure (1)..(5244): unsure at all n locations
agcgcttgatttgacnnnnnnnnnnnnnnnnnnnnnnnnnnnnnnnnnnnnnnnnnnnnnnnnnnnnnnnnnnnnnnnnnnnnnnnnnagtggcatatgtaaggtaaaaaagactctgcatcagcatttggccatttgctttgacgagttaccgtagctgggctctttgggggaaaggtaaatcacgcaaaacattttagcactatgccacgctagccgtatgaatgaatcgattttcacatcaaattcaggtcactctgaatctgcaagcatgaaattggccggtggcatacagcctgaacgtctacgctacaaactaacagaccaattgtactggtttgcagtcggtaagtcagcagagaataaacctacaatatatatcacgacagggtaattaaatacacttcatatcattagatgatttgaacttaaaattttttactattcttctaatatattttttgcgcgttcgaaaaaaaaatctttacaaaacgaaaagggggaggcggcggcggggtggatgtggggatgatggagtggcattgtggcagctagtgatgccgcgtgttgaattgttgatggatggcatttgggtcatggaatgatggaactgtgggctggtggatcgctctggactagcgctgtcaaaaaaaaaaaaaaaaaaaaaaaaaaaaaaaaaactcgaggctcacgagctgcttaggcttgacttatccttggctcgattcgagcttaagcccgagctcgagctgagctcgagcttacaacgagtctagtaatatattttttttgttatttaataaattatgagatcgaagatgttatttgtatatcttgtattggtatcatatatttatttttttttctcttctattaatatgatatgatgaactagaaattaattattttttatagattatccttgaaatatgcattgctctactaaaaaatcaagctcgagagcctaggcaggtgagctcgattgacttcggctcgctgacaaccctaatttggacttcaggtgcaccaccgtgcacactagatcgggatgatctactctttttttttttattacttcatcccagaaacagcggcagagaaaaaagaaaaagaaattgagcccggacaaatttcaatataactagtatttgctataaaaattttacaatcaatttactcatcaatattaaatattaaaatttagtggagtttttatcggtgagcccgggctagccggcggtggctctgccactgcctagaaatgtttttattttgacccactatatatgcatcaatacaaaactaaaaagactaatagtcttcactttagcaaactcaaatacatttgtcatcactttaagaaagtaccaatttatgtgtcccttgctttagtaaatccctatacatttttccccgttttagcatagtctaatatattaattgatcgtacctatcgataacgagacacccgtgacaactttattaattttaagatataccgacctaaccttttgaaggtgtgcgtgtgtatttataggtgtaagtgagcttgcgttgtgaacgcctgcatgagtattgcgtttcttgaaggaaaaatacagagaatgtaagataaatgtgataaggaaaaatgaagtcgttttttagacagagagagtactactcctatgagagagaataaacttaattatttttgagttagcgtgaatattacacaagttattgaagaaacacgagcctgaaagacaaattatgaagacaccaactctatatttcttcaaaagaacaaacaaatttgctgtatcgcgtgtatccaattctccatttctttcttacacctttgtaagttagttgaagtacctttctaaaaaaagtcaattgaagtgttgagccaaaaattcccgttggtccctgaataggtttaggtccagaaatccaaaggatgaaaacaagttatgtttgagagcatttttacggtcctgcaatttatacctcctggtactggtacctgtaggtaccaaaacaaatcgaacagtacaattccggaggggtacaatcgggaggaaaaataacagagtaggtggcgcataggaggagccgtcggggatggtggaggcaacgccgcaacgaaggaggaggaggaggtggcgacggcggagtaggtgtcaccggtgaaggaggcgacagctgcggcggcggcaaagcggcgctagcaaagcaagaggtggtagcagggcggcgaggtggcgaggcgacggaggcggaggaggtggtgacgaaggagatgcggcacaacggctgtgaaggagatggcgcacgcctccagctctatcgttccggtcgtaactcgctcatccatccgtacgtaaaattacattcttgcccctctacctctatttatcgcgaagtaccaattcaggagcagaagtggtacatagcggtacctaactctgttagtcgttggatctggctcgatccaacgaccatgatttggtacctagcggtaccgttggatggtaaaaatcctcatgacaagtgaacattcatgttcactcttcctacttgtctgaaactctagatgccaaaaattcaccaactaaaggcctgtttggcacagctccagctctagctccacctctcctggagctggagctcagccaaacagtttcagctccaccaaaactgggagtggagttgggtggagctctctcacaaaatgaactagagttgtggagctgggtttagacagctccacaactccactccagacccaactcctgaagctaaatttaggagttagagctataccaaacaggccttaaatgtttcacttcacaccacgaaatgacaccccttaagaagaagtgacgagcttctggttagcattgtactgaaacaaacctgtgaactgctttaacaagcaagatcagagatctgacgagatcgctcactgtcacagttactgtacatggcttacttcggcggattaacataagccagtatgccaaaaacggtttgcacaattgtgcagatgaggacaatgacagtcgcactcgcagccaaagccagccatggattgctgaagtggtttagccagagccatgccatccaccgattgatgagactttgatagtgagcttccatagtctggcacagagttttaagtagtagttaccattgaaatcaaaaaccacgtctttgctgagcatggtgaagagatcagacaccctttcatcgctatcaagctggtgcacaatgatttttctctgaataagcagcgtaacgtcctctggcatgcttataagttgagacaagaaaacaatataagcagtgaagtcatctccaaattgagggcaggtttgttcaaacgcaataaggttcctgaaaagactccctgtgtactcatcaacaacaatacacggaatgtccatggaaccattgctaaaccaaatgtctagcagagaatggggttttaatttatcatattcccgtttcttaaactttattccggcttctagatattgtgcagctcgtcgccaacgattaagctgatcccctccttgtgccagatccacttcgttctggaatgatgaatcatgtctattgttttctaggtagtagttgattctgaaatacttccgtccaaaactgaggaaactgtgaatgtactgaggcacaaatttatagttgtgatcttcctccagcttctgactcggttggaagtaaatatgacacaggtgaagcaaatggtgaaagtctttcggtctgtcagaatcagtaattgcttttggataccaacgcaaagcagcctcgacatacttagcaaggtcatctgtcaaacattgtgatgaagcacaattatctgtaacaagttcaaatattgttttcacaataaaaaatggtatctgattttccagcaataataaatcgtgattgacaaacctcacaaaccaatgtccgccctttctgcaatcttgtttatatcctgcgccctcttcttcccccacttggacgctctctcgacatgcctcatcatcctcacccttaggacgctctggctgttccccgcaaacagcccttgcgttttcaatatcttcgctctcattatatacttgtcaattttgcatgaatctctgcacacccccgagagaacacagaatgaagcatccatcaagtaagagcatatgcagaaaggcctcgttatccatcttggtatcttcagaataacagctccttgcacgttttgataaccccaaccgctgttaagtaatccagcaaattcctcttacagttcagtttaacgattacatccacatagccccattttactttctccatactttgcagatctgcagatccatgatggtatggaccaactgatacaatacagggctcgtatgaaaatctgtcaatgtcacgaatatgttgctgaaccttgtaaattaagcatgattctgttccattatcaatatcagtgcccagtgaccaataataatcaagttcttgcgtcatggagttaaccagttcactcatgtttatttgcttgtttttacttctctgaacttgccgcatcctcacctgttgaggtatctttcatggttaaactgatcagcaatactaaacatttactatcgaactcctaagatgtgaaaaggccaattatacagagggaatattatatagttgaatatccggcataaaaataataaagcataatgagcaacttttcatcaaagattgcaataattcaacaatagcacattgattcatcctgagtgcacctaatatctggccagggaaaaaaaagttggaaccaaacttagtaatggtaagggctatgaaaaagtttgtcatatccaatatttaccacacaaatatatggatcacaatttacacatactccatccgtctcatactataagtagttttgattttttttttctagtcaaacttgttttcagaataacataggagtattttcaacacaaaacaaacatattatcagaatatattcaatactaaatttaatgaaactaatttggtattataaatgttgctaaaattttctatacatttatcaaacttaacaaagtttttttaaaaaaatcaaaacgacttgtaacatggaacaagggagtaacaaatactgaatcaaacggaagaannnnnnnnnnnnnnnnnnnnnnnnnnnnnnnnnnnnnnnnnnnnnnnnnnnnnnnnnnnnnnnnnnngntcttactcgca

SEQ ID NO: 10387 - DNA, 1446 bp, Oryza sativa
  unsure (1)..(1446): unsure at all n locations
cgcgcgcccttgtttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacatctcattatctcttgcggttgcggatggctaattttacggtcgctcgtgggctcccatcgctcactgcccgatccgcgcatgacgtttgtgactgtgatgactcaggggaggcgaggaaagaaggggactggggaaagaggaatgaagggtaagttttcagatggaatgcacgagtttcacagtgaatttacatggaagatatcggccgcgtctgagatagctgaaattgatgcaataatctgtttcttttatagcaacctgaggtataaatgaatcaataactactataaagttgagaaaagttactttgcaaaaaatatttcgaaagaattactataatgcatcattttttttgcgaggataatgcatcgtttttgggtatataaactttttttttgcacaaaatgcataatttaaggcataggaaaggatacaaacaaaaaaaatcaaaattacgcgaaatgagcgtaactttacttattagattcgttctagtggaactaaccggatgagttctggagttgatatgagtgttcgtatttatggctaattattcttttagtggtaggcgacctttagtcgacacggaggcgtcatggtgagtggtgacttcgtaaatctcaagatatacaaacgcagacttctggagatgctcatagtgatatgtgtgcgtgtgtgtgcatgcattcataggagtgagtgtgcggttgtgcgcgtgttgtgagcatctgcgtttgtaccgtgtttcttaagaaaactacaataggaaatccaaagttattcttattcatctcaagcggttatttattttcggatctcgggatggttattaccatgtcatttcaaactagccctaggcaccatctgtaaatttctatttttagcaagtttactattgcctgtaaatttgaacaaatattggctaattttttaaacataaaaataataattttcatatttttttagacaagttttaaattttaggaatatatgtttaaatacatagcctcagtagcaccataggtaatgggttcgacttcccatggagtgaattttgcaagatttaacggctttgtgctttcagtggtaggcgacgtacccgtcgacagcgaggtgcctgggtgatgtcaatctccaggatggatttaccggcccagtcttcgaagatgctcataggggtagtgtttgcgtgcgtatgttcataagggtgannnnnnnnnnnnnnnnnnnnnnnnnnnnnnnnnnnnnnnnnnnnnnnnnnnnnnnnnnnnnnagacgggcgttcaatcgaantcaacccag

SEQ ID NO: 10388 - DNA, 828 bp, Oryza sativa
  unsure (1)..(828): unsure at all n locations
cgtgcggattgancttcggaattgatacgtcacgtctnnnnnnnnnnnnnnnnnnnnnnnnnnnnnnnnnnnnnnnnnnnnnnnnnnnnnnnnnnnnnntacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgcgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttggttataaccagactgagccacaaactaagccttacccactagacatgtgaaagtaccgtagtgctttgcaacagaagccccgaagaccggtccttatattggcgaagtgctactattcaaaccatgcaccccgagcccagactaaaaccattttggggggtttggaataagggggn

SEQ ID NO: 10389 - DNA, 777 bp, Oryza sativa
  unsure (1)..(777): unsure at all n locations
nctaactctaaatacaaacatgtaatggtgtcaagtcacgcaattgcaaagggaatttctcattatttgaaaagaatgttaagtaggataggtttcacattactaatcgaagaccatgcaaattactgtttttctagtacattatacttcgcaccaggtaaattacatcgtgtttcactttataccgggatgatctaaggtgagttgcactttactctagcatcatatttcaattggatacatacctgtcagtagtattctcaccagataacatatataccagtaccaaattgaacaagaaataggaatgtgttcacttagaaagagaataaaaatgccatcatcaatggggttgcctgtaggctaggactgttaatatggtctgaacaatggtacagagtaggacgaccactgcagccaacacacctaatgctaaccatggattgctgaagtgattacgccagagccaagccatccatctgttcagcctgctttggtaatggtcctccaaaacataggataaagtttgaaggtagtggtaggtatcagaaccaaatatcaaatgtgtgctgagcctggtgaacatagctgacacttcatcgtcattatccagcatatgaacaattatccctctctcagtaagtagagtggcatcctcagaagtgcttacaagctgagacataaaagcgatnnnnnnnnnnnnnnnnnnnnnnnnnnnnnnnnnnnnnnnnnnnnnnnnnnnnnnnnnnngagagattggaatttcatntcatgccc

SEQ ID NO: 10390 - DNA, 6009 bp, Oryza sativa
  unsure (1)..(6009): unsure at all n locations
cgtgggattgaacntctnttggaannnnnnnnnnnnnnnnnnnnnnnnnnnnnnnnnnnnnnnnnnnnnnnnnnnnnnnnnnnnnnnnnnnnnnnnnaatttgagcgcttatgtagctaataactctgccacctgaatacttgattcattaaggtcgtcacccaatacccggaagtctctatcgttttctttgtctgttaagcttcacagggttgggactccctaaatcaaactgcaatcgctgtttatcaaccactcacgacgacaccgagatcttcgacttagctcccacaggtctcggggcggaagataacgaaagggagacaaagtcctaactaaatcaacacacaataacctcaaccttctaccatccatcatatcagtcgagtcgaggagattcgttcttatctatagataaggcaagagagaacttatgacctcgcggatggagagggattcgaacccccggtattcctatcaatacttcggttttcaagaccgactctttcaaccgctcagacatccatccctgcgctcgcccgccctatctatctgcgcgctggcaggtaggggcaattctatgtgattcgctacgcttgcttgcgctccaccccgtaagctaactatattgcctagcggttagcgacacttttccggtagtacgaatcgctacgcttcgcttctttttcaccgtcggttgctgcgctccctgcgggtaatagcaagagagtgaagaacgaacgatcatcagttagcagtgaatgagtccgacttgagttcgtgagtcaaaggcgtggcaagagagcgagttcgactcgcgaacgacctgcaagtgaaggaccgatcctttaacgccagtactgttgcgagactggtacttgggggctcacgagcaacatatagactaaggttgcccatcactcccttgctcctttttgaaggcccaccgctccccctttctttaagcatctatcccggcttgcattttggggcgagtactacagttcctccataatcacacagaacgcctagcttcgtagagctgctctctccccagtccacaacaaggtgtggaatctggatctacagtgtgttctgactctattggatcaagtcagatactaagccttctactactacttaggtacttaggagagaaaatgctatatttcatagattggactctcttactgtgtttttctcagggcagttcccgagccgggttccctggatccattctgacctaattggatgaatgaagaagggggcgagcagatacgacggcctctttttagccgaataaagctggatctactacatagggaaagattaagaaagcaagagcaagcctactctactatcgattcaaaaggtaaactgcccccgaagactttatcaatgaatggatcaaagaaggaggctctatctatgtcatcgtatataataagggaagaagcccgcccctgatcgaagaatgaagaagctagcccgggtagactttaagagctcttgctctgcctatccctatcgctctgccttctttcccctcgcctctgtaaggagtgatttgtttggacaaagccgaccaggaatccaactgaacgacacgagttactctcccgagcctcctctttattcagaaatgaaaccaagccatctgatctaaccttaggaaggcggtatggattgactataactaaccaaagcgagtgagtgggatattgtgatactaagaaaggaagcaaatgtctcaatctggccaacaataccatttacatcagtcggcatgttctctgcgacgaatctacatttccttttcaatctgtgccttaaactactcccactacttactccacttcaacatcttctcatacaactcttccagtcatctcctcagtctctgcttctcctcttaattcctctcgtccacctcctccttccccatgtccttaacactctcaacaaccgacacactctatgaccactcgaaccacagatcgcactatgaaacctcagaaattccctgatttcattgcctactcatctaccctgcatccattgcctccttccaatcaagagactaaaccaacatgttattcaggggctgttaaacatccacagtggcgctctgctatggcttcagagatttcagctcttgcaaataatggcacttgggtactggtaccacctagtcctaactacaatataattggtaggttgtgggtttacaaaaccaaacgcaagtccgactgtacgattgagcggtacaaagcgcgtttagtcgccaaagggactactcaggaggatggtgtttcgtgattcattgaagctactcccagattctttaagttctttaggtcaaagtctctgcccagagctcggcagtaaaggtgaagtagatcatacgtctgtagttatggataatttcgcatctaggaagagggaattggtagagaagcaagacatattgggtggtattatgctgatcaaaatatctattggagtctttacgagctttatattactacaaggatgatgaccttgtcttttctagcgctaaccatctttaggaaggattattatgatgagatgagtacacctatagcaattcctcataggactgctgatgagtttcttcataggggagactatggaggtcatgcggatgtgtataagctgtgagaattttttctattatgacgttcgctctctgtatccgtttataatgaaatcatccccaatgccgataggtgcagctaaatgggatggtaatttacagggagaggaactgtatggctttctcgaggcatatgtggactgtcctgaaacaatgaataagccattccttccatatcgatcataaaaaagactggattgcttattttccccggtttatcggagtttactattcagagaaacttcaatatgctgatatatttggatataaagtcagacctctttgtggctatctctatgataagggtgatggtttattcgataaccacatggccccttttccctttaacgcaactaggtaacaatacctcgctacctgttgctgtcctttttaaacccgtgggaaacttcatcatcaagtgaggtggaaactacagcttcgattgcattcagccttcctcgtcctaatattgcatgataggccggcgtccaccaccattgacggtcgctatggccacattcggagacttccaaaactgaactggaagatggtacccaaagcttataaggtttaaccggtaaagcttatgagagaagttcgaacctgggacaagattttatcatctcgttcgagaacttctttatgcaagaaatgggctacccgtgtcgaccagtaccctttttactcggtgcagtacccactcggagaacgtgagagtatattcccccgccctcttctagactttatacacttgtaaaaatatgtcatgcgccactggcgccttctctgcttgcttttgtctccctacggtgtttacatacacttcccaccatgtggcatgccattgactcacttttaggacatatttgtacatcttttgtctctatcctagtcaactggtacgcatggcgtaaataaagatgacccgaccacccctgttcaccttcctcaaacccaattcaaatgatggctgtgaaagtcagaatccttcctacctaggaaactctcatcagaatcattgatggtattaactgacggctgtgtggaaggactactatctcgtacataactctgtgtacactccgtgttgataatttgagacctaatggacacatcatacataagaacccgttgtcgagattccatcaatatcttgcttggcagcttcataaacttcgtcttcctcagatcataaggagttttgtcaaatgaaatgctggacaatctacatgagtgaaaggatgtagcattagactctttcgagcagaaggagaagacagacctttatgtatgactctggtgccggcatgataccaaattatgggctttttgtaaatggcttcatgctggtatggggtattaccctattttactcaaaatactgtgacttgtagctcagtccaaaagcctactgcttatggtactgctagtctgttatgtacaagtatcttaccgatgaaaaatgagagataacatgctttttttccaacttttttttctaatgtgcatatatcgtaaggggataacagaggagatgctgaggaaagtgttggggattggaatggagtttttcaagttgccgcccgaggagaaggcgaagctgtactctgaccacccagcgaacgagactagagggcgccttgcttttcgtcctagtcctaaggccaattggagcactaagcccaattactgctttactccgttatttagacttcattctcctagtcctattcctgattgttatttcggattctgtgcctgggtggtatcttcttactattgattcaacctcttcgggcaaacgttgtcacttcctttatttgaaaaaaaaggggtctagaactacagtgatctgataccttcttcccttggtctgggtaggtaggttatgtaggctacaactgttcataggttgttcgatcgcaaaatgccaaataatcgattactagtatgccggatattgcctggaggcccttctccctatgtttgactcatcctagatgggttcacacttgtcgattccggtcaaagaaaaaagctttttcacggtcccatcacaccaatctacgccaagataaggaatgctgggttgccaggaacaaaccctgtgattcaaggttttgcctagaattgccttaaaaaaaatgcaccccattaattgatccctctttagggtagtataagtacatcctcgactatagcacgagtagagtcgagttctcgtactaacctaagagcagatatgccgaaatatttccacgttcaagcagctaattagtaaacgacttctccataacagtttgaagattggctcgcaacgcaagtagcggcaagaaaggagagcaagacttccttttctaaaagaagaaagaactagacttctataagaagattttgataatcgtagatcgtggaatattcatctatcttattaggtaactactttagctgctctcgaaactgaaccatcgtgaatagaactagcgcttaaggaagagtaggatctgttagcaagtcatattcaatcacccggtcttctccttcctagcttttagatagccctgattctttattggattttaatacacttagccgtgtacgtatcttggctaaactcgaatctatagtttatttaatactgatgtactcggtaaagaatcaaaaaggtacttgaagacgactttgaatgggaggaggttttctttttatccccccctaacctgattttgatgtcttcttcgttctcagtccctatggtccattgtaggatgatttttctaaggccttgaattcgttggaaaggtgatcagggtcctctccctggtcctatcgaaccagtgacttctctcctgggattgaatatgttttgcctttccccgatggttccgcattccaatgtgggtaggatttgccaggatgagcggcttatttagcctatgcgaagcacgaagcataagagaagagtgtagcgaagcgagtgtaatacttgtagcgaatataagtagtgtcaaagcctacactggcttagctctgcagatgttttcaggacgaagacggtgatacgataccactcgccagtgatgataaggttcactcatagcataggtggaagatccatccaattttctttatagatttatttgttcaaagaaaagacgcctaaaaatcattcagggctcttggtatcctttaccacattcactttccatattccctttttttagttcagacgctatcatacctcagggaaaataaaatttctatcaacgattnnnnnnnnnnnnnnnnnnnnnnnnnnnnnnnnnnnnnnnncaacagccatcaatgcacgc

SEQ ID NO: 10391 - DNA, 6242 bp, Oryza sativa
  unsure (1)..(6242): unsure at all n locations
ctggcacttgatatctactcacttanggcgaattcgagctcggtacccaacatcagaggatcaattgaataaccaactctcccgccccgctgccgctactgctccaaagccaacaaatgcacttgctcatcccaagcatcactttccacaaatagtacccagcgtgtgtcctagccgccgagggcactcctcttgaggaggcagttttcgaatctaatctttctgtctgcccataagagcgggacggtgaattaccagtaggggcaggcccagaattccatgtacgcctattccacgcccctcccccctgggtgaggattagctcctatgatttgccgatggtagtaggatttcctatcacattgatagaagggaaggtcatctactaatagttaaacggaataagattagttacgaggacacctgctaactattagtaaagaaagcaatagttgggccctagtcgatgtgctcttatttgaaatctatagctttttggccgggtaagaaaatgaagtagtagtctatcaggcagtctaattcgtcttctctaaggtcaggcagtgaggcattaagaaagagcagcagcgattttgtcaagcgaatagaaagagctgctcgttaagcaagggatgggtttgtttgcctgtataggtagaagcaccggtgtattaggtatcaaaagaaaggcatctggataggtatttaatcaaatacttcttccctcataccatacttatctacttcgctttatttaatatgtttattgacccgtaaatcaatgttctactctctcatggaaaaccttctttgtagtaatatgaaagcttatcgcaaagcatagaaattaatagagcttataatcaggtcagatattccacttgctcctagaaataaggtaaggttagttagcactttcatgccaactttcatcagcaagcacttatataaggggggtgcgttaacagaggaacttgaattcccgctggaaaagtgaaatagattcagcaccaggcggggaacaactactccttttttctttcctcaatcctcaaacaaaataaaagtattccgttctacttccaattccagctttcgatacacagaaggaaagccatcccaacctagagatgaagccaacaaaccactatctatattttatgtcgaccaacaatcatatgtctgagagtctggtctaactaagcggattggaggcgggcattttcatttcaacgtagcagtagggaaagtgattttggggggttagtacacatgggcagttgggacagttacaggtagttaagtttggtcttattcttatgggcaagtggtcctagaatctctctttccttctctaaagtatagctttacgaaactagaatatgagtaaatatagaaatagaataataagaatatcatatagccgtttattagtaaggataggttttggtgagtagtagttcttggcattagtaagctagcttcactagactatctatgacaggaaattcggtaaatgcacaatatcttttcaatgaagaaagattcataggaaatgaacaatagaaagagtactattcttcagttactcttttttcttgtcttagaatagacaatgtgtcaatggattagctgactttactatgttcctgtcttcaagtataagtgagtcgatgtcaacgaatagttgcttattgcactactcagtgaatgagatatagcatatataatggatttttcttttccttttactaacattctgcctttattctacttctttctcgtctgtgtcaatgagaagtaagagtattctcgtactacgaagaataggcaaatctttgatttggaagagttttttactcatatctttttttcagggaaatatgcctttaagaggaaatgagtgactttctgccggagaatagtagtcatctgtactcgtcttttgtccttccatacttactaagcaaactaggtcacacctggacaactagggaacataagcgggtgatctaatgattcagtggggaaagctgttcataaggaccggtgagatggtactcccctgtggtatcccaataaccgtattcccatgggcatttcctcaaaaataggctattttgagaaaggaatctattagctgcacaagtccagagttgtgtgtacccctagtgaaagagtggaggagttcagacgcatatcgataccaaagtgagaagcctcttaatgatggagaacctgcctctgccaaatgcccaatacaagcaagcagggggagcggattcccagagagaattcccgtgttactctgatattagaaatagaggaactagaacgaagctctacaaagttcacaactcaccattgcaaccgtaggtggatacgcctgctggatggagtcagcaaaacccaaagcaagatagaacgtaacggagactttccggatccctcaacctcctatcgatatgtatgaggcttcgccaacttagaatactgaatttaggcaagaccaacagctacttcatctcctgatttcagcgttccgtctttacgtcctgtggtggggaagtatagtgcaatctacgtccaaccatgggttctatcagaatatcatcggtcttaccacaacattctccattcctgaaaattcctcattgggtagattctatcaaaaaatcccagttccactttattagcctatccttatatgctccaaggattcagcctgctactatatccaatccaatccatccgagttgtcccaataaagcggatttcactttaatacatctccgtgtactttccttattggtcttactcagatacttactcgggttattacaatatggacatagtcatttattgcccagtccacttatctttctccttttctttacggttaacagggtcaactaaccaaaaacctttgctgttcatcaccagttacggatcgtaacaactatcaccatcaccccgatcactccgataactgatacccagtgccgcgagtagaatgacaatgaagcgagtctagaggtaccggcaagttctcctgtgaaaagaagtggaactaaacaagctagtgtttttaatatgaaaggaacgcgggtcatacccgtacaagttcagaaagaaatcctgggaaaagacgagcagataaaagttctcttgcccgtaaaaaaggcttaaatgagtgtttttttatttgagttccagggcttttcaacgattagaaagctctctatgacggcggctaagtcgaggagtaggcacacaagagtgctttttttgggggctcaacctgtataggtactgtgtaaggttagctctattgggcgccgcacttacttattgtaaaacatgcgccagaatgcccaggcatgaaaactatatatgataatatggtttttaacaaacttgtctctctttatattctaagaattgtcagcccttgtcattttacttcttacgcgggatttatggacaaaagttagcccggattactaaagatctttgttgcgggaaaaggagggatttgctgagttcaaaagcaagagtacttcagtgaaaaagcacaaaattcattcccagttcaaagtgatacacaaacagcttgttgctaatgaattcacaaaataaatggttgctaggtaaatcgtactttttgcagtcacatatggcttgtaactattctcggtgttatcttacaactactcttcctttctctccttcggaagaactagtctttgaagcaagagatgaacatattgtgggtggatcttcttacccattgattggaacatcgtaaaaactccgaagatccttttcactatagttagtgacgtatccaaattctgtatactattggtggacgggacattccccgcttccttctgctttgttttcacgaagcgagcgctttcaacaagcttcttttctttggtaataagcaaaagtgtgtaaagtcctccgttttatcactgggaaagctttgttgtcttcgttttctttctgccgtagtatatcaccgcatatgatctggcctttaaagtgggttagtaagaaaacttacctttctgggtaagtgcccttttaatgtttaagagctagttgagcagtaaaatagaaataagagctgctaaaacaatatcctttttcttaaagttcctacgatgctagtttttaacaggcatatacactcagataatgcagcaagagttccccactaccaagtaagctctttctacttgttcacctagatgaaaactacctggctttgtttggctactttttttattggctagtgtgattttatatcttaggctagactcgcttgagctgtcttacattagtggggctatatgtgaatcgcagaggtctgtaaattaaggcaataggcgggcacatttgaaatgcagcagtagtgagctcctatagaaaatcaaaaattcaataaaaggtcataatggtcggaagctgttcactacttcagaaccatccagaaggcaagagaaaaaagcacctgaggtcaggtgtttcttaggagttcaatatgtttcatgtgtgtttttgcaaatcttttttcttcactggtcctgcacgcttgataaaaaggatctggtgtctatgccattttggtaaaccatatagatcttgcccaaacaaggagtaggggctagcttgtaagccacgacttagtactacgaggatttgggcagagtttcacatatagataggtcgggatgaagatgagaaataggttcggttgtgaatctgggtcaagaaatgggggttatgcgccagcctatcaagcaagccgaataggcgcgcctggatgatcaattccttggttttttcttacctgaccgagagacggggccgatagagcatattccggacaagttggttcgattcgcagttcactttctataagataacaaaacagcagacccgccccatgcttttctttacactgacccagcattcccctttgcatttcttccaggcacaaagggattcgtttttatgagaagcgagttgttctaggctgggccgatccctacccgttttgatctgacagcggacgaacagagaaacgtgggtctttttctcgcattttagcgatcaataccgaatcctcatctatgcaattcttgtacttatttgatgaaagacaaagaaagagatcaggttatttatgatcggagaaaaggaaacgatcaaaccgcctacacctattccattggttaactattccggttctaatctggaatcgtagtgagagtatctagcatacatttgtacattctgaactaagttctactaatttcttctaagatagtggtgttctcattcccgcttgcactaacgaactgtgatgtttacggatgagaagtaggctgttggacagatgatgcttgtattgccagccttcatcggctccgaggtgtggccgggtgagcagtctgcggaacgtttcactgcctggcccccagggtttctgagtgctagggaacctccttagaagtagctatattggaataccccgctgacttcagattctgattggctggaggtgaagacctaagcattggcttacactgactcctctatcaaaagaaagggtacaggcactagacaaattacctactggtaatgtaaagggaggaccagagctgccacatagggcagttttacatcgatagcaggtaaagacagatagtcagacctaccaatatagttaagttggacccgaaagacagcttcacaagaccatgcaatagtttacttgttcttttcttagcactttatcgaagatatatcgctgattataaaaacaaattggcagagcttgcattagtgtaaaatcaaactaaacatgctattgggttaagaagaagaggttggtgaggatgaggaagatccacaggaggagttaagcaatagtgcaacagaaaagcaattagaacctgaagaagcattaatctccatgtttgctatctcctctgaccctaatctcttttgtttgctactatgatcaatttggcatttcgatcatcttttgttttgaaggtacttataacaaccaattgagcatatatctgtacatgctggtacgcgtgatttagtactagagacacattattacctaatgnnnnnnnnnnnnnnnnnnnnnnnnnnnnnnnnnnnnnnnnnnnnnnnnnnnnnnnnnnngnaagatggagtagcaattcaatgccagg

SEQ ID NO: 10392 - DNA, 7347 bp, Oryza sativa
  unsure (1)..(7347): unsure at all n locations
ccgcgctttgaatggcaactctctttnnnnnnnnnnnnnnnnnnnnnnnnnnnnnnnnnnnnnnnnnnnnnnnnnnnnnnnnnatgggttaagaagaagaggttggtgaggatgaggaagatccacaggaggagttaagcaatagtgcaacagaaaagcaattagaacctgaagaagcattaatctccatgtttgctatctcctctgaccctaatctcttttgtttgctactatgatcaatttggcatttcgatcatcttttgttttgaaggtacttataacaaccaattgagcatatatctgtacatgctggtacgcgtgatttagtactagagacacattattacctaatgctgctgataatgtactgtcttttatagttacaaacaacctatgtttccatctttttaaagctgtttactagttatctgtccgagaaacaaactatcacacaattaaagcccgcaatgcacagaacataaggcacatacataccactttagcacactttacagaacacgagtgcaacataccaattctagaaaaaacacataaacagaatccaaacaaagccacttaagaataggcaagggacacaccgtccacgccacctacttgaagagcagaaaagagtatagttagtgtaaggaaagtattataggaaagaccctataagttcagacaatatgctacattctatgatatcctattcaatccctaggttagcatgcgttgctcgtcgtgctaataaatcctctcttcttaaagcccaagtaggacaaagaaatgcaagtaaataccctcgattcattccttttatgcgagtgggaaagctagctagaaatcaatgacaaggagtagagcctagagcaaaagggcctggtgtcaggttagttaaagcaagaaagtcaatgctggtgcttgcttattcaatccttttttctctcctcctttgtgctaatcactaggtcaaaaggaacccttaatatggagttttatacttgttcttacttgtgttagtgaagccggatagttcaacttgcctgcccaaagtcaatctatgaaaagtcttccttataggcgcacccagttgtaagagagtagaagcaatcggagtaaataaatcccatagtgaaatgagcgttagatgttgactagacaaaactagctaatacatgtagtagggtaacttttccttttttcttggttatgtgaaaagggagaaaactcgctacactttataggaaatgaactactcttaatgcaagctagtcgagctggatgagttgttaggaatggctcaacccaggcagcactaaacctttcttttccaggcaaatctctcacttcaatctttctgggctagctatgttctcggaccccaccagagtaggtttcaccatcgagtaatgaagatgttaacttctagtacaagcaagcaaaatctaatgcccgagaaagagggaatggcattgaggcttcatccttggaagaagacgggagtgctactagggacaaacagagttctggggccagaggaaggggaacaaaaggtagaatatgcgggttatcgtagaatctctgagtggcgatgccctctactacctaatactaaaagaaggggactttgaaagccaaagccaagaaagaccatatcaactactctccaaattgcaggataagtcacagaattcaaatggaagacagaaagagaaggaaattcaaacctaatggccaaacattacgaatccaagacagaaagacttatagccataaaagaataacaagagaacaaaaacaactccatattctactggcctgcctctctgatctactatccaactgccatggaagcaccactgaagactggcttctctgaccttccacccgatcctgggcgatcccggatcgacaagctgacggtatggattccctatatatggatggtaggaacgcttcaactgcagagccctgaatgcgtcagtgaggttcctctgtgagagaaagagaggttgctaatcttggatcagacggcgtgttggtattattgataaggcttggattagcaaattagcaccgcttgagtttaggtattcgaaatagcgaaatacataaattatctatctcaagtacgtctccaacttatcttgagccatcagtcagattaaaagcagcgccctgccggtagctcctgacctctgttcctatgggagaaagaaggtgtggctttggaccccaaactcttccatgacggccttcttccactcattttattagcaatcaaacctcttccctgctcttgcactgaggtaagcattcaaatagcaaagcaagggaaaaaatatggtatgtatttttttaatctacatacagagaaagcggatgtgcccttattagcgcagttgaaaataaaatatataacgcgtagttgcaagctttctttcgtgagctagctatgtttgcttcctcttttcctctctgtttcggatgtcaacccaatctctgattcaagtccataagttccttttttatagctcctgttgctcttctctggctaggatctcacttatatggcctttttttttcttttatatattatatagtaagcttcaatagatagcgtagtaggtgctgtctctatttactttctttcttacgcctaggtgctaccttttttccagttccgtaagtcccatagagttattttttatctttgattcccaaacgctgcgcgcaagtcaagcttacagaattcctgccggggcgccttctttcttatgccagccaagtagcaatcagaaaaccaatcaatcttccttacactacgacaattcacttgaactaccaacatcatgagtgacccaggccggtcgtatatgcgtcatttctcctcatccttgtctctatttgttaattgctcgctacccgtagtgggccttgagtaggtgtcacaccctgaaaatttcaaaatatataaattgttgtttaaatggaatttttagaaataattttaaaagtcttgaagagaagatctagttttaattaataaattccaatataaaatggggcaagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggccgaaagtcggcccaaaatcccttctctctctcctcggcccagccggcccagtccgcagccgcagccgcccgcgcgcgagtgcgctgtcgctgacaggtgggtcccacctatcgggatcgtcgtctaccttcggccgccgccgccgaaaccctagtttcgcgccgccgccgtttcctttccaaatctccggccgaattgaaagaggggaaatgatcctcgggatctcctctaccttttctcctttggaatctttggctaaatcgttttggaaagagttggattcgagttcgtctcggatttgttcttaccgagctttccttcgccgttgccgtcgccgtgggccttcgccgccgcctccgagcccctttaaaaggaccccggtgtcttctttacccgccgccaccctcgccttcgcctctcgtcgccggtttcgctctagcgccgtgtgccctagcttcgccgtcgccgccgccgctccagccgtgctccgccgccgttccagacgcgccgtcgctcgggaaggacgtcatcgtggtcgccgtcacgtcgccgtcctcgtccgccccttcgccgtcaccggagatcgtcggagcttcgtcgccgtcgacaacccgaaggtttccgccgtttcctcctcgccgccgtcgtcgtccgttgttcttccgccgccgttttggtcaccggtgtgttcgccgcgttgtcctctacgtgctggtgccctccgtttgcgtcctcgcgccgccgttcgccggcgagcgtgcgccgtccgagccgtccgctccgtcgagtcgccgccgctgtcggtgacgtcattgccgacgtcatcggggttgtccgccgtgagccgccgtggacccgatcgatctcggccgtccgttttggattggttcgatctcggccgtccgttcgcgtgaaccgccgcccgtgcgcccggtccaccaaaaccctagcccgctgacgcaataaaccttcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttagtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattgtttcaactagatattagatataattgcttagccctgcttagaaacattagtacacattcgggataactaatgactcattattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgctgttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaaagtttgctaaatgctgcttttgcaaatgcaaccctattatgccattctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagtaggatttaagcacgggtttcgaaccgtctacttttccttatccttatgggaatttaagagagagatcactccactgagtaaccgagagagaagattnnnnnnnnnnnnnnnnnnnnnnnnnnaaatagaggcaacgaaccaccaatccattacgatgcccgcaaagaaaaccaacgcttaagacgctattggagactagcgtagctattattcgaagcttattaatttctttactgcgttcaaggcatgaccgcgtgataggtgtccttttccccctactcaagaagagttacatctaagttccgatcgtgatatgacaaacaaatcttactttttctttcccaagctggcgcataacctctggactgataggaagatcgatgacccgcatcctacaacttcaaagaagtatttgtatcacacccgagcaatggaccggggaaggagtttcattcatttacggagtttggaagcaaggacaatccaggatcaactgctatctgaagaagtggaatggatctgattacccattggcatctgcattgacgcttttgactacccctactctgtgtcttttgcgtttccttattcatgtactcatgtctatttctatttgtatgatactgatattgcaatcgatctatcccttggtcctcccaatcgaattgttaagtatgttttttccctttcgagaaatggtggcagtaccaaatgccgaattagcagctataccaaatgatcaatgcctctggggtttaccttctcttcagctctccccggtttcaccgatgtgttgggcactgaacacttttcaagatccggttttggtaggacgaagatttttcactttcgtgaaggtcgttctgaggtggaatcgaaccactctgttaggatttagagtccaacgcgcaaagctaaagaggatttcgagtcctctgctctaaccagccagaacctagaatacagggattgtgataccgaacacccacacaatctcgatttgacatgacagagagagagatggcgatggcagtctctctctctctctctctcttctttttaacggatattattgacaggaaaaaaccaatgttcaatacatacttcagatcttgaatcaggcctcgaagaattctatggcaattcatactttcttaagaaataagagagaatctcctggtagaggcggctatgcctcccaagcgatctcggctgaaggtatctatactcatccttcagctttattagacccctctcacttggttgacaaccaatgagccccttatgtaggagaaactcatgtacgccttttcgaacctcttcgggacctgttgtgtctgccctcgatttagccgtcttagaatagaannnnnnnnnnnnnnnnnnnnnnnnnnnnnnnnggtgagcagcacccaaggcgca

SEQ ID NO: 10393 - DNA, 1117 bp, Oryza sativa
  unsure (1)..(1117): unsure at all n locations
cgtaccgatgttactgacatagatacttactaaactgtnaaatttgaatattgcgcagaattgctgtntatggacgcatntngatcatgtctttcnctctccnctnnccccccagcccggctttgtttgaagntcgtctnnnnnnnnnnnnnnnnnnnnnnnnnnnnnnnnnnnnnnnnnnnnnnnnnnnnnnnnnnnnnnntctgacttctaaggtagacaagggataggaatcaatgcatgctcaaatccaaatttaaaccaagcaacaaatgggccaaaccactagccaagcatgatgatttgtatgcatagaacatttttcatgaacccggataaagacactaatgcgactgactaaactatagcttaatgcataaactagatgcatgaaaaatgatgcgcgtaacattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcaaaagaacaaaaccccaaaatttttcccgaaacaaatccaagtgcaaaaagcatatgcagatgaaaaggtttcagagggctcttagggtttccatttggcttgtcctacggtcaaggtcggctctgataccaacttgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactnnnnnnnnnnnnnnnnnnnnnnnnnnnnnnnnnnnnnnnnnnnnnnnnnnnnnnnnnnnnnnagacttggggtacaagcattcaaggccac

SEQ ID NO: 10394 - DNA, 801 bp, Oryza sativa
  unsure (1)..(801): unsure at all n locations
gcgggcattgattgacancccctttgaacgcccgcctnnnnnnnnnnnnnnnnnnnnnnnnnnnnnnnnnnnnnnnnnnnnnnnnnnnnnnnnnnnnnnattatgctcgcaaaaaaaatgatgcattataggaatcctttcgaaatattttttgcaagagaacttttctcaactttatagaaggtattgattcatttatacctcagggtgctataaaagaaacagattattgcatcaatgtcagctatctcagacgcggccgatatcttccatgtaaattcactgtgaaactcgtgcattccatctgaaaacttacccttcattcctctttccccagtccccttctttcctcgcctcccctgagtcatcacaggcacaaacgtcatgcgcggatcgggcagtgagcgatgggagcccacgagcgaccgtcaaattagccatccgcaaccgcaagagataatgagatgtgttgatgatcaggtaccggtcctaattggcttaaccaatcaatctatatgactgtagcccgcctggatccggctgatccgaattttgctgatactttttccggaagattttccagctcccaagagaaatcctaccgaataaacgcatttctgtagcatcgtcgcccgtatcaattcggcgagggattacaggcacctgtaagcaaaaaccctacctttcctcaacaggttggataccatcgggagaaatttcgctgcgtttcaaaggtcctttcgtctcctttatattacccggcgataagaaaccccgcttaattctataacgttacgggag

SEQ ID NO: 10395 - DNA, 1002 bp, Oryza sativa
  unsure (1)..(1002): unsure at all n locations
gtggggtttgaatgacacncncatgatcacccgctnnnnnnnnnnnnnnnnnnnnnnnnnnnnnnnnnnnnnnnnnnnnnnnnnnnnnnnnnnnnnntgaagtttatatgctctttaattgaatatttgcgaatttcttcatttaaattttaatttaaaatcggaattattgcgtcagccgaggggagagggcgcgcggaccgggtccacgggagtggggcccacgcggcagcctcacggtccacggtggaccgggtgcacccggctcacaccggccggcgccgtgggtcccacgcgtcagccgcacccgagggcgcgggcggcttacggccgggccccacacggcagccactcgacgcgcccgagggcggccaagccagcgcggccggcgggaggcggcgtgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaaacagtagttgaaagcagtaaaacagttgtagtaattaatccatattaaccaatcactgtccaacgttacaccacgaaacaaaaggcacaaaccaccacctaaactaatcagttccaaaagctaactagggtgaaactaatcacggggtaccgagctcgtattaggcgaatagcaattgatctcacccctt

SEQ ID NO: 10396 - DNA, 6957 bp, Oryza sativa
  unsure (1)..(6957): unsure at all n locations
agggnatgaactccaactcttatgcnnnnnnnnnnnnnnnnnnnnnnnnnnnnnnnnnnnnnnnnnnnnnnnnnnnnnnnntgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataataccgtgtagctttaggatcgtctttttaaaatggctttgggcaactaagtgacttttaaatgctgtttactgcaaaacttaacccctttattattaccccttgtacccccttgcattaatcatgcatctgccggtgtggcttgctaagtactgtggttgtactcattcttgttcaatctttccccccttcagtaagagaagcttcggagaagatgtcttaggtggagtcctggcttataccccagttgagcgcctgtgaagatggagccgtaggcccgctagtccgctgctgtttatttttgtttgtcaggccgaagtgcctttgtaataatgtaaatattatcgatataataaagatgtgccttttgtatcatgtttgtttggtgtaccccggcttttcctgggacggggattaatacactagcgttcgggaaaatgtatttttctcggtcgcgacaagctggtatcagagccatctcgactgtaggataagccaagtggataaaacctaaggacatattttataaataaaactatttgcgaaagttccttctttctccttcccctaatgctatttgcaaaaggtttactcccttcttccttcttcggatttcaactagtactagatggtcaggtcagtgaagaagaagacatcgtcagttgtttgccgaagctccggaagactgcaggatccgttagcgaagtggaggaagcagtgaagccaactgtgaagcaggagtgaagatcttgggaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcatagaatggcctccaccaggaatgacaaaacgtcagagaagaaataccttccgaggtgcaccacagttgacagagcatcttttagctaatggaggtagggtgtctgatagtgaagattcagatcaagtctcctcagatgatgaagatgagaagtctccccaaggtttcaaccagaataaaatggaacgaaaggcatgctctcgttgtggagaaatcggtcatgttgccagctcgtgtgccactacatgcgttcattgtgaggaagaccatccacccgacaggtgcccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatcctcgtcaagattacagttttagcctaactccagtgccaggacagaggaatcaaaatgagaaaagaaaatgccgagtccggaaagatatttgttgcttcaattgtcaaggaatgggtcatttcgccgacaagtgcccaaaaccgagaaacatagctgccagcacctcagtccacgcaactccctgcaatcagaagcttgctcctcagcgaattgtcatccatgcatcccgaagcagtcctatagcccccgttgcaacagctccaactccagcgagtgcattaccacaaggtgtcaatgctcaacttcagccccagccaccagttgacaacacagaggccagtatcggcattgtacctttggatgttccagcacagcagccaagaaatcaagtacaagataaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctaaaaactgagactccaacctttgccattgccgtcgatcctatggaagccagtgattggttgcgcacagtcgagaagaagctggggttggttcagtgcacagaccaggagcgggttgtcttcgcaactcatcagttggttggactggcttcagaatggtgggatagctacgaagcatcacggccagaaggacataccatcacctaggacgagttttcatctgtattcaagatatcacatgttcccgcaggaatgatcacactgagaaaacgagagttccgctacctgaatcaagaagatttgaccgtcacagagtacctgcacgagttccatcgtttggctcactatgcaccggaagatgtggaaaatgatgaagacaaacaagagaagtttctccaggcgttaaaagatgagatcgcagtgcaactactcctagaggaatatgaagattttgagaaacttgtggacaaagccatacaactcgaaagtgagcataatcggatgaagaactgtaagaggaggattgtcagcatcccagtatcttcatgtggtaaccaaagacagcgcactgagccacttcagatcatcggatcttctgttgcacatcaagagtttccgccccaagaagatggacacaatgcagacaacaacattagcaatactaatgatgatgataccaccaacaaccatgctccatgccccattagtgaccactcaaaccaagcgtgcaatgtcaacatcattcaccaaggtgtcgacgatagtatcgatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaagaaccaaggcattactcgagggactgcctgcaaccaaggcaaagtcgacctccacattaccgccaagttacacaaagcagacatcccaatcgtattgtggtcactggagcaaacaccgtacccgtgaggcctcgtgttaatcagaacccatagcagaaacaatgtaccgatgctaagcacttttccttttaggcagtgcttagtattcatgtaatgagggagaaatgtgtaatacagacaagttctatgaggattcttttggaagatgcggatatgtgattatgtgtataattgcttactgataaaggagacctagggtctcattccagaggaactatgttctaacctcgagttaataaccaaccggatgatggaaaagaaaatcaagtgattaaccaaagagacatttgtttggactaagtgtttcagatgtgtcttctttggatcaaaggcaacaaccgtcagtctagcttttgatgaaccacttgaaggttctgtgaaaggcagcaggctcaagtaccacattgccccagaagcatcctcaacacccggagcgaagagtacctggttgagaaaggtcgaaaggtgattaatggaagggatcggaaaagatgtttggttactgggaaaagaagtaggtcgaaaggtgattgataaaggataacgagaaccacgatttgtgtcactcgaggaagactcccgatagcaatcaaccctacaacagttgccctgtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagtatcgttcaacgcacttttctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaagataatgatcagacaataagaagtccagcagtaaaactatttgggaaggcgtcaaagtatatcaagtgggataagttggttctcttgggaagcataattcaaaggcaaagttatcgacccttgcatcaaatagaagaagtagctatcacccggagaccaggaaaactaatatgaggcagttggtggcaagttagaagtaaatgacaagcatggtattctcatgatgacaagcatggtatcttagtaatgacgagctgatctcgacgcatgacatgaagtgggtaacttgtatgaggttgacgccaaagatatgaatgataagaagttctagaactgaagccccatcctcgaccgccacagcctagtctgagtcagttagaggtgcaaccagggaaaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcatgctagcctcctcgaatctcggggacgagattcttgtaaggggggtggatttgtcacgtcctgataaattcatcccgaattaaaaatcattcgctaaaaggaataatagaattaattaaaattcgaaaagaaattgacaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaaaccctaaaaagtctttttctcccccctccccctcttgggccggctcggcccatctccttccctctctctcctcctccccgcggcccactcggcctctccccgagcgcgccgctgacgggcgggcccgcccgccaccctcgctgacgggtggggcccacctgtcatccctatcctcccgccgctcccgccgccctgcccgcgccctagcgccgccgctgccgcgaatcccgccgcctcccgccgtccccgcgcgcattaaagtggggggaattattccccgcgatcccctctctctttccccccatttctccctctctctcccgcgttcaaacgggcggatttgcccccgcaaatctcgccggcgccattgatgacggccgacctcccgcgccggtttcctcccttccccggccaccctctctcgccccggctctatttaaaccctccccgcacctcctccgtccggttccgcctctcgccgcccttcctcctcgccggatttgagctcgcgacgtcgctctctctttccgccgtcgccgccgagctccggtccgccgcagtcgtcaccccggaccgcctcccacctcggcgccgcctccttcggcttcgccgcatcctcgccgacctcgtccacctctccgtttcggtcgccgaccgccggagcgccgtcgtccccgtcgacccgagccgcgccaccacctccctccgctccggccgcctcctccgtcgccgccgtcgccccagggtgagccgtggaccgtcgcctcctttcccccttccctcccttctctcggccgccgctccgccgcgccggtggtcgccggcggcgaccatcgggacgcgggcgcgccgtgtcacgcccggaagttcccctcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaaaatcctttcttcttttctnnnnnnnnnnnnnnnnnnnnnnnnnnnnnnnnnnnnnnnnnnnnnnnnnnnnnnnnnaaanaagctggcatcaatgccat

SEQ ID NO: 10397 - DNA, 5840 bp, Oryza sativa
  unsure (1)..(5840): unsure at all n locations
gcgattgatgaccnnnnnnnnnnnnnnnnnnnnnnnnnnnnnnnnnnnnnnnnnnnnnnnnnnnnnnnnnnnnnnnnnnttcagtagtcttatagcatgttttgcttgtgtgctttgtttgtcgcgtagatttcgcccgtttcgtcgattcgtggtttcgcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcatcatttttcatgcatctagtttatgcattaagctatagtttagtcagtcgcattagtgtctttatccgggttcatgaaaaatgttctatgcatacaaatcatcatgcttggctagtggtttgggccatttgttgcttggtttaaatttggatttgagcatgcattgattcctatcccttgtctaccttagaagtcagacatgttcttcgatcgcaagcgccgctccgagcttcagagtcgccgcccttagctttatcgtcttcttagtctgtttgcgtgctagtttttgtgtttaggtttgttgcttgtgggttaatcggcggtcgatatcatgtgtgagtggtatgacagccttaattaggaattgcgtgcctctttttcagtgttttaatcaagattaagataattgcacttaattttataagaaagattagtttccgagccatctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctgatgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgctcctgaagacgtgcgcaccgatgctgagaagcaggagaagtttttgtttgggctcgatgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacaactaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccattttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcgatagtagaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcatcgcagaagcccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacataagcagcatctccgtctggtactcgagaaattgaaggagcaccagctatatgccaagtttagcaagtgtgacttctggttatcggaggtcaaatttctgggtcacgtcatttctgctcaaggcgtggcagtggatccatcaaatgtggaatcagttacaaagtggaccccaccaaagatagtttctcagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttataattctgccagatcagacaaaagacttccaagtctactgtgatgcatctcgccaaggattgggatgtgtgttgatgcaagaaggcagagtggtcgcatatgcttcgcgacagttgcgtccacatgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagagatagccgaattcgtcgcactctgcgatgtttgtcagcgagtcaaagcagaacatcggaggnnnnnnnnnnnnnnnnnnnnnnnnnnnnnnnnnnnnnnnnnnnnnnnnnnnnnnnnnnnnnnnnnnnnnnnnnnnntccattgnnnngtcaatcaactcccat

SEQ ID NO: 10398 - DNA, 1357 bp, Oryza sativa
  unsure (1)..(1357): unsure at all n locations
cgtgggattgacttgcaactcccatnnnnnnnnnnnnnnnnnnnnnnnnnnnnnnnnnnnnnnnnnnnnnnnnnnnnnnnnnatgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttatgctgataaccgccgaagagagcttactttcgaagcaggggattatgtgtaccttcgtgtcactccgctcaggggagtacaccggttccaaacgaaaggcaaattggcaccacgctttgtgggaccatacaggattttggaacgccgaggtgaagtcgcttaccagcttgagctcccatctaatatggttggaatccacgatgtgtttcatgtatctcaattgaagaagtgtttgagggtacctgaggaacaagctagcttagagcacattgacatccaggaagatctgacttatgtggagaagccgattcgtatccttgagaccagtgagagaaagaccagaagcaaggtgatcaggttttgcaaagttcagtggagccaccactcagaagaagaggccacctgggaaagagaagatgaattgaaggccgcccatccgcacctcttcgccagctcttccgaatctcggggtcgagattccgtttaaggggggtaggtttgtcacgccctgaagttcccttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaannnnnnnnnnnnnnnnnnnnnnnnnnnnnnnnnnnnnnnnnnnnnnnnnnnnnnnnnnnnnnnnnnaggggtcaaatcaatcccgtcg

SEQ ID NO: 10399 - DNA, 1794 bp, Oryza sativa
  unsure (1)..(1794): unsure at all n locations
tggcttgatttcanatcaaatctccctctnnnnnnnnnnnnnnnnnnnnnnnnnnnnnnnnnnnnnnnnnnnnnnnnnnnnnnnnnnnnnnccctttcgagaaatggtggcagtaccaaatgccgaattagcagctataccaaatgatcaatgcctctggggtttaccttctcttcagctctccccggtttcaccgatgtgttgggcactgaacacttttcaagatccggttttggtaggacgaagatttttcactttcgtgaaggtcgttctgaggtggaatcgaaccactctgttaggatttagagtccaacgcgcaaagctaaagaggatttcgagtcctctgctctaaccagccagaacctagaatacagggattgtgataccgaacacccacacaatctcgatttgacatgacagagagagagatggcgatggcagtctctctctctctctctctctcttctttttaacggatattattgacaggaaaaaaccaatgttcaatacatacttcagatcttgaatcaggcctcgaagaattctatggcaattcatactttcttaagaaataagagagaatctcctggtagaggcggctatgcctcccaagcgatctcggctgaaggtatctatactcatccttcagctttattagacccctctcacttggttgacaaccaatgagccccttatgtaggaggaactcatgtacgccttttcgaacctcttcgggacctgttgtgtctgccctcgacttagccgtcttagaatagaaaggtttcgcagattcagattaggatgcactgaacacttttccagatctggttttagcggcactgaaaaatctttgattcttgtctcgtttcacttgcatttgctttcgttctaaagtggaatcgaaccactcactccgtttggatttagagtccaaagggcccaggcccagcgaacgaaaaaggatttacagtcccacgcccactgccctgccttcaccttttgattgctttatttttatacgattttttgagcaactagcgcgaaagctgttgcgcgttagcgcatttggaaccacacatttttatacgattttcggatcatttgattttcgttttgaaaactttaaaaccttatcagagaggggccactaaggctggatgttggcttcaagaaatctcctttagccttaccccgggctttgaccatgtctcccgaacaatttcagtacatatggcgcaagacgattccacatatatatcgaggtcggaataggatcgggtgttttcacgtctcaccgtagtgcccggtttgtcttgattggtgattgataaacaagaaggaaaatggaaaagtagaaaatctacataagcttccgttgaggtccttagtttagtcaagtaggcgagggcatttccatcacgaaggattcannnnnnnnnnnnnnnnnnnnnnnnnnnnnnnnnnnnnnnnnnnnnnnnnnngaagaccccaccgtggtatgcgccaataagaccaccaaaggcctttgtggcactagtggtacacagaagtcatgggtgatcattggtccgatgcttcgggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccgagttacagagaacaannnnnnnnnnnnnnnnnnnnnnnnnnnnnnnnnnnnnnnnnnnnnnnnnnnnnnnnnnnnnnagacttgagagtccatntcaaaggcgcgt

SEQ ID NO: 10400 - DNA, 2715 bp, Oryza sativa
  unsure (1)..(2715): unsure at all n locations
agtgggcatttgatgagttgaataaccnnnnnnnnnnnnnnnnnnnnnnnnnnnnnnnnnnnnttatannnnnnnnnnnnnnnnnnnnnnnnnnnnnnnnnnnnnnnnnnnnnnnnnaatatgcaagtgcacaggataacaaaggatggcatagtagggtttcatttgcataaacagcatttaataaacatttcagaatttaataaaacagttaagtaataattaaacaatattaactgtcgcgaccgagaaaaatacattttcccgaacgctagtgtattaatccccgtcccaggaaaagccggggtacaccaaacaaacatgatacaaaaggcacatctttaatatatcgataatatttacattattacaaaggcacttcggcctgacaaacaaaaataaacaacagcggactagcgggcctacggctccatcttcacaggcgctcaactggggtataagccaggactccacctaagacatcttctccgaagcttctcttactgaaggggggaaagattgaacaagaatgagtacaaccacaatactcagcaagccacaccggcagatgcatgattaatgcaagggggtacaaggggtaataataaaggggttaagttttgcagtaaatagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgcgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatccaaaccatgcaccctgagcccagcctaaaaccattttgggggttttgaatagagggggcggtgtgaatccaattccacaataatccaacaattccaaagtgtccaggtgatgagaatatcccaaagtctagagttgtaaaaccacctaatgttacctaattaaacagcgaagcatctacctaaaatcatactagtggtaccgtaagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactgggatttaatatgttcaaggatgatgtgacttgccttgctcgctttcccaaacgccggcttcaacttccacgaagagcggatcttccgaagctgcagcgtctacacgaccaacagaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaatcggaattattgcgtcagccgaggggagagggcgcgcggaccgggtccacgggagtggggcccacgcggcagcctcacggtccacggtggaccgggtgcacccggctcacaccggccggcgccgtgggtcccacgcgtcagccgcacccgagggcgcgggcggcttacggccgggccccacacggcagccactcgacgcgcccgagggcggccaagccagcgcggccggcgggaggcggcgtgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagnnnnnnnnnnnnnnnnnnnnnnnnnnnnnnnnnnnnnnnnnnnnnnnnnnnnnnnnnnnnnnncactgacggtcatcaaagcgcg

SEQ ID NO: 10401 - DNA, 1912 bp, Oryza sativa
ggggcgcgtagtaataagatgggccggggagtatctggaggagcgtaactccggcctgtttgggagccggaaaaaaagaagggaacaactgggggagaaaacagaagagggggatcgcgaggggaataatttcccccccacattttaatgcggccagagaacggcgagcatactgcatgtattttccgcgtagtgagtggacctagtggctcggcaaggtcggcgagatccgccggaagaatagggattacaggttggccccatccgtcaggaagggtggaggcgggcccgcctgtaagcggcgtgcttggggagagccgaagtgggccgcggggagtaggatagacagggaagcatatgggccgagccggcccaagaggggaaggggggagaaaaagactttttaaggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgtcaatttcttttcgaattttaattaattctattattccttttagcgaatgatttttaattcgggatgaatttatcaggacgtgacattaacccaacgctatacaacataccctgttgcataggcccaaccattctgaacaaccatcccggctgcacagttctatctccaaaccaggaatataccattccaaaccatcccggttggcacggttaatgtttcacagccgaaactcgtgaaccggtccttaattgtcatgagcacgaccatcaaaaccatgtgctcacaacccaccattatcaggttttagttggcaaattaattaattaaccaatcacgattgaccatcgtgagctatcattaagacatcattaaataatagtgaattataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaatttcacccaatgacattcgaaaataaatgcaatagttgaatagaaacaatagctttaaacgggatcaacatgctcaaagggttgtttgggatctgtgtgacttgccttgctgtcacgcctagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccagaagaggaggtatgatgcaagatatatccaaggggggctaaaggttcttttgcataaagccggcatttcaaagcagtagttgaaagcagtaaaacagttgtagtaattaatccatattaaccaatcactgtccaacgttacaccacgttgcacaggcccaaaccaccacctgaactaaccagttccaaaagctaactagggtgaaactaatcaaggtgaattttggtcgaccgcccataacctgcggcaccggttttccaattattttactctatcagaggtgtcaactggacccacaagaaacagctccacgacaagttcccgtgcgccgaaatg

SEQ ID NO: 10402 - DNA, 2280 bp, Oryza sativa
  unsure (1)..(2280): unsure at all n locations
tttccgggcaaaaaaggccccagccaaaaacttttataagttttgttaaccaggaaacaaaaccctttttaattggatttaaccccatttatttgatttctgaaactttaaagggcttattggagcccggataaattagtattattttttaaaaatatttgtgttttttccattaaaagaaaaccctttaactatttattggccaaaaatccccccagggcttaggtaagcaagggtggggaggcccccaaaatcgggcccctgttggtaacgggtacaaggggaaaaggaggggttctggcaggcggggccctcggggcagttgcacaagccgggaggggcgcggctggtggttgggctcggcttcaagccggccggccggttatggcgagggcggcggcgcgcgcgcccggttgccagcgacggcaaccgacgacgggaggcggcggcggacggcgcaaagacggcggcggcagccgaagcggcggcgcgagcgaccctagcggcggcgctacacggcgggcggcgcggcaaagggagagagaggaagagagggggagaccgatcctcaccgaggggctcggccggcgcgagggaggagcgacggcgaacggcaacgacgagagacggcaggctgccgccgacgggctccgggaggacatagagaaaaggttgggaggggttagagagagggaggtggtccatggcgcacgacatacccgatcgaaggcggcggcaatggtggaagctcaccggagtgcgaggagatgcgagctccggcgatggaattggacgggagaacagcggacgaggtggacctcgggatggcggacgcggcggtgccgatggcggggtgcggcggcgaccctagcggctgctagaggcggccggagcggtggagatgtcggcggcgggtgggcgcacggtgctagggcgatagggagctcgggagcggacggcaaaagagggaaaaaggtggagagaggcgcggtggtcggttatatagaggtggggaggccggacgtggccgggagcggcggttccgcggcgacgacgtggagaggtggaggaggagagagagggggagagtattcaaatcgaatcccgccctctcgagcgcgcgcacgggccgtgagatgcggggagagggcggcgacgtgggcgtgcggtacgggcggagtgggcgcgggaaacggggaaaccggcggcgtcggtggcggtttcggcggcggcggcgccgtcggctggaggaggaagaaggggccgacaggtgggccccacctgtcggtgacccggagagaggagggagggagtgggccggcccagctgacaggagggcgagcgcgcgggaggcgaacggactgggccgacggcccaagaagagagaaaaaggaggaaaaagaaaaagaagaaaagattttccagggatttaatattgcactttgcttattttaattggttaaaattatttccaaggctctgaaaattccactaaaaatcctgttagcatattttgacatgtagaatccaagagaaattctacatgtcgattccgattattatttgcatttattacttagggattcatctctaggttaaattaaacaatttcttcgaatgatttattttatgaatttagagtaagggaggggtacttcagggcgtgacacttgctggccttggaactcttcaaattcttctcctgcgaaaacggactctccggaaacgtcggaatctaaacagaaaggagcaaaacaccaaaacagcacattaacaagcatgaacagtacatgtagatatttttaacatgtagatctcaattttagaaaaatttagagacttgaaccaactaaatccgagctaagatgaattagttatgaattttcaaagattaaatcggtttaaaacacttatatagattttaattgaattatgacgcaataatgaattatttttgaaaaggaaaagggaattattgcgtcattggctagggttcgcggtgaaccgggtgcacggcggcggttcacaagattgggcggccgagatcgatcctaactacaacggacggccaagatcgatcggatccaccgcggctcacggatggacgacgacgatgacgtcagcgacgacgtcaccaccggcggcatctcgggcgcgcatgctcgccggcgaattacggcgcggcggagcaaacggatgnnnnnnnnnnnnnnnnnnnnnnnnnnnnnnnnnnnnnnnnnnnnnnnnnnnnnnnnnnnnnnnnnnngccattcaatngcg

SEQ ID NO: 10403 - DNA, 750 bp, Oryza sativa
  unsure (1)..(750): unsure at all n locations
ccgggtgtgacatgaacgcccnnnnnnnnnnnnnnnnnnnnnnnnnnnnnnnnnnnnnnnnnnnnnnnnnnnnnnnnnnnnnnnnnnagtaataacgacttctccataacagtttgaagattggctcgcaacgcaagtagcggcaagaaaggagagcaagacttccttttctaaaagaagaaagaactagacttctataagaagattttgataatcgtagatcgtggaatattcatctatcttattaggtaactactttagctgctctcgaaactgaaccatcgtgaatagaactagcgcttaaggaagagtaggatctgttagcaagtcatattcaatcacccggtcttctccttcctagcttttagatagccctgattctttattggattttaatacacttagccgtgtacgtatcttggctaaactcgaatctatagtttatttaatactgatgtactcggtaaagaatcaaaaaggtacttgaagacgactttgaatgggaggaggttttctttttatccccccctaacctgattttgatgtcttcttcgttctcagaccctatggtccattgtaggatgatttttctaaggccttgaattcgttggaaaggtgatcagggtcctcttcctggtcctatcgaaccagtgacttctctcctgggattgaatatgttttgccttttcccgatggttccgcattccaatgtgggtaggattgccaggatgagncgcttatttagcctan

SEQ ID NO: 10404 - DNA, 822 bp, Oryza sativa
  unsure (1)..(822): unsure at all n locations
cgcgaggtagaacgcttctatgnnnnnnnnnnnnnnnnnnnnnnnnnnnnnnnnnnnnnnnnnnnnnnnnnnnnnnnnnnntgaaacacatcgtggattccaaccatattagatgggagctcaagctggtaagcgacttcacctcggcgttccaaaatcctgtatggtcccacaaagcgtggtgccaatttgcctttcgtttggaaccggtgtactcccctgagcggagtgacacgaaggtacacataatcccctgcttcgaaagtaagctctcttcggcggttatcagcataactcttctgccgagactgggcaattcttagcctttctctgacggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggtagacttttatcccatgctccaccaaaatcgagcgcacacgctcgcagcatatcttccaagatctgattgaccctttcggtctgaccatcagtttgcgggtgataggccgtgctgaaattcaaacgagtccccaattcttcttgcagtttctgccaaaattttgaagtgaactgacttcctcgatcagatacaatcttcttaggtaccccatgcaaacacatgattcttgaaaggtaaagctctgccaacctttctcagtataggtagtgtgtacttggaataaaatgagcaacatttggtgagtcgaatcacgan

SEQ ID NO: 10405 - DNA, 1363 bp, Oryza sativa
  unsure (1)..(1363): unsure at all n locations
ctcttcgttttgtaaaattttttttttgaacgcccaaaaattttttaaaagaatagtaaaaatttttaagttcaaatcatctaatgatatgaagtgtatttaattaccctgtcgtgatatatattgtaggtttattctctgctgacttaccgactgcaaaccagtacaattggtctgttagtttgtagcgtagacgttcaggctgtatgccaccggccaatttcatgcttgcagattcagagtgacctgaatttgatgtgaaaatcgattcattcatacggctagcgtggcatagtgctaaaatgttttgcgtgatttacctttcccccaaagagcccagctacggtaactcgtcaaagcaaatggccaaatgctgatgcagagtcttttttaccttacatatgccactgttggcaaaaatgccaacatacagcatgggtatgatcatgcattcatgcgctttaaagttcaagtcttcaagaagcctctacgcatgagagaatatcagacgaagaacttgctggtagtatctcccaagtctccgtgaagtgataagagtcaactctaaattattcgcatctctctttgcaaatggtgtaatcttgatctctgtttctcaagtatagtttatggctgtgtttagttttccctatattcccaactttccatcacatcatatcacataaaaaactatacatgtaaactttcaattttttttttaaactctcaactttcttcaaactttcaacttttttttaaaaactaaacacaccctatataaggtttcgaattcatataattttgtgtaatttccgttcgtgttagcccgaactttgataggatgaccgtcgcctgaatttgctgtgcctagcgctacacaccacagtagtaacctgattacctgatcagtgatcacccgcgccacgcgcccatccaagatcgccgtgcacgcctctgctcagcgcgacccacgagtccacgagaagatatacgatccaccaccaccatcccgaccgtcaccttcacctcacccccgcgccatcaccagcagccgccggcactccacccccccatccccgcaccgctcgccttccactcccgcgcccaccggcttattccccacattccccgccccgatgaccaccccgttcgagccgncgccgtgcccgcaccttgccgngtaccggcacaccacgcgctcccttcgnttnctncgncgttgcctccgcgtncgcccgctcggnncgcccgagatccgccgcgagcctcgcgagctcccccggtggttcccctgcttcttccccaccttctcctngtnccggctttacgccttgctctnctgcgccgncgtcttttgcccacc

SEQ ID NO: 10406 - DNA, 902 bp, Oryza sativa
  unsure (1)..(902): unsure at all n locations
cgtggcattgaatggcnnnnnnnnnnnnnnnnnnnnnnnnnnnnnnnnnnnnnnnnnnnnnnnnnnnnnnnnnnnnnnnnnnnntcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcatcatttttcatgcatctagtttatgcattaagctatagtttagtcagtcgcattagtgtctttatccgggttcatgaaaaatgttctatgcatacaaatcatcatgcttggctagtggtttgggccatttgttgcttggtttaaatttggatttgagcatgcattgattcctatcccttgtctaccttagaagtcagacatgttcttcgatcgcaagcgccgctccgagcttcagagtcgccgcccttagctttatcgtcttcttagtctgtttgcgtgctagtttttgtgtttaggtttgttgcttgtgggttaatcggcggtcgatatcatgtgtgagtggtatgacagccttaattaggaattgcgtgcctctttttcagtgttttaatcaagattaagataattgcacttaattttataagaaagattagtttccgagccatctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaagggtaccgagctcgaattcgcccatagtagtcggttgtcatcaacgccat

SEQ ID NO: 10407 - DNA, 807 bp, Oryza sativa
  unsure (1)..(807): unsure at all n locations
tctggttagcattgtactgaaacaaacctgtgaactgctttaacaagcaagatcagagatctgacgagatcgctcactgtcacagttactgtacatggcttacttcggcggattaacataagccagtatgccaaaaacggtttgcacaattgtgcagatgaggacaatgacagtcgcactcgcagccaaagccagccatggattgctgaagtggtttagccagagccatgccatccaccgattgatgagactttgatagtgagcttccatagtctggcacagagttttaagtagtagttaccattgaaatcaaaaaccacgtctttgctgagcatggtgaagagatcagacaccctttcatcgctatcaagctggtgcacaatgatttttctctgaataagcagcgtaacgtcctctggcatgcttataagttgagacaagaaaacaatataagcagtgaagtcatctccaaattgagggcaggtttgttcaaacgcaataaggttcctgaaaagactccctgtgtactcatcaacaacaatacacggaatgtccatggaaccattgctaaaccaaatgtctagcagagaatggggttttaatttatcatattcccgtttcttaaactttattccggcttctagatattgtgcagctcgtcgccaacgattaagctgatcccctccttgtgccagatccacttcgttctggaatgatnnnnnnnnnnnnnnnnnnnnnnnnnnnnnnnnnnnnnnnnnnnnnnnnnnnnnnnnnnnnnnnnnnnnnnnnngtcatntcaagcgcgtg

SEQ ID NO: 10408 - DNA, 1373 bp, Oryza sativa
  unsure (1)..(1373): unsure at all n locations
atctgacggcactatttattggcaaccgctgtgaagtttacactgatcataagagcctaaagtacatcttcacccagcccgacttaattctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccaggacatcatcgggtcacgattcaatctgggtggtcgtggatcgactcaccaaagttgctcattttattccagtacacactacctatactgggaaaaggttggcagagctttacctttcaagaatcatgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttatnnnnnnnnnnnnnnnnnnnnnnnnnnnnnnnnnnnnnnnnnnnnnnnnnnnnnnnnnnnnnnnnnnnnnacatgcattcaatgccgc

SEQ ID NO: 10409 - DNA, 2520 bp, Oryza sativa
  unsure (1)..(2520): unsure at all n locations
cgtgggcttganatcgaacttgcaattctcnnnnnnnnnnnnnnnnnnnnnnnnnnnnnnnnnnnnnnnnnnnnnnnnnnnnnnnnnnntgatcaggttttgcaaagttcagtggagccaccactcataagaagaggccacctgggaaagagaagatgaattgaaggccgcccatccgcacctatttgtcagctcttccgaatctcggggtcgagattccgtttaaggggggtaagcttgcatgcctgaaggtcgactcttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaaaatcctttcttcttttcttttccctcctttttcctttttcttgggcccggcccattccctccagcgccggcccgcttcacctcccgcgccgaccttccctcggctgggccggtccaagccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccgcacgcccacgtcgccgcccaccttccccgcaccttccgccagctcgcgcgcccgcaaacggcgggggatttgaaatttcccccactctctctctcctcctccatttcccccacgtcgccggccaaatcggccacctttccggcctcgtccgcccccccgagcccatataaaccatccccgcactcccctccacctttttcctctttccgccgctctctcccgtgccctccatcactcccgcaccgctacacccgccgccgccgccttttccactcctccggtcgccgctcgccgccgctggagccgccgccgagccaatttgccaccgccattagcttcgccgccgccaaagctaccccggccgccgcatccccatccaatcccgccatcggggcccgcttctctccgcgcgccggtgagtaccaccatagccgccgccgtcggccatggtttccgcccgccgtagaccaccctctctccctctaacccctcacacttcctctcttagggtgtcccggagctcggccgccgttcgccgtcgcccttcggtcgctcaccgtcgtcgtttgccgtcgtttcctcccgcgccggccgaaccccggtgagaactccctctctcttcctcccgcgcgcgccgccgctccccgcatgcgcgtcgccgcgatgcaccgtcgcccgcgtcgccggccgccgtcgtcttctcgccggccgccgccgtcggaggccgcttgccgccgccgccctcgccataaccggccggccggcttgaagccgagccgagccaggccgcttttccccccccccccttgtgacgctgcccggtgggtcccgcctgccagccgcccctctccctctctcctgtgcctctgtcccgtgggtcccgcatgtcggcgccgccccaccccttgctgacgtcagccctgggatgaattattgcgcaataaattgattaagggtttttcttttatagtaataaacacagtgaatcttctaaaattcataactaattcatccgagctccgattaatcccattcaagtctcagtaaattcataaaaatgtgtagaatccattaaaaatggttttgcttcctgtttcagtagtcttatagcatgttttgcttgtgtgctttgtttgtcgcgtagatttcgcccgtttcgtcgattcgtggtttcgcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttgcctaattaaaatacactacatggtgggctgtgggtgcatggttttgctagacgtgcccatggcgattaaggaccggttcgcgggatgggtaccgagctagaattcgcctgtagtgatgcgatgtcaatcacttgcatttgtgttgtttattgttatttaggtaatgcagtgtatacaatcaaatctaaactgaatacacacacgtagaaggtataatgcagagcacagatgtgacaatctatagtgttacaccctacaa

SEQ ID NO: 10410 - DNA, 780 bp, Oryza sativa
  unsure (1)..(780): unsure at all n locations
cggctgcggaattcaccgcgccacaaaaggggggctgccccgtgccctgctgggacgggggcgaaccataaggtgtggtgcgatcggtaaaagggggttatacgaagggtcctgtcacggcctctttccggtatgtcgtggtggcatgtcggcgcacggaaccgtgtcgtgggcctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatnnnnnnnnnnnnnnnnnnnnnnnnnnnnnnnnnnnnnnnnnnnnnnnnnnnnnnngcttctgagctggcattcaaactct

SEQ ID NO: 10411 - DNA, 1750 bp, Oryza sativa
  unsure (1)..(1750): unsure at all n locations
atgcgcattaatttgagtttctgatnnnnnnnnnnnnnnnnnnnnnnnnnnnnnnnnattatactaatgtatataccttgcggcctgcaagcgtgggccaaacccaccgactaattatgctgtagatggcttcattatgcttgctggtgacacattgcactgggagtgagacatactcggagtgatttacccaacagatgctattggagagaatactgattctgggcccgattcacgttgaagctgctcagctgcagcaatggatgggttgtttgcaccatggtggagggatgatgcaagaggcatatgtataggaatcacacggttcactaacaaggggcacattgctcgagcagtgctcgagagtatgtgctttcaggtgaatgatgtcctcagctccatgcacaaggatgctggggaggcaggagaagtgaagagtgcagaaggggagttcctgctgcgcgttgatggtggtgctactgtcaacaatcttctcatgcagatccaggtaataatccttctcacgagatttaaaaagaataataaatactctgctagcttttccattggaacagtggaacatttactatcacgcagatgcgaaatttctgggttgatgagcaactacgtttaagagtaaaataattcaaataggttatcaacgttgatgttaccaccacctgaaatgttcatgcttatagttgtgcttttgacttggtgaaaatgaatgaaatgcaagatgttggctctttgtgtccctctttctatttaagggtaaccaaagcaccaattgttaccttttgcacataatgacctcttacttctgtgagtcatacttgacatgattgcagccacatctgtacagcactatgctatcaatctcaaacaggaaaaaaatatataagtactgtcttcatctgtaaacaaaacagtagtgctatgaactgttatttcaaaattcactatcttattgataactgatctttggctaatttacttatatcctcctacagtacagcttactgaaattagaagcttgagctaattagttaaatcctcttatagtattgcttactgaaattgtcttgaaaaacaatctttttaaatgcactgggtgtaattgtagctgtagcttagtgaaacgtttctctttgcaattgtaaaatctctccaaattcccataagatcactgattttgcatgcacacctgcaggctgatttattgggtagccctgttgtcagacctgctgacatcgagacaactgcccttggagctgcgtatgcagctggattagctgttggagtctggtcgaaggaacaaattttcgctggtttgcacaaggagaacaccagagtcttccgcccgaaattggatgaggcccacaggaggaagagagcagactcctggtacaaggccgtttcaagatcatttgatttggctgacctttctctttagaatgacgagggatttgtgaattacttctggattgtataaggtgcttagcacttgttatgtccatgaataagttggtcaatggaacatccttcaaaagaattagttgattccccacgctttgctgctggaattattaagtaattttcaatatacttttttaacaattgagataggagtaaaaagaaaaaataatgaaatgtcagtgtttnnnnnnnnnnnnnnnnnnnnnnnnnnnnnnnnnnnnnnnnnnnnnnnnnnnnnnnnnnnnnnnnnnggacatgcatncaatcccac

SEQ ID NO: 10412 - DNA, 11328 bp, Oryza sativa
  unsure (1)..(11328): unsure at all n locations
aggcttgaatgacnnnnnnnnnnnnnnnnnnnnnnnnnnnnnnnnnnnnnnnnnnnnnnnnnnnnnnnnnnnnnnnnnnnnnnnnntgggttgtaactttatgaaaaagctttggagtgagtgggttgtaactttatgaaaagtatagatttatcttcttggtatttatggcagaatcagatcatattgttacaatcacaaatttaaaatatcaccaatttccaccttttggttttgatcgtgttgtgaacatgtagtttacagtcatgcacacgtctcctggagcatacaaatgtttgcattgtcactatatggagatgtagcattaagaaattccaacaattcatgtacaaattctgacgggcgaacacttcagacttcggagcgagacaaaagaaagactattaatcagagtttgaaggaatctcttatgagaaccccctaatcctttttccatagtagttattgcaacggatacggaaataaaagagtttatgttgtgttgttttgagatatcgacttaaaaagaaacttatctcaaactatcgatatgtggaagagtgcattgttatcgatgtgaattggtttttaaagtagttaagatatactatttagaagacactgagcaataattgctataaagagtcagatcaatgtgttcgatgttggattatcaagcctacatcttacaattagtgctatcgacccaagtcttgataagcatatgttcgatgttgcattattgcatatgctcgatagtactaaatagggggtgtttaatgcagtggtgtaaagtttagcgtgtcacatcggattttatatagggtatcgtatagggtgttcgggtactaataaaaaagctaattataaaatccgtcagtaaacaacgagacaaatttattaagcctaattaatctgtcattagtaaatgtttaatgtagcacaacattgtcaaattatggagcaattagatttaaaagattcgtatcgcaaattagttgcaatctgtataattagttattttttagcccacatttaatacttcatacagttcaaatgtttgatagaacaaggtgtaaagttttgagatgggatctaaacatggacttttagtgcttttcacaagtacgtattgctctggtcattaataaactacaatttttctcattttccgtgttcagcagcaggtgaaatagagaagatttgtctagttttctgcgctcatactttttaaactattaaaaggtgtgttttttaaaacaatttctataggaaagttattttaataaatcatattaatccatcttgaaaatttaaaatagttaatacctaattaattatgtgctaatggctcccttcgtatcttctcaatgtttactttttctctcctgtcaaacactcccggtatactatagtttagacatgaaattttggaaggtcacttatggtgtggtggtcactatggttcaaatgttggtgtacacaaatagtatgcatattatgcttttaacagaaaattaatttaatgaggttagagatttatcgagtatgtgttagaaagtgcattcgtgcgtatgtgaatgtggtttgtcttacgtgtaattaaaaaattaataggtttttctgaaattttaatctaatttggacattgagatctataagatttattagggtactgtccagatttattgcgctgtgatatgttctattcgatgtggaggtagacaggtagtatatgattttcaatttcccctattcaaacaggcttgcaaccactggggaacgatttttttttttgacaacaggcaaatgcattacccgggctttagaaaaagcccaagagacaagggaactgttcactttgatgtcaaaaaaaaaaccttaccaaattttggcattaccaaaattttggcatagttaccagaattttggcaggatttcttatatagttaccaaaatttgatagcaaactaaatgtagccacttttttttgacaactttcccaaaatttgataaggttgaaaatggcatcaaagtgaacaagcccaaggtctttacttgggaacgatttgtgcccagccggccgagaaatttgataactcgagaaatctctcccagccagtcagcccggttctgtccagcaggcagcagcgagcaagagagttggaggcgccgccgtggagaggagggcaactgtggccatccatcacggtggagacggatctacacgcactcccaccgtcccacggattgaatctaccgatgcgggtggcggtcgaggagggaggagtgatttgccaccgtcctcctccccttctgagaaattggacattctgccactaccaatagtaggttattctgcggaatggcgtcgttaaaatgccactttcaaccgatgccaaacatttattttgctatttcagccatttcataaaattttcaccatttttcacacttcaactgaccaagatacccttctctcctgcagtttctttcacctcctcctccggcgaacatgtgggaagaggcaaggctgtgcgaggagaaggggaagagacggcgctgtgcgaggagatgttctggacaccgtcgccggcaagagaaggatgaggcggccatcctcgtgaagtgcgagcacccgggccgcgctgtagcggccgacgcggcgaggcgcgagcgcttcgaccgcatggcggcgtctgactcagcggccgcagcctgccatttgtggtcggcgtttgactcgatgacgtggcggaaggatcctcttgatggactgaagctatactccggcgacgagcactactggtccgtgagctcttcttcttcctcctctcctcctcttgatacacatgtccatcctccattcttgtttcatggctgtttcttgatttgattctgctcgtcgtttgtgacaaagcatgcgtggtgtagtcggtcgggttcacggcggcgccggtgttcgccgcggccgggatttggttcgtcgtgttcggcgtcgctcaccgctgcgtacgtaatttctccggtcacctcgccgccggtgagtaaactaaccagccgcgccattgttgcaacgtggggtgcggcgtgctgtacgatgggcaggggcggttcgacgggagcacaacagcgacggtggagtacatgacgggcaggggcggcgagcgaggtgaatatcttggcgatggagcacttcttactgttgtcccctcctcctcctagcttttgcttccagccaacgttggtcatagcggtggcgatggcgtcgtcgaggctgagcggtggtcctcgcttgtgacggtgacgaggtggtggaggtcggagagaaatactgcccggaagggtattttggtcatccaggtgtgaaattaggtagaaatagagagaattggcccaaatgccaaaacaaatgtttggcatcggttggaagtggcattttaacgacgccattccgcggaatggcattgtggcgaaacccactcttggcagtggcttaatgtccaatttctctcccctacttgcccccggtccgtcgcatacagatgccaaccggctcattcgcggcgtctcctctccctcgccccgaggtcgctcccttgtaaccactctctccgcatactatatcttctaatgcccgctcgttctgattctggagatacgacgactacttccctccgaggcaattcactgggtaaagagaaccgcaataatcctggtaggttcttcatttttatcactgtttattctaaatattactatttttttctatcctttcatgactgctggatttaatcactacttcctctgtttcacaatgtaagtcattttagtatttctcacattcatattaatgttaatgaatctaaatagatatatatgtctaaattcattaatatcaatatgaatgtgagaaatgatagaatgacttacattgtgaaacggagggagtagaaaatatgtgtcaatttgagggagtagaaaatatgtgtcaattcgatataaaggattgtgtggaactgcaccgtgtttatgagaatacagatataaaaataaggttcagcgccttttgctgtctttgcgaggggtgatcgggtgagacatcaaaggatcagtaggagtgactaatacacgagaatcatgtgaattttgagtgatcagaaatatataaggtcttatggtcttgtgcatgctgtctcaacgaaactattactggcatgtatacaacataggttcttttttttcaatgttaagtccattttctttaggcaaaccaaccctcctccaagaagaatgatccctaggatacgattagccggccttgcggttgcaaagggatttggacatcccccacgctgacttcctgccttcctgcattgggttagggagctggtcagtaatagcccctaggaggctgtgggctcaactccaagccaactcacattagtaactatttgtggatgagaaattttacagttcttgagaaagtatatagagataccaagagtttgcactaaaagttttggtacttcgagatacctagtacctataggtacctcttggtacccttttaaggatggtaaaactacccatttgtggataatcatccttcttagaggcactatacaacaactccaataagaaaactgaatgctgtgttaatgatgggaagtatcagggagagcaaattgtgttgcaactttgcatgcttactcttgttattatcagttatcgcatatcgcctccctcttcacgtttgcgagaaaatgaggttattcgtaagattcattgggatattttatcaaactaagaggaaccttttcaccacatggttttctattgatgtctatccatcttatattgtgccctgttcttcaaaggaaaattagctgatgttttcttcactactttttttttagaattacacagtacaacgcagacactcataacgcacgcgcactcacccctataaacacacgcacgcaaaccctacccctatgagcatcttcgtagactgggccggcaaattctggaaagattgacgaacgcaaaccctacccctatgagcatcttcgaagactgggccggcaaattcttttttttttagaattacacagtacaacgcagacactcataacgcacgcgcactcacccctataaacacacgcacgcaaaccctacccctatgagcatcttcgtagactgggctggcaaattctggagagattgacgaacgcaaaccctacccctatgagcatcttcgaagactgggccggcaaattctggagagaatgacgaagtcaccacaggcgcttcgctgtcgacgggtacgtcgtctaccactgaaaccacaacgccgttaaatcctagaaaattcgctcctatggggagtcgaactcaggacctcagatgctactgagactcttgtaaccactaggctacaggcccttttacttgttcactactttcttataagttataagggaactatacaggtacgaggcatgctaattttgaatttctttcctcgaatacttagtctattcataaaatcatcctgtaggaaagtgcagttggattttttatattgtcatgtcaataaaaatgactcctggcaaaagcagccaatctgatttagtagatatggagaagatggtgaattctatcactagagaaatagatctgtactggtctgcggttgagtctgatgaaggaaataagctatgctcaatccacaaagtgccgcaacatattcttgaggttgataggaatgcttatgagccaataattctatcaatcggcccatatcaccatggagctcctaagctgacagccatggagagagaaaaatggaagtgtttagactttattctcaagttgaattgtgaattaagtttgcaggattacataagagcaattcataaactggagaagcaagcaagatgttattactctgaggagataccaatggaaaaaatgatgtttgtgaggttgcttttgcttgattcatgcttcatcttagtaaaagttgatagaactgttgtagcagcaatgcaattaaaagaggtgccaacagatgttactccgggaagtattgctgttaaagatggtctaaactctggtcaagaagttgaaagcaactgtcctatgcaaagacgtgaaactgagattgcggtgcatgaaattgaactaactaaatctcattttgatcatattgagtccaaaagtaatagaacggagcatgagcaaaatgctgactatgcatctggttgcaataattctggagattggtatgctaactatgcttggcatgatttgttcttgctggaaaatcaaatgcctttcttcattgttgaggcagtatacaatttagctttaagcaaacagagcaaaggcctttcttagagacaaaattgtcgaatgtgtagaagatatcctgcgtcaatttccaaaaggcattgaagaatctaaaaagcctaagaatttttatcatttgctgcacttatgtcatatctacctgcggccaacccataagtgtgttgggactaatcaaaatcactcaaaggtacggttttttcatcatctagtttatttaggacagaggtatgttggttctaaccaaaaggaaaatgaggaatcccgactgctaactcgccagaaggattgcttccaagatgagcaattaccaattcgatggcgtcaagcagtacaataccatgaagcaggagttcaactgaagaaaagggtatacagcatctatgagaaacattctctcttggacataaagttcagtaatggagttctagaagtcccatgtcttactatcgatgagaataccgagtctctgttcaagaatttaattgcatttgagcaaatggattctcaatatgaaaactatatcacagcttatatcgcttttatgtctcagcttgtaagcacttctgaggatgccactctacttactgagagagggataattgttcatatgctggataatgacgatgaagtgtcagctatgttcaccaggctcagcacacatttgatatttggttctgatacctaccactaccttcaaactttatcctatgttttggaggaccattaccaaagcaggctgaacagatggatggcttggctctggcgtaatcacttcagcaatccatggttagcattaggtgtgttggctgcagtggtcgtcctactctgtaccattgttcagaccatattaacagtcctagcctacaggcaaccccattgatgatggcatttttattctctttctaagtgaacacattcctatttcttgttcaatttggtactggtatatatgttatctggtgagaatactactgacaggtatgtatccaattgaaatatgatgctagagtaaagtgcaactcaccttagatcatcccggtataaagtgaaacacgatgtaatttacctggtgcgaagtataatgtactagaaaaacagtaatttgcatggtcttcgattagtaatgtgaaacctatcctacttaacattcttttcaaataatgagaattccctttgcaattgcgtgacttgacaccattacatgtttgtatttagagttagaattataatgtgtgcaattactgtgtttgttgtttaaaataaaattgtacttctttcaacatttttgtatcaatcaataccactggaatctaggccactacaatcaacagtgtagaactaatttttgctcataaccttcgtaatttctaatccttgagagcaaacttgatgatttcttttaaccttttatgtactttagtttaatataacaaacataagaagtcttttaggaatatatagctctcttgtgcagcattgcaatagaaactactcacaattttacatgatggtatgcttgcatgtgtaatatttgtactaaatttactaccctccattgaaactaacatcattttctgggacttctattctacatattaagcaacaggacaaattatttatttagcaatagtgaactaaagggtttgttcagattgatgccatttcaaaccatatcatttttttggtagaattgccgaatatgcgcatccatttagtttttttttgtcaaactttgataaatacataagaaattctgccaaaattttggcaatttaaaaatttggtaagatttattttggctacaatctggacagcccctaagaatattgtgggggtccctttattttcccacgtgcatgctttaaatagaatctactagatatttgattccccctagttcgctatgctaagtgcatttgatcgaaactataccatgtgactagagttgggatcacattttacattactatataaataggcatgcgagctgcttatttcatcatctcgttttcacttccttgcagcgaaagatggttgtcaaagcagcgttcgcagttgccatgtttttgctcacaaccaatatgctcgtttctgttgccacacggtctccggataacctcctaaactcttttcctgaagaaacgggtcacgtctactcagcgtcaactgtgcagaagatgaccgaatacaagcccacgactggttagcatttcattgttctattacaatcgcttaatctttttttttctgattctttcgactcgcttaaatgttagagtatttgcacacctcatacctgacgctggactctctttttcttgacagctcaaggtcccggattcagttccgaagagaaaatagtcatgactgggcccaataattttgtctggccgacgcgccctgcaccgtgcagctcacgaacctgctaaatcaaccacagcttttgctgcatgcgacgtcgctgagatgatcaaaatatctttctatatctgccattttctctgtattgtcgaactgctgatgaactatggtcggaacgcttaaataaaaagcaaaggaagagtgagagagacacaaaattcttgttttacgatcttatcaccactcgtttactatgtttccgtttaattaaatgtggtattgcgatggatgataaaactagttataacccaacgatgcctcctggatgatccatgtaatggaccgaatggtagccatccaatgcagaaaaaactggcaaaatagagttgaacaatcgtagattcgtagtcaaactggtgattgaaccgtttttacggtagcgctaaatcgctaatcgcgcagtgctacgctcgattagtagcgcgcctcatggagcccggtttctcgttttttttctgttttccaacacgcacaacaccgttttattatttttccgccgcactccactcttcttcacataataacagagtaaaacaattgctccaatcccctctagcactctccaacaccgttaggctgtgttcttttatccatttcctaacttcttcttcctcatttttcgcatgcgtgctttttaaataattgaacgatatgtttttttaaaaaaaaactatagaaaacttgttttaaaaataatactaacatatttttcaagttattttagtttatgtgtaattaattatacactaatccccagaggtatgggttgggaatcacccataccccaacccatacctctcaacaccaaaatccccatttcgcgcataggaatgtgtcacgctcaccatgcgaccagccacgtggcacgctgggagaggcgagtgggtcggcgtgcacgtgggcgaggggagatggaacgacacatttttttatacattgtatatgtatatatttttatacgtaaaaaattatgtatgtatataaaatatatatacacttcacatacatacatacgtatatattttgtatacgcgtatgtaaaatttatacctatgaatataaaatatatacatatgtacagtaccagagaggggatgcgcgggggaggggtgtttgcgcaggcacacattagagcaggtacaatagcaagttataagccagttataaccacatatcgagaagaaaagataaaagagagagaagaaagcggctacagatttgtagccggctgcaacacggactccaaaacattatgtgtgtatgataggtgggaccggtattaatggtgtagtatatttttatagttaacaattatatgaatgtgctattagattaattatagatgatttggagtcattaattggctatagtattatacttgctcttagccccctctccccagtccccacaccccacagccttattaattatgctcccacgaaggaggtatggagtattcggttcaatcgttttctataatcttggaatttaaccagaccagactgaaattaagggtggagctcattggtccggaggacgactagtaaaatatgttttctaaaaggcctatagtgtaacgcgtgtcgggatttggcctgctaatatctccgcctcttcgcgagctctaaacgggacgaaatatattttgcaaaacctgataaaatttgctctatgaaactatatatttgtgacatttacgacatgacactataattttttagaaacatggtacaaatgctggcgtttataacacgtgtacactcacacgtacactttacctttataagtagcttcaaaagacttggtcgatatatcttgaaattgataaaagtcactatgacgtcttactgtcgatgagtacgtcgcctgccactgaaagaataattaaccgtaaatacgagtacccgtgtcaagtgtagaacttgtacccaggtcgattggttctaccaagtaacctaattacttcatccgtttcatattataagactttttagcattactcacattcatatatatgttaatgaatatatatatatatatatatatgtatgtgtgtgtatatatatgtgtgtatatgtatatatgtgtatatatgtatatgtctatatatatatatagacatgtatatgtctatacatatatatatatatacaattacatctcacgagaagcggagcgttacaattatacagtacaacgcatacactcacaacacacgcacactcacccttatgaacatacgcacgcaaacactacccctatgagcatcttcgaagactgggccggtaaatccatcctggagattgacatcacccaggcacctcgctgtcgacgggtacgtcgcctaccactgaaagcacaaagccgttaaatcttgcaaaattcactccatgggaagtcgaacccattacctatggtgctactgaggctatgtatttaaannnnnnnnnnnnnnnnnnnnnnnnnnnnnnnnnnnnnnnnnnnnnnnnnnnnnnnnnnnnnnnnnnnnnnnnnnnnacaaaggccatc

SEQ ID NO: 10413 - DNA, 1962 bp, Oryza sativa
  unsure (1)..(1962): unsure at all n locations
cttgagttttcgaagtcacccttcacatgaccctcggtttcgattaaaggtggctcccattaaaagattattaggccataaatcggaccctcatatcaactccagaactcatcgggttagttctcttagacggaatctattaagtaaagtccgctcattccgcgtaattttgatttttttggtttgtatcctttcctatgccttaaattatgcattttgtgcaaaaaaaaagtttatataccaaaaaacgatgcattatcctcgcaaaaaaaatgatgcattatagtaattctttcgaaatattttttgcaaagtacttttctcaactttatagtagttattgattcatttatacctcaggttgctataaaagaaacagattattgcatcaatttcagctatctcagacgcggccgatatcttccatgtaaattcactgtgaaactcgtgcattccatctgaaaacttacccttcattcctctttccccagtccccttctttcctcgcctcccctgagtcatcacagtcacaaacgtcatgcgcggatcgggcagtgagcgatgggagcccacgagcgaccgtaaaattagccatccgcaaccgcaagagataatgagatgtgttgatgatcaggtaccgctcctaattggcttaaccaatcaatctatatgactgtagcccgcctggatccggctgatccgaattttgctgatactttttccggaagattttccagctcccaagagaaatcctaccgaataaacgcatttctgtagcatcgtcgtccgtatcatttcgtcgagggattacaggcacctgtaagcaataaccctacctttcctcaacaggctcgcatcccatcgtgagaatttcgtctgcgtttcacaggttccttcgttctcctttatattacccgtcgatagtaatccccgtttaattctaatacgtttatggatgaaatatgaaaggaaaagagatatggcatctattgaaatgagatggagaatgtcttgaatatcgatttttgttttattttgtcgtatacttctgttcaaggatggagattgaaacacagaacaaacatgtatgagtttaaaataggaaaaatgctaaaatttactgctagtgcataatttatatacttaatactcctatattgtttcttccgtttgattcagtatttgttactcccttgttccatgttacaagtcgttttgatttttttaaaaaaactttgttaagtttgataaatgtatagaaaattttagcaacatttataataccaaattagtttcattaaatttagtattgaatatattctgataatatgtttgttttgtgttgaaaatactcctatgttattctgaaaacaagtttgactagaaaaaaaaaatcaaaactacttatagtatgagacggatggagtatgtgtaaattgtgatccatatatttgtgtggtaaatattggatatgacaaactttttcatagcccttaccattactaagtttggttccaacttttttttccctggccagatattaggtgcactcaggatgaatcaatgtgctattgttgaattattgcaatctttgatgaaaagttgctcattatgctttattatttttatgccggatattcaactatataatattccctctgtataattggccttttcacatcttaggagttcgatagtaaatgtttagtattgctgatcagtttaaccatgaaagatacctcaacaggtgaggatgcggcaagttcagagaagtaaaaacaagcaaataaacatgagtgaactggttaactccatgacgcaagaacttgattattattggtcactgggcactgatattgataatggaacagaatcatgctnnnnnnnnnnnnnnnnnnnnnnnnnnnnnnnnnnnnnnnnnnnnnnnnnnnnagactaggcggacaaagcaatcaaggcccg

SEQ ID NO: 10414 - DNA, 900 bp, Oryza sativa
  unsure (1)..(900): unsure at all n locations
cggcttgatgacngctctcttnnnnnnnnnnnnnnnnnnnnnnnnnnnnnnnnnnnnnnnnnnnnnnnnnnnnnnnnnnntgccatttgcaaactggcttgataactgttgttgtaagagaattccgcataaggtagacttttatcccatgctccaccaaaatcgagcgcacacgctcgcagcatatcttccaagatctgattgaccctttcggtctgaccatcagtttgcgggtgataggccgtgctgaaattcaaacgagtccccaattcttcttgcagtttctgccaaaattttgaagtgaactgactccctcgatcagatacaatcttcttaggtaccccatgcaaacacatgattcttgaaaggtaaagctctgccaaccttttcccagtataggtagtgtgtactggaataaaatgagcaactttggtgagtcgatccacgaccacccagattgaatcgtgacccgatgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggcttttnnnnnnnnnnnnnnnnnnnnnnnnnnnnnnnnnnnnnnnnnnnnnnnnnnnnnnnnnnnatnagagcngcaatcatgccgg

SEQ ID NO: 10415 - DNA, 796 bp, Oryza sativa
  unsure (1)..(796): unsure at all n locations
gtgggnnnnnnnnnnnnnnnnnnnnnnnnnnnnnnnnnnnnnnnnnnnnnnnnnnnnnnnnnnnnnnnnnnnnnnnnnnnnnnnttcggtccattacatggatcatccaggaggcatcgttgggttataactagttttatcatccatcgcaataccacatttaattaaacggaaacatagtaaacgagtggtgataagatcgtaaaacaagaattttgtgtctctctcactcttcctttgctttttatttaagcgttccgaccatagttcatcagcagttcgacaatacagagaaaatggcagatatagaaagatattttgatcatctcagcgacgtcgcatgcagcaaaagctgtggttgatttagcaggttcgtgagctgcacggtgcaaggcgcgtcggccagacaaaattattgggcccagtcatgactattttctcttcggaactgaatccgggaccttgagctgtcaagaaaaagagagtccagcgtcaggtatgaggtgtgcaaatactctaacatttaagcgagtcgaaagaatcagaaaaaaaaagattaagcgattgtaatagaacaatgaaatgctaaccagtcgtgggcttgtattcggtcatcttctgcacagttgacgctgagtagacgtgacccgtttcttcaggaaaagagttaggagggtattcggagaccgtgtggaacagaaacgagcatattggttgtgagcaaaacatggcaactgcgaacgctgctttgacaaccattttttgttgcaaggagttgaaaccagatgatgaatat

SEQ ID NO: 10416 - DNA, 882 bp, Oryza sativa
  unsure (1)..(882): unsure at all n locations
tgaagcgattcaccgggacacccgggcggaccaaactccatcacgccaaccctcgcgtgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgcgaaaccacgaatcgacgaaacgggcgaaatctacgcgacaaacaaagcacacaagcaaaacatgctataagactactgaaacaggaagcaaaaccatttttaatggattctacacatttttatgaatttactgagacttgaatgggattaatcggagctcggatgaattagttatgaattttagaagattcactgtgtttattactataaaagaaaaacccttaatcaatttattgcgcaataattnnnnnnnnnnnnnnnnnnnnnnnnnnnnnnnnnnnnnnnnnnnnnnnnnnnnnnnnnngtnagagatgcagtcaatcccgc

SEQ ID NO: 10417 - DNA, 990 bp, Oryza sativa
  unsure (1)..(990): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctatgtgattcgctacgcttgcttgcgctccaccccgtaagctaactatattgcctagcggttagcgacacttttccggtagtacgaatcgctacgcttcgcttctttttcaccgtcggttgctgcgctccctgcgggtaatagcaagagagtgaagaacgaacgatcatcagttagcagtgaatgagtccgacttgagttcgtgagtcaaaggcgtggcaagagagcgagttcgactcgcgaacgacctgcaagtgaaggaccgatcctttaacgccagtactgttgcgagactggtacttgggggctcacgagcaacatatagactaaggttgcccatcactcccttgctcctttttgaaggcccaccgctccccctttctttaagcatctatcccggcttgcattttggggcgagtactacagttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10418 - DNA, 803 bp, Oryza sativa
  unsure (1)..(803): unsure at all n locations
cgcggccttgaattgcactccagtctnnnnnnnnnnnnnnnnnnnnnnnnnnnnnnnnnnnnnnnnnnnnnnnnnnnnnnnnnnnnnntactgagagagggataattgttcatatgctggataatgacgatgaagtgtcagctatgttcaccaggctcagcacacatttgatatttggttctgatacctaccactaccttcaaactttatcctatgttttggaggaccattaccaaagcaggctgaacagatggatggcttggctctggcgtaatcacttcagcaatccatggttagcattaggtgtgttggctgcagtggtcgtcctactctgtaccattgttcagaccatattaacagtcctagcctacaggcaaccccattgatgatggcatttttattctctttctaagtgaacacattcctatttcttgttcaatttggtactggtatatatgttatctggtgagaatactactgacaggtatgtatccaattgaaatatgatgctagagtaaagtgcaactcaccttagatcatcccggtataaagtgaaacacgatgtaatttacctggtgcgaagtataatgtactagaaaaacagtaatttgcatggtcttcgattagtaatgtgaaacctatcctacttaacattcttttcaaataatgagaattccctttgcaattgcgtgacttgacaccattacatgtttgtatttagagttagaattataatgtgtgcaatactgtgtttgttggttaaaataaaattgtacttctctcaacatttgttggataaatat

SEQ ID NO: 10419 - DNA, 801 bp, Oryza sativa
  unsure (1)..(801): unsure at all n locations
gcgcgcattgaactgaacgtctgctatgaaannnnnnnnnnnnnnnnnnnnnnnnnnnnnnnnnnnnnnnnnnnnnnnnnnnnnnnnnnataccacaggggagtaccatctcaccggtccttatgaacagctttccccactgaatcattagatcacccgcttatgttccctagttgtccaggtgtgacctagtttgcttagtaagtatggaaggacaaaagacgagtacagatgactactattctccggcagaaagtcactcatttcctcttaaaggcatatttccctgaaaaaaagatatgagtaaaaaactcttccaaatcaaagatttgcctattcttcgtagtacgagaatactcttacttctcattgacacagacgagaaagaagtagaataaaggcagaatgttagtaaaaggaaaagaaaaatccattatatatgctatatctcattcactgagtagtgcaataagcaactattcgttgacatcgactcacttatacttgaagacaggaacatagtaaagtcagctaatccattgacacattgtctattctaagacaagaaaaaagagtaactgaagaatagtactctttctattgtcatttcctatgaatctttcttcattgaaaagatattgtgcatttaccggatttcctgtcatagatagtctagtgaagctagcttactaatgccaagaactactacttaccaaacctatccttactaataaacggctatatgaaatcttattattctatttctatattaactcatattctagtttcggaaagctatac

SEQ ID NO: 10420 - DNA, 797 bp, Oryza sativa
  unsure (1)..(797): unsure at all n locations
gtggcatgaatgaatgtcnnnnnnnnnnnnnnnnnnnnnnnnnnnnnnnnnnnnnnnnnnnnnnnnnnnnnnnnnnnnnnnnnnnatctgaagtggctcagtgcgctgtctttggttaccacatgaagatactgggatgctgacaatcctcctcttacagttcttcatccgattatgctcactttcgagttgtatggctttgtccacaagtttctcaaaatcttcatattcctctaggagtagttgcactgcgatctcatcttttaacgcctggagaaacttctcttggatgtcttcatcattttccacatcttccggtgcatagtgagccaaacgatggaactcgtgcaggtactctgtgacggtcaaatcttcttgattcaggtagcggaactctcgttttctcagtgtgatcattcctgcgggaacatgtgatatcttgaatacagatgaaaactcgtcctaggtgatggtatgtccttctggccgtgatgcttcgtagctatcccaccattctgaagccagtccaaccaactgatgagttgcgaagacaacccgctcctggtttgtgcactgaaccaaccccagcttcttctcgactgtgcgcaaccaatcactgccttccataagatcgacggcaatggcaaaggttggagtcttagtttttagaaattctgataactggcactgttgctgcactggaggttcttgaacgtcggttgccctgcttgggtggttcaattctgaatagttgaaagggtttgccaacttttggtttgttaaccacaatttgaata

SEQ ID NO: 10421 - DNA, 803 bp, Oryza sativa
  unsure (1)..(803): unsure at all n locations
gcggcattgaatgacatacagnctcnnnnnnnnnnnnnnnnnnnnnnnnnnnnnnnnnnnnnnnnnnnnnnnnnnnnnnnnnnnnnnctctctagtgatgtcttcagatcaggcagttgtctatgccgctttgcatcattgtcagataagggcttgtccgtatctccgtatgttgtcattcagagatctctcttatttatgtttgattggatatggggcacccgacaccagatacattgatatatacaacattcgtttcatactataagccgttttgactttttttttaagtcaaccttatttagctttggccaaattttataaaaaaaatataataatttttcaacataaaacaaagaagctattaaaatatatttaatggtagatttaataaaactaatttaatgttataaatgttactgtatttttctataaacctagtaaaacttcttaacttagttaatttttttaaaaaaatcaaaacgacttataatattaaacagagggagtagacgagtagtgtatattgataagtgatgagtccagcctacctgaataattcttttgagttaatatggaatgaattatgtaggaggtatccatttggacaccacttcagagttcaagttgatgtcaagtgctccattaagcacactgatgtagtcccttttctgtagtaagaaaaaggcaataagctagataaccttccattgcaattgtaatgctactcatagctaatgctgtagggacactttgatggtccaccaaatcagaaatattacaatgacaaaccttgtctgtat

SEQ ID NO: 10422 - DNA, 799 bp, Oryza sativa
  unsure (1)..(799): unsure at all n locations
gtggcctttgatttgcatgacacntnnnnnnnnnnnnnnnnnnnnnnnnnnnnnnnnnnnnnnnnnnnnnnnnnnnnnnnnnnnnnnnnnnnncttctgagtggtggctccactgaactttgcaaaacctgatcaccttgcttctggtctttctctcactggtctcaaggatacgaatcggcttctccacataagtcagatcttcctggatgtcaatgtgctctgagctagcttgttcctcaggtaccctcaaacacttcttcaattgagatacatgaaacacatcgtggattccaaccatattagatgggagctcaagctggtaagcgacttcacctcggcgttccaaaatcctgtatggtcccacaaagcgtggtgccaatttgcctttcgtttggaaccggtgtactcccctgagcggagtgacacgaaggtacacataatcccctgcttcgaaagtaagctctcttcggcggttatcagcataactcttctgccgagactgggcaattcttagcctttctctgacggttctgactttctcctctgcttcagttaatacttccgtcccaaacaattggcgttctccagtttgatcccagaagagcggagtgcggcattttcgtccgtacaacgcttaaacggtgccatttgcaaactggcttgataactggttgttgtaagagaattccccataagggagacttttattccatgctncaccaaaaatcaaccgcccacgcctcgcagcataatcttccaagatctgattgaccttttcggtctgcacatcaattgn

SEQ ID NO: 10423 - DNA, 777 bp, Oryza sativa
  unsure (1)..(777): unsure at all n locations
atgcgcttgcttgcnnnnnnnnnnnnnnnnnnnnnnnnnnnnnnnnnnnnnnnnnnnnnnnnnnnnnnnnnnnnnnnnnnnnnnnnnnnnnnnnntataggtgtactcatctcatcataataatccttcctaaagatggttagcgctagaaaagacaaggtcatcatccttgtagtaatataaagctcgtaaagactccaatagatattttgatcagcataataccacccaatatgtcttgcttctctaccaattccctcttcctagatgcgaaattatccataactacagacgtatgatctacttcacctttactgccgagctctgggcagagactttgacctaaagaacttaaagaatctgggagtagcttcaatgaatcacgaaacaccatcctcctgagtagtccctttggcgactaaacgcgctttgtaccgctcaatcgtacagtcggacttgcgtttggttttgtaaacccacaacctaccaattatattgtagttaggactaggtggtaccagtacccaagtgccattatttgcaagagctgaaatctctgaagccatagcagagcgccactgtggatgtttaacagcccctgaataacatgttggtttagtctcttgattggaaggaggcaatggatgcagggtagatgagtaggcaatgaaatcagggaatttctgaggtttcatagtgcgatctgtggttcgagtggtcataaagtgtgtcggttggtgagagtgttaacgacatggggaaggaggaggtggacct

SEQ ID NO: 10424 - DNA, 884 bp, Oryza sativa
  unsure (1)..(884): unsure at all n locations
agaggttgtgctaagtcatagtgtcgtccatcgtgaacgcggtggatcgatcgatctggccggtcggtgtagtaggatcgatctggcggcccaatctgtgaaccgcngcntgcaccgggtcaccgcgaaccctagccaatgacgcaatanttccctttccctttcagaaaataattcattattgcgtcataattcaattaaaatctatataagtgttttaaaccgatttaatctttgaaaattcataactaattcatcttagctcggatttagttggttcaagtctctaaatttttctaaaattgagatctacatgttaaaaatatctacatgtactgttcatgcttgttaatgtgctgttttggtgttttgctcctttctgtttagattccgacgtttccggagagtccgttttcgcaggagaagaatttgaagagttccaaggccagcaagtgtcacgccctgaagtacccctcccttactctaaattcataaaataaatcattcgaagaaattgtttaatttaacctagagatgaatccctaagtaataaatgcaaataataatcggaatcgacatgtagaatttctcttggattctacatgtcaaaatatgctaacaggatttttagtggaattttcagagccttggaaataattttaaccaattaaaataagcaaagtgcaatattaaatccctggaaaatcttttcttctttttctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10425 - DNA, 783 bp, Oryza sativa
  unsure (1)..(783): unsure at all n locations
cgcgctacagtggacccatacgctacacgccgaanncgagctcggtacccatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaagataatgatcagacaataagaagtccagcagtaaaactatttgggaaggcgtcaaagtatatcaagtgggataagttggttctcttgggaagcataattcaaaggcaaagttatcgacccttgcatcaaatagaagaagtagctatcacccggagaccaggaaaactaatatgaggcagttggtggcaagttagaagtaaatgacaagcatggtattctcatgatgacaagcatggtatcttagtaatgacgagctgatctcgacgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10426 - DNA, 6532 bp, Oryza sativa
ctaagatgcaattgaaaggtcaatcctgagagaaaatgtagaaaattattagggcaccgcatcattctgaatttaagtcttccaaacacatataatttgtgatgaactgaagcagcacatttcctctaaaagtcatagaagtgtggataaatcgacatcaaactctagtcgacagaaggttttttttgtctacaccggaagatgatagtcaaagtgtcaggaaaagctccattatgaagtaatattatagcctaatctcaaacaatcaaagcagttttgtagtttttttttgttcgatatgctttaaaaactattcagatcaaatgaaatcaatttgtttcgtaatgcactcaacacaataaacacaaataatcagctgattatagttggaactgcaattgttttcctcaacaaaattagtgtgcactctcattaggaactaaagtacaatcagtagtgctgctaaataggacagcaggagaccaaaatttggtgctgctaactggaaagcgaattacatatacatggagctagcagtactcacgattcaattcctcaattaccccattgcatgccttgccatcactacaagaaatatgatcttctgtgacgaattcctcgtgacatcggagctcttcgtcattagcacattccattttatgacgattagtatgagatgaggatggcttagtgacgaaaaaaatgtgttcgtcattaacaccaactagaaatcgtcataaagtatttcaatgggacattgtgacgaatattaatttgtcatagatatatataatgcatttcttgaaaaaaatatactccctctatcccataatataaggcgcggtaaaagctggcacggtctccaaaactaatatttagcttataatttctcatatactataagatttatagcaacaaaactataatcatatgaaagtaaatttaaatatcaatctaatgatataatttttaacaaataaaatattttatattatactaagtgttggccaaatgtttaaaagttgaatcttgaaatatgtgcacaccttacattatgggatggatggagtattaaaagttaacgcaatttaatcaagtgaattaatgaggaaactaaaattttcctttaaaaatcatggacggaaatattttttgtaatattttacgtggtctaaattattattttaaatttttcgtgaattttcagagctcaataactaattttaataccacaaaacttatttaacctattaaaataaatagaaaacaaattaaaattcctctctatgtacttgggcctttttcagcccaagtattactctatccctccctcagcccgcagcctatctctccctcttcctccctcttcgggccgccggcccagcctttttgctacccctcgccgaaaagtccattttacctccctcctctaaattcaaataacttttcaggtagcaaagatttcaaatgaaaaaattgtcaataataattgtataacttatcaagatctacaacttttttttggtcatttttctatatgactttgtttcaataatttgaatttgaatttcaaattatgacaacttcaaacatcactttcaaatactaaatgatttcaattgaaaaagtcatcaacaacaaagttgtataactcatcaatatctataagttttatttttgtcattttgctatatgactttgtttcgataatttgaatttgaatttcaaattatgacaactttaaacaacattttcaaatactaaacaacctcaactgaaaaagtcatcaacaacaaagttgtataactcattaataactataacttttattttggtcatttattcatccgataaagtgatagtaacattgttcacaaaatttacacacctctcttataatttatgaaaccatatggaagatttgtaaaatttatgaacaatgttaaaaaatactttatcagatgaacaaatgaccaaaataagaattgtagatctagatggattatacaactttgttgttgatgacttttttcagttgaagtcgttcactaataaaattttctatttgaagttctcaaactttgaatttcaaatttcaaattgtttaaatagagttagattgaggaattaccaaaatagaaattttggttcttgatgagttctacaactttaatttaggtgacttttccatttgaaatcatttattaaccccaatttttgttcgaagttgtcaaattctaaaaattcaaaatttgaattgttcaaatgaacttatttgtaaaaaagaccaatacaatagttgtagatctcgatgagttctaaaattttgttgtttgtgatttttgcatttgaaacataaaaagcagcctaaaattaaatttgatgttgttcataaattaaaattaaaaataccataagatcattcatgtttaggcccaaatggcccaactatttctgaccgtccatctccgatctaatagttctcatcgccatccctaaccttagccccatataaaaccctcctctccacccctcccccctctctctctctccaccctcagccgccacactaccatccattctcctctactctcctctcctctcctctcctctcctctccggcttactccccccctcaccgcttaccgcgccgcctccgtctctgccgctgccaggctcgggagcggcggatctgccgccgacagcgccggcatccgtctccgcctcttcacggcggcgtctgagccggggcaggtatccctcccattccctcacctcccctctcacctctcctctctcggcgcggattccggccggagcagctgccggagggcggtggcggcggcggctccaggcggttcctgcgcggaaggtggaggcggcggcggtggcggctcccctccctcctcccagatccggtggaggcggcggcggctcccctcccgcccgtgtacctcccgcgccagcccgccgcgcccctgctcctcgcgctcgacatcggctcgcgggttttcctcgctctctcacgcgcgaagtagttcggtcgtggtggagggatggactcgtgggttttttttctttttgttcgcagggactctgataaagctggtgtacacggcgagctgcggtggcggaggcgcggagctgcggtttgccaagttcgagaggcggaggctgcaggagtgttttgacttcgtcagggcgcagggtctcgtcccccctcaccgcttccccagtgtagcatcaccaccatggcgacgcagcggaggcacgcggctgtggcatggacacctactaccgccgccacctctccgggcagcagccgggagtacatgaaggccaaatgcagcatgtaatgcgctgatttaaacacgtacgaaaaggctaattctgcacaatatctttccttttcttatatggtacatgaattattcattatcccaaaatatttgtaaatgctatgtgcagattataaaagctgttctgtaggaggaaaatcattcttgaagattgagtatcatgaattcctacatctagacagtctcgatgttatataaagaactgtataatttggtaagtactgatacaatgaatgtcagtgattcccatgtagcagataactgcaataacccttcaatcaaatctgggatgaaacgtgtagttgggaattattgccatgttgattagtcctatttctgatggtgtcgaaccaagcagtacaactgtagaagtagtagctttgcttacagagttggatatgctaagcattacaaatgcataggtggctagaatattagttcatttcatggaaagtaattgtacatgtagagcttacaattgtatcctgatctgaatgattattggtgtgtctgcaattgtacatgtagagcttccaattgttaaaatttagaccatcatgtcatagaattgcttaaggtgacataaattcagtaggaccctcattcttgatgattttgggttgtcatgcatcaaaggaaccttcaggaagtttcaaaaagtcccacataattgggttattactaaatggagctgctattgcttctctctttgaagttatcatgctaattaaggcaagggcacttatgagatgtatgtgtttgtgtaatacatgaaattgtacctcttcagttctgtagttacgcagccaatggcgcagcgagcttgtttttttatgatgaaatggctagcttcggtagctgatttagagttttgcagcagcaaaataaaacgtgatagctgaaggaaaatcttggatttatggtagtattcatgcacatcaactggcattagacaatctcacattttgcttgcttaatttacacataatcaaagcttaattctatatataacatcaggattttgttgtgcctaagtaacacctcttttgctatggatagatgaatcggaagcaacaaggaagcatatgcccttttgtcgtttgattggccgcaacactcaggtcagcctcaataaggtttttgtctattctcttaatgttaccttgctaattcaagatcttttgattcgtgtgatttggatatgactttgcttaggtcaatgtgtgaacggctatttggcatttggctggatttggtggtcagtgacttgtactagtgatgtattatatctggtcagtgaacctgtgatgtaattgaacatgctttggatagtgatttgtggatgtaattagctgacttgtcatgtaactgatttacggataacctgtgatcttttttttttctgaatttatgatagcctgttttgtgattatgtattaaatgtgagctgaattttgttaattgggctataagatgtcagatttagattttaattgggctaattctgtttgatatatgggctttttgagtgtgcatggctgtcacaccctgaagttcttctctcaagcctaaattgaatttataaatggtcctaagaaaataccggtgtaaaagcaagagtgaaaccctaaaggaacaagagtgaaaccctaaaggaattaatgtaaataataatcggaattagcatgtggaatttttcttgagttttacatgtcgaaatacgctaacaagatttttagtgaaatttcagagctctaagaaataattttaaccaattaaaaatgagcacaagcaatttttaattccctggaaattcttttcctcctttttctttcttttttcccttcctttttctttttgggatgggccgccggcccattctctccttccctcctttttcccgctgggccggccgacagaaccggtcgcccgacttcctctcccggggtcgccgacaggtggggcccacctgtcgggtcctcccccaacctctagccgccgccaccgcgctccgcaaccgccgccgcgcccacgctcccgcctcctccgggccacgtcggccacgcccgcgcgtgcgcccgcgtctcccgcgcccactccctctctctcccgcccgcgcccgcgctcgagacgacgggattcgattttcgaatcccgcctctctctcctctcccacttcccccacgtcggccggccattcccgcctctcccggccacatccgagctccctttcccctatttaagcatccccactctcccctctctctttttccccattttgccaagcttccccgtgccctctatcgccctagcgccgtcgccctcctctccgccgccgccatcgccgctccggtcgccgctagccgccgtgctgagccgcgccgttgcgttcgccgttgtgcgggccgtcccgtccacccctcctccgtcggaatccactaccggaatccactccatgccgtgcgccggtgagcaccgccatggccgccggctttggccggcgtcctcgccctctcccattttcctctctccctttaatccctctcatcttgttcgctaggtggttccagagctcgtcccgccatcgccgtcgccctccgtcgctcgccgtcgccgatcgtcgccggtgaggcccctcctcccctttctccctctctcccgcgccgttagccgccgcgccgccgcctaaccgcttagccaccgctatcgccacccgcgtcgccgcgacgccgtcgtcttccgccgcgggccggtcgccgctgtgtgcgcgccgcgccgccgcgcgccatggccgccgggccggcttgagccgtgcccgcgcgcgccggccgcgagccgcatccgccgtccgatctaccgggcggtagatcggggccgtccgttcggccgcccgcgtggctgccgcgtcggcgccacgtcagcgccacgtggtgcgccgccccttacccggtccgtggactccgtccaccgtgaaccgccctccccgagtcactgccatgtggggcccgcatgtcggcgccacccctctctctctcccgggatttatttattgcgcaataattcaattaacgatttttctgtttatagtaaaaacgcagtgaatcttcgaaaattcatatctaattcatccgagcaccgtttaagcccattcaagtctcagtaaatcaagaaaa

SEQ ID NO: 10427 - DNA, 5259 bp, Oryza sativa
agtcagttaccaagtggaccccacctaagaccgtgtcacagattcggagttttcttggacttgcgggttgttaccgtcggttcattgaaaatttctccaggattgccagacctatgacttagttgcttaagaaagacgagaaatttaaatagacggccgagtgtgacaagagttttgaggaactcaagaagagattagtgtctgctccagttctgattctgcccgaccaaacaaaggacttccaggtctactgtgatgcgtcccgccacgagcttggatgtgttctaatgcaagagggcagagtggtcgcttatgcctcgtggcagttgcgtccacatgaagggaactatccaacgcatgacctggaattggtagcggtggttcatgctttgaaaatctggaggcactatctgattggcaaccgctgcgaagtatacacggatcacaagagtctgaaatatatcttcacccaacctgatctaaatctccgacagcgaagatggttggaactaatcaaagattatgacatgagcattcactaccatccgggcaaagccaatgtggtggcatatgcattaagcaggaagagctactgcaatgccttatgcaccgaggacgtgtgtaaggaattgcagcaggagcttgaacggctcaacgtgggaatcgtagaacacgggttcgtagctgctctagaggcacggcctacgctcgtggatcaagtcagagcagctcaagtaaatgatccggagatagctgaactgaaaaaaaaatatgagggtcggaaaagcccgggactttcttgaggatgaacatggcacaatctggatgggagaaagattatgcgtgcctgatgacaaagagctgaaagatctgatactcaccgaggctcatcaagctcaatattccattcatctgggtagtaccaagatgtaccaagatctcaaagaaaaattttggtgggccaacatgaggagggaaatagctaaattcgtcacgctctgcgatgtctgtcagcgagtttaagcagaacaccagagacccgcaggattgttacaacctcttcagatcccggaatggaaatgggaagaaattaaaatggatttcataacaggtctgcccaggacatcatcgggccatgattcaatctgggtagtcgtggattgacttaccaaagttgcttatttcattccagtgcatacttcttatacgggcaaaaggttggcggagctctatctctcgagaatcatgtgtctgcatggagtagccaaaaagatagtatctgattgagggagccaattcacttcaaagttctggcagaaattgcaagaggaattgggaacccggctgaacttcaacacagcctaccacccgcagaccatcccgatggtcagaccgagcgggtcaatcaaatattggaggatatgttaagggcttgtgtgcttgattttggtggaacatggtacaaaagcttgccgtatgcggagttctcttacaacaacagctatcaggccagtctacaaatggcgccgttcgaagcgttgtatggccggaagtgccgcacacctctcttctgggatcaaacaggcgaacgtcaactgtttggaacagaagtgttaacggaagcagaagagaaagtcagaaccgtcagagagaggctgagaattgcccagtttcgacataagagctacgcggacaaccgccgaagggagctcacttttgaagcaggggattacgtgtaccttcgtgttactccgctccggggagtgcaccgtttccagacgaaaggcaagttagcaccacgcttcgtgggaccatacaaaatcttggaacgaagaggagaagttgcttatcagctagaacttccatccaacatgatcggcatccatgacgtgttccatgtgtcccagttaaagaagtgcttgagggtacccgaagaacaagccgattcggagcacatcgacattcaagaagatctgacttatgtggaaaagccggtttgtattcttgagaccagagaaagaagaaccagaaataaggttaccaggttgtacagggttcagtggagccaccactcagaagaagaggcaacttgggaaagggaagatgagttaaaggccgcccatccgcacctcttcgccagctcttccgaatctcggggtcgagattctgtttaaaggggggtaggtttgtcacactctgaagttcttctcccaagcctaaattgaatttataaatggtcccaagaaaataccggtgtaaaagcaagagtgaaaccctaaaggaattaatgtaaataataatcggaattggcatgtggaatttttcttgagttctacatgtcaaaatacgctaacaagatttttaatggaattttcagagctctagaaataattttaaccaattaaaaatgattacaagcaatatttaattccctggaaattcttttcctcctttttctttctttttcccttcctttttcctttcgggatgggccgccggcccattctctccttgccccctttttcccgttgggcccggccgaggcccagctgaaccggccgcccgactccctctctcccggggtcgccgacaggtggggcccacctgtcgggtcctcccccaacctccagccgccgccgccgcgcccacgctcccggctccttcgggccacatcggccacgtcggccacgcccgcgcgtgcgcccgcgtctcccgcgcccactccctctctctcccgcccacgcccgcgctcgagacggccgggattcgattttcgaatcccgcctttctcccttcttccactacccccacgttggccggcgattaccgcctcttccagccacgtacgagctccctctcccctatttaagcatccccactctcccctctctctttttccccatttcgccaagcttccccttgccctctatcgccctagcgctgtcggccttctcttcaccgccgccgccggcgctccggtcgccactagctgccgctagccgccgtgccgagccgcgccgtcgacgccgtcgtgcgggccgtcccgtccacccctcctccgtcggaatccgccaccggaacccactccacgcttgcccgcccgcgtggctgtcgcgtcagcgccacgtcagcgccacgtggtgcgccaccccttccccggtcgccgccggtcaccgcctcgcgtcgccgctataagcgccatggccgccgggccggcttgagccgtgcccgcgcgcgccggccgcgagccgtatccgccgtccgcggtagatcgaggctgtccgttcggccgcccgcgtggctgccgcgtggccgccgcgtcggcgccacgtcagcgccacatggtgcaccgcgccttccccggtccgtggactcggtccaccgtgaaccgcccccccgagtcactgccatgtggggcccgcatgtcggcgccgcccctctctctctcccgggatttatttattgcgcaataattcaattaaggatttttctgtttatagtaaaaacacagtgaatcttctaaaattcatatctaattcatccgagctccgtttaagcccattcaagtctcagtaaatcaagaaaaatttgtagagtccatcaaaaatggttttgttctctatttcaatagtcttatagcctgtttttattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatggtctattgttttccttcaaatactgcattgttttgcaataatactatggaatgtttacctactgttatagccatgctattcttgtaccatgctcctttgttagcttgggatgtgacatgactagatgttggaccagggattgcttagccatgcttagttcaactagcacacaatgggggaaatcatattaatgtatagactgtaggttctaatgttaatgttggattagtgccaccgtcctggtgttgcttaattaaaataaatcatatggtgggctgtgggtgcatggttttactggtcgcgcccatggcatttaaggaccggttcgcgggatgccgtggaagaacttatcgtacttaccacaatccagcgtgggcaacggctgggcttgtagtgtagctttcctctagctgacgcattcaggcaagggtgggcgtgatgaagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctattcggtatgtcatggtggcatgtcggcgcacgaaaacgtgtcgtggggctgtgtcttgtggatacagttgtacacctctgatcagagtaaaactattcgaatagtcgtgcccgcggttctaggcggtcaaccagattcaccgtgattagtctcaccctagtctagtataatggaattgaatagtctaggtggatggttgggcctgttgcaacgtggtgtagcgttggacagtggatggttaatattgattaattactacaactgtttttctgctttcaactactgtttataaatgctcgctttatgcaaaagaacctctatagctatcctttgataattccctgcatcatacccctattccggtatgacttgctgagtacggtgattgtactcagtcttgctctattttccccaaaccccagagtttgagtatgcgtcagatggttgtttctccgaggagtagactccgtccgtgccgtcgaggatgcctgtggagtggtgttcccgctgcagtccaagtcgaggcttagctccaattgccttttaattttccgctgcatttatgtaagacttttataatatttgtaagacgtggatctgtatgtaaactttgtcgtttatgtacctcggccggtcctggatggggattctaatgcacattctgcttggaattctattcggaaatttctgggcgtgacaatggcctagattcaatttcattgcaatggttgggcctattggcccttttgaatatgtatggcccacttaatatggatggatatagtataattgggctgaatttattaaaatctaattggacttacaataggtctaccccataaacaagttgctcactatatggaccttaatagg

SEQ ID NO: 10428 - DNA, 1118 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaaatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcatgcgcgacgatcgtctccatgttgtcctcctctggggcaacaaacagcaggccgagttggctctggccggaaaggtggcc

SEQ ID NO: 10429 - DNA, 642 bp, Oryza sativa
aataggtcatcgaagcatgtcatgttaaatgggaacatatcctatgtacacaagtttctgatacacactctgtgcacagcaattaacaaatgtcttcgaaaattctagaaaaaattggacatgcaatcctaatagtactccctccatttggaattgataagtgcaaaagcaaaacattcagaattgatcagtgcataagagcaggtacaatagcaggctattagccggctataaacatattttaatgagataaatgatgagagagaagagcagcgggctacagatttgtagccagctgcagcacggactccaagacacaatgtgtgtatgacaggtgggaccatatattaatagtatagtaagcaactattgtatgaattggctattagattggctatagatgaattggagctagtagtgagctatactattgaacttgctctaaggatgtggtagctgttcagttttgcatgtaaatttattgttttcccatgcaaggattgggtggctctttgatttacatgctagccaatcagttttgcatgcagatttattgctttggcatgcaaagattgcctggctcttcggttctcattcaagccaatcaattgagcaaaaataggatgcttcattgaataaaaa

SEQ ID NO: 10430 - DNA, 4731 bp, Oryza sativa
  unsure (1)..(4731): unsure at all n locations
aggtgttatgaccagaaggatccaatgggcactgcggcattaatatagtgaaagttaattaagtactcaagcaatatgtcatgctgttgtgtatatttagttaacacacttactattgattataggcacacataatgtactccttgtctcggcgggaccacagggtgtcgtagatgtagttgaccattccttgacggtcattctggagatttgtgacagtgaccacttgtggatcaaggaaggcaacttccagtgcatgcttctgacaccattgacaacttaacctacacacaggatcaacaatcttgtaagcaagttaaaccgattgttattaccagaatgagttgggcgacaatatttacaaggagtagcacttaaggaggcttgtgtccaccgctcggagcctgtagaggtcgaaaagatccttaaagtcgaccaccacataatttgttggaccaaggaatggctttccatcgtgctgtccaaggatatcggtagctttacttggcttcctggcgttagatttctccaaggggggggggagaaggtgctttcaaacntttcccatttcttcaagcacgtcatctccaaccaatggcatgcctagttggaactcctgtggagcgacgtatttcttcttgacctctttgcccttagtctcttcctggcccttgcccagatctagctttcttggagctagaagcgaggcctgcacctttcctcctcttcctctcccctttgcttcgggtttatcgagagtaattctctgaggggaagagtgtgccttcctgctcttcttcatcggtgggggttcatgaatcgtcttgctgtcggcctccgttcggtcctccccaaaatccgtgtcgtactgcatctgcacatcgtaagattgtgcatgacgatcttgagcaggaggggctgaaggagcagaggcgggtctctttggtggacgaccgcctggtgcaatggttggcctcgctgtaaccctgatctcaatgaggtccttgggccattggatgaaggtaccacgggcattttctagtgagaggacctcgtcgttcggtggatacttcagagggaacagctcgtatttgggcttcaccgagtcgacttgaacttttgcacagtcggccctgagttgcgctccatgcactcttgtctctggggttggcttgtacgcaagtccctcggctgctggaacagtgaaggtcagcatcaccctaactatgagggtgcagctcgttggtttctgcgatagattaatcaatttttttagaatattatatatcatatggattcgttatgtctttcatgtattgagtaagttcacggttaccgatatgtggtcgacggtgctgtcgaccgatgttggattttccgccaactcagttgatgtgcaactgctgcgtttttcgatgggacttcctaactctttgtgcgcagcagcagtggcggcctgggggatctgttgctcttctcggatctcttgcctaatcttggccctcatcgactcgagcttttcgtcgaattcatatgtcagctcagctcatatcgactcccggatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcatctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccggcggtaccaagccggtgcggatgctggttcttggtctggagcaagcgatatgcctcgcttctagctttggactcgggggtcgacttcttcgcatggaattcctcccagacctgttctgtgatccaaggaaatttctctcttggatctggatttgccgggttgtagacgaactcaccgactagcttagtcttgaagttcttccaagcagtgcccataaccttgaaagcagcccgcctgagacggtcctcatgctccgcaggataatcaaagctctccttgaacgttagccaagcaatgtccttctctgcgaccggcacgagcttgaagtcgtcttgcagaatactgaatttctgcctccctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaagaaaacacaattgagtgctacaatctattacaatctattaaccacatttcacaataatttcattcatgcaccacatttcatcccaacataaataaaccacatttcatcccaacataaataaaccacatttcatcccaacatgaataaaccacatttcatcccaacatgaataaaccacatttcatcccaacataaataaatctcatttcatcccaacatgaataaacccaacatgaataaaccacatttcatcccaacatgaataaaccacatttcatcccaacatgaataaaccacatttcatcccaacatgaataaaccacgtttcatcccaacataaataaaccacatttcatcccaacatgaaccacattgcatataaataaagttaaatgaactacatttcatcaatcactacaatcatctatcacaaaattcataaatgcaccacatttcatcccaacatcgacatgtctcactcacagttcaatcacatatcatccacatccacatttcaatgacatgtcattcacagttagcagagggcggcgcgatggaggactcacctgaggatggccggtggggctcggtggcggcggcgcccgggctcggtggaaagcggcgccggtcggaggagacaccgatcgggcaggtcggcaccgggcgggcggcgtcatgctcagtgggggtcggcgacgtgggtcggtgaggacgcgggcggcgacgacgaggaaggccaacaccggtccggtcggtgtaaaggctcggtggcggcggcggcgggctcgggggcgggggtcgtcggtgaggaggctcggcggcggaggtccaaatggagggccgaggaggctcggtggtgacggcggcaggcttggcgagggaggacgactgcggcggcggcgggctcggtggcgacggcggcgggcttggcgagggaggatgacggcggcgctagggttctaaggaggcgggaaactgtagcgggacttagaaaaattttcgatccactctgagaaaccctagttatattagagtgatgagtcatctcaatcgggctttgccgtagggccagtcacagatgacgcatcggtgacgggctccatactaatgcccgattgagatgacattcaggcccgtcacggatgactcatctgtaacgggccctaagataatgcccgatagagatagattaatctctatcgggcttgaactaaggcccgtcaccgatgactatttttccatttcccaggtaagtctttatatttgtgagtacaaaatatatagctgctgtataataatttattttattagttataacacattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatataatcaacatttgtaaatactaaatgatttgaaatggaaatatggtcaacaacaaagttgatcctctcatcaagatctataacttttattttggtcatttatctatataactttgtttctaacagcttgaaattgattttgacaatatgacaaatataatcaacatttgtaaatactaaatgatttgaaatggaaatatggtcaacaacaaagttgatcctctcatcaagatctacaacttttattttggtcatttatctatataactttgtttctaacagcttgaaattgattttgacaatatgaaaaatataatcaacaattgtaaatactaaatgatttcacatggaaatatggtcaacaacaaagttgatcctctcatcaagatctacaacttttattttggttacttcttcatccgacaaagtgatagttatattattcataaaaatcacatttttctcatctggtttacaaatatcaacacagatatgttaattttgtaaacattggtactatcactttgtcagatgaagaagtgaccaaaataaaagttgtagatcttgattagctgtacaagttagctgtttatggctttcccatttaaagtcatgtaatatttacaaatgctatttagatttgtcata

SEQ ID NO: 10431 - DNA, 359 bp, Oryza sativa
actattgttctcgattcttcagaccagatagtgtcaatacaaaaacctggaggtgcagtgacatctatgacaactattaaggtctgttagctaatccgtgcttaataaaaatttccatagtatctgtggtagtttttttttttggcttttggtaaagtattcaggcgcgaaacaggcttcatgtatttgacaacaaaggaattacatttgtatatttgattcaggacgaaatagcagctgtctgaagttagatactactgagttttatgttttggtgatatttcctattcttatactgttatcaagggttggcttgtctctctactctaccaaaatttagatgccaaaattttggcatt

SEQ ID NO: 10432 - DNA, 497 bp, Oryza sativa
gggagcaactagaagagagcatgcggcgtcatgctgcgcgaccgataaagtttcatacatagattgaacagccatttaaattttcaaagactgagaagagttgtatacaaaatgtgaacaaattggtgagaggaggttaattatcagtgtgcacagagagggccacatgtagtcgtcggtatacacagcgcgctcctcgaatgacattggctcgccgtggagcttcacccaggttgtgacatcgttcggccgttgtcgagcatgtaggtttcgtgtagtcccctgtggagaggaggagaccatggtgatatgacctgtggtgcatggtccaagcgacatgatgtggcagctcaaaaggttgcggtaagggtgaccatgtctcgccaatgccagccctggcctagtcaaccacctctaagctcggttccgtaagcaagcttgcaaattatgtctttgtggtaaatcttgctatcgagcttgatagcgttgtacttggc

SEQ ID NO: 10433 - DNA, 7796 bp, Oryza sativa
tttttttttacattatttgtccatccaacttgaccatagcaggacgaatactgtaagagagattcaagggaaactggcctagttaccctcttgccactataatgctagcccattcatgggcacatatcaaaaccatccatgacatttgttacatagcttatctgttatgacaatgattgatgtattccagtagtgaaataacacatagtgacttaatagagatgcaccaacaatattcacatgtcattgtcaaggtttaaaatatagccacataaagaaaatgataattacctatagcggttctcagagaagattctatataattcgttggatgttctgtgctgtaaaacttctccacagggaataaggttccagggatattcaacacaggacatccagagaagaactttgacactttcaaaccatcaagagtagcagaagtgatcagaactttcaaatctgaagctcgatccttaattaatcgtttcattaaacctagaagaatatcactgtaaacaaacaaatatcagaacgcgactaaagctttcaacaaatagcaacaaaatccagcggtcgtgtggccgatgccaaacaagaaaaagttagtactgactatcgatcactttaaaaatacaattgctagcttacaattgaagcatctgagaaccaattataataaatatgggcaaaatatggagaacgaaaaccacagtaaagttgcatcctacagttagtaaatagttactaggcatttgcgatccgaggccctcccattcaaagttgtccaggtaaacatctaatatagagaactatcgattatatcaaagtcaattttgagaacacatactagatgtctacattacttgtgagtgaaaatatcgtataggtactaattcctagcagtagagaaagaacgcatcagaagaaaaggcaaagctaagttgatttatataaaataggtacaggaagaccaaatataaccaatacatttatgttgactcccagtttcatggcacacagaatggcttcccagcactgttttgttcactgttccaaaaaccggacacataagcaacaaaagttcaacaggcatgcaatcaatcttgggtaaatctatgtagtgtataagcaacaaaagtttagcatattactataactaaatgtagtgtatgacccattcccggtaattatcttattttgttttcaaatcacaagttttcaattcaaacaacaagaaatgggtgtggaataactgaagagtaagcagcaaacttgataaagtgctaaactttaattcaaactcttatagatcagttgaacatataaaacgcatacgtgtttaaactgcgctcgtgagcttcatccagaataattactgaatactgcttcaactcagggtctgaaaggctttcgcgcagaagaacaccatctgtcaggtacctgcatatccgaaaatagaatgagttcgcatattgttcaagaagaaattcaagtcacataaacaccctctgaggcttactttatgcaggttttctctgaagttctatcttcaaatcggatggcataaccaacttcatcaccaaggggaacactgagctcctgtgctactctcctgcaaatattcagattgccagcattcataatggcatcctaaaaaacattttccacacttgaatataggcatagcacaagactacactggaaaactattcttctctgtacatgtataaatatgcatatgctgtaaacatagtgctgctcgccaggaagaaccacttcaaaatttcttaacaagcaggttcttaagttttctccccttaaaacacttctaaattaaaataaatggcttggctatccagaaagcagctgcagtttttacaaacgatgttctcgtatctccaccatcacgattctaaatttcaagatgaatctgcaattttcgtatcccttaagtgctaatggccaaaatccaacacatctgagagcttttcaggcataaccagacccacacgaacccagtaagaatgtaccctgagctaaaaggaaaccaacatttgaaaataacaacatgaatagaaagggggaagttgtactaaactcccaggtagcagataacaacgagcgcgcgcaggtgcgaccgtgccaccgtgggggaagacaagcgaagcacggagtcgggttacctggaaaccgagacggcggcgacgcgacggggctgggtgacggctatggcaccacggcgggtgtagccgcggcggtggagtatctgggagagctgggtgctcttccccgagccggtctcaccgatcaccaccaccactgggttcgcctccaccgcagccatgatctcgtcctcgtgctccgagatcggcagctccggcggcgacggctgcggcggcggcggcggcgatggcatggcggaggaggccgctgggatgtgttagggttttgatttgtttttggttttcctcctctctctctctctctctctgggttttccggccgttggactgccgcccggtgatgaaaggaaaaagtccaccgaaggtccctcaacttgtcatccagttacaaaatcatccccgaaccacaccaggtattcgacgtacctcaactcacagagccgttcattttaggtccctcggaccccagttttttcctacgtgacggctgagtcagtatgagacccatatgtgcccacatgtcaggatgccacgtaagctcctctcccttcctttctctctcacttctcctctgcaggatcacggccggaaggggatgagtgcaggcggctggcggaggaggaggtcctgcgcggcgagtgcggcgtgcgtgtccgacggccaacaggggaggagggccagcgcgacgggcacggccggtgcccagcatgggaggaggccctggcccagcgtgtgcggcgggggcatctagcagccggcaggggaggagggtcgtgtgcggcgggcgtggctggcggccagcaggggggagtgcagtggaaaggagggccggcgcgacgggcggcgaggaaggagcggggctaggctgacgatgggcggggagaggagcggaggtggagacggacgcggcggcggcgccaccggcgacagcctcttcctcgccctcgccttgcgtcgtctcgctctccgctctgctcgacgggaggcgactccagcggtcgcccgcgcgtcctcctaaacttggcggtgttggccctcgttggcagcagcgacgctagctggcgaagactagcggggaaagaagcagcggccgtcggagaggagcttgacgttggcagtggcagccatcggctagacccagtgggcgccgtcctctgccaggaacgcgtagcggcgagaccggacgtcgagcccggcgggcttgtcggagaggtcgagctcgacgcccatggcgtgggcctgctccccgtttccgtcgaagaggaggagcacctcatcacggcggcatcatctgcgactttgcagactcaccggcctccccgcttcgccccgtcggcctccttcccacctgccggttgcggtggcggtggcggtgggggcggcgtggggggaggccctcctggtccggtgctcccgcgccgtcgcttcctctcatcttcttctccaaggccactataaatacacaatacacctcgccatgaacactcccaggcccagcacacagcaaagcagcagtagcagtgcaagctcgagctagctacaagtacaagctagcagcctagcaaagctcgatctatagcaatggcggcgaaggcggtgcttgttctagcggtgagcctcctcaccatggccgtggcggccagcaccgggtcgtcgtcgtgcccacgcgacgcgctgaagctgcgtgtgtgcgccaacgtgctcagcctctgttgttccctgctgctcgctgctcaacgaccttcccccgcgtcacagccgccgcccgctgcctcctcctctcctgcctcgccctggcggcctcctccctagctgctggccagctcgcctagagaagagaagagaagagaagagaagagtgagagagagagaggaggaggaggaagggagagtggagaggaggggagagagaggatgatgatgtggcatactgacacgtgggggcccacgtgggtcccacgctgactcagacgccacgttggataaatctagggtcaaaaccaccgaaggacctaaagtgaccggttttgattagttgtgggacgccggatatcttgttttatggttcagggatgattttgtaactcgatgacaagttgagggaccttctgtgtactttttctgtgatgaaatgaagtttcggcctcctgggctcgtaggcttctcaagcacaaatgttaacaatatggcccattcgtttcccttaattggatccatgccattgtaaatatgccatattggaaaaatgccactactattcatgaaatcgggtatgtcggagatatgggcccgggggtatgtggagtagaggagaattattttccttccggccacgtgactccgcaggttggccccactcgcgcgccacgcgagtcgtagaagcgcgggaggggggggcctcggggcatgacgtcaccccctcgggctctcccgcggcttcgccccgaggccctcgctcggctgccgcgcggcagagagagagagagagcaagaagggagcgcaggctgaatagccataaatgtgcgacgccccaactgtccctcaccgcatttaatgcggtcaggacagacgtgcggcgcgcctagctaacccctgtccatcgggtatgaccggtttgtgaccggcccgtctccgtcccatccgatggataaggcaatcatgtcctcatgtcgcccttgtccccggcggagtgggggtgggtatgacccgtcacatccggacgctactcgaggaagggctgttgcatgtcatcgttcatttataagggaatgacagggctgacccccgtgtcaggggggacggcgccgagttccgcgcaagaatcggttattggttagcttccgagagaaggcacggtttgaaacccaaaaaggtggagtggggtttccccccccccccatggaggggaagtagaggtggcacatgtggtatccccttaagctataaaaggaggaccctgcccacctaggaaagaaaaggaggggggagagggccaaaaaaagaaaaagaaaacccgaactccagaagagaggaagcaagtgcgctctctcaaggaaaaaaaacccttgtaaaactcatccataatcccaaacacaggagtagggtgttacgctcaatagcggcccgaacctgtataatccgactgcgtgcattcactcctgagagtcgtagggacgagcaagcgactaacgagagacgagcctccggccgaactcacgaaaggagggtctcacgactccccgctattgagggtcttccctcgacagggtagataccactgaaatcttctaaaattagaaccatgacactccatcacgttttccgtcatttttgtcacattttctgtcacggtgccttcatctccttgtcgtcttcatctccaagcagcgtcgaaggaggacgagggcacgacggcgatggggaagggacaagagggcaggagagctcctcggcgagggcggcggcgagcaggacacgcaccccgccgctcgatggtactgctgctcactcgccgctcgtcgtcttcgcctctgggctttagcctacgccaaaggaggaggagggcacgacggcgatggggaaggggcgggacgggtggagagcacctcggcgagggcggctgagagcgggacgcgcaccacgccgctcgcctgtcctgccgctcgtcatcttcgtcttcgtctccaacctgcgccggaggaggaggagagcacaacggcaatggggaaggggtaggacgggacgcgcatcccaccgccgctcgccggtaccgctgctcgttgtcttcgtcttcgtctccaacctgtgccgagggaggaagggggcacgatggcgatggggaaggggcgggacgggtggagagctcctcggcgagggcggcggcaagcgggacgtgcatcccgccactcgctcaccgctcgtcgtcttcgtctgggctctagcctgcaccggaggaggaggtgggtgcaacggcaatggggaaggggcgggagggcatgagagctcctcggcgagtgggacacgcatcccgccactcgctcaccgtttgtcgtcttcgtctgggctccagcctgcgccagagaagaaagtgggcgcgacggcgatgaggaaggggcaggagggcatgagagctcctcggcaagggcagcggcgagcagaacgcccatcccgcagcttgctggtcccacctctcgctcgccgctcgtcgtctttgtcttcgtctccagcctgtgccggaggagacagagggaacgatgcgatggggaaggggcggagcaggaggagagctcgtcggtgagggcggcggcaagcgggatgcgcatcccgccgcttgctggtcccaccgctcgccagtacggccgctcgctcgccacgcatcttgctcgtcttcgtctctctagcgtacgccggagaaggagggcacgacagcggatggggaagggatgtggatcttacgaggatgacagaaaagtgaacggcgaagaaatgattataattttacaaaatttcagtagcaccaagtggatatcacgaattgtagtggcgtttttctgatttgacacatttgtagtggcatggattcaattaacccttgtttttctacactgattgactcaacacccaacagcttgcattaactcaaaaaggaagttccttctttatccagagtcctagtactagagcactaaattgcacactaagcgacaaacctgcaccgatgagaatataactctcttaaataaactaattaaagaacataaagaaactcgaacacttactttgacaaaagaaccatctgtcgaggtacaagcgagagaagatggctgacaattccgactttcttcgaaactccgttgcaagaatgttaacactccggcactccttcgtgaaattcttggaggaactttgatattttggagaattccttctagagcttcccttcactctctactaagccaacatactaaatattaaactacaagtgagctatactctagttgagctcaagttgtgtgtgttgaaggtgcatgagctcctccttttatagcctctatatgacggttgtaacagttatccaggccgagaatcgggcataaccatcattggaaagccatttgggacctagacatggaaggctaggatgagatgcgccagaggtggttcagctgaaccaggggttcgggtgacccctgggctccacctcctagtcttctctgttgactaggagactgattggtgggcccttatcgcggttaggatggtttggccccactttaagtcggtttcatttgtcaggtgggccctctaatcctggtactcgtgcatgattggttggagggtcattttcatcgcatgactagtgtattttctcattaaatgacctgcatacatatatttactaaaactattggaagtgattagtagtaaactactacgattaagttttgataatatatttgatatcttttatgcatgaattaatacctaaagtttgcacttaacgaccgttaacagccaaatggactgtagatttgaaacacatttatctcttttattataaaaatatagaataatagcatccatccatattttgccttttatagaagaatgat

SEQ ID NO: 10434 - DNA, 6224 bp, Oryza sativa
ggtgcattgggaggaattggctgaacagctggctgattattagtgatcaagggccaatagtttgggaaaacacctcctggcaaataaaccggtcctgtagcctggtattcagctattgagccatcaaccatcgacttcaccatgtttgacaaagtgttgactaacattccagattgattaatcaaagcatgttgtagggcatagtcaatccgatattggaagttgttaaactgtagctgtgtcgtgttgccatcttggttaagattctcaccatgaaatccctgagaaccatcaccttgagccccttgagaaccaccacctttgtcacctgagccatctgcagcgcctttatcgcctgattgagttgtaccatctgagacctgttgtacttctccatccttggaagaatttgtcctaggaacatcagcaactaatttcatcttgtacctctgaacaattgttcctttacgggtctccatgaatgaattcaagaattggtgttgtgtttgctgcatcatcagattgagctcattcttctactcaggtgttagcttgtctatagtgacgggggcaatgtttccttcgtgaacctcaaatgcaccagactttagattcttggtaggggtctctttgccagccgaagatggcgatgctggtggtttctcagccatgagagaatgctgttgcggttctgacttctaatcggtcccactaggcgtgccaaaagcgtgttgatgtaaaaacacgaggcctgggtgatctgcttaactccagtgcaggtccaaaacttgcctttgggtgtgtgagcgtgccagttgatttgatcatgcaatcaacaggaaactaagacaaagaaaaccgcggttaaatccataaacgatagccgatcggctaagtgccgatgacatatcatttatccttgagccgacgtcatatttgcatcgatcggcagtcattaagaaataaaaagaactaaatctactcgattggctgcagatattaacaatatataatccttagatcgatatatacttaaatcaagtgattgggatagatcggtcgtcatgccgagacagtataaatcacttagatcgaaatatatactaataatgagattatatgtgttcatagcatagccgatcagatagatctagcatgtatcggctaatactccgatactactctatattaggatattaaagcgagtagaatatatcaaacaaaaagcctaatatacttaaatgcaacgagatcttaacataaagggcaaatttaacatgtcaaagaagcatgtaggataaatgtagttaaatcagataagatcggctgaaaccccaatactaccctaatcagcaaccaaagacaggctagagattaagattctaatcacaactcataagatcaaactcaactgatgaagctataagtatgaaaagaaggacaatatctagacaatcaagtcgtcggatatgtcatagagtggtagatatcctatataatctaagtcaacatcggtatttaacctaatcggctgccttctagtaacaattgttagccgattgtaggttagatagcgatattgccggagattatataagatatatgataactcgtcgaattacataaacaagattagagtatcatgaagatggaagcactaatctcgagaacgcaagccaccataacaagttttacctcttgttgaagatcgaaaccgatgcagctcaacctaaaagtaagaactcgtcgaaacaaaacgaaaataaaagggtggcgatgcgccgagattgtattgaacgtgtgttagtttgattacatggggctttggtctatttatacccgagaattacaaaatatgttcatatcggacacgactcttatctctaacaaactctaagataccataagtctttgcagtagacttttgcccaaacatatctctaaggaaattacataaaatatcctaagtaatagatacaattgacttctcaggactctatccatgcgtggaaatcatcatgaagcacgtcaacctaaaccgacaacatatgctgtgtcatattgtcggattcggctcaatcggctaaccccgtccgactcgaactctgccgatcttagtcgtagccgattcggacttcagccgatcttcactctgtttccgggacaatctctatctcgattcctccttcacatccgatcctccttcacttttggatatcactaaattacttcttagacatacaaaagtaaattcaataaagtctaaatgtaatttacatatattatagaagtaactttagacaaaacgaaagtaactttgtcataacattaggggtaattccattgtagggataaaaacataactctatctataaactaaattaattagcacaaactatggaattgactaaaacaataataggtagtcacctctagcattatgaatgtataggaagtaatttaattaaatctaaaattatgaatgtataggaagtaatttaattaaatctaaaagtactctaaaagtaatttaatcaacactaaaagaaacctttaagtgtggcgggctgggcggccggggagcacgccacgtcggattttgcaaagaaactctcatatttgttcgtaattccgtataggtctctcagtaacgtatttggagaggagaaatcgcggataggaacctatatgtaaaaagtgaaaataataggggctttttcgcaaaataatgcccactacctaactccccaaaccctccgttgccgcccgcaccctctccctctccctctccggcgccgccgccgccggcacccctcgagccgtcacctccgcctcccccttgcgccgtccccatttcctcgcgccgccgcctgcgcctccccctctccctctccctctccctctgccgcctcgcgccgccgccgccgtctcgcgccgccaccgcctccccctcttcctctccctcttccgcctcgcgccgccgccgccgtctcgcgccgccacctctgcctccctctcgcgtcgtcatcctctcctccttcccgactcaccttctccctctccttcttccggcgccgccacctccgcctcgtgccgaccccatctcggagcacggccgccacaaccgccgcgtgcccgtcgccgcctccgcctccgcctcgtgacttgaacaatgttgcatgcaagttgaagctaaaaagattacaagcaagctgagaagctttgcactaaggtacacccagatcttcctgcaaaagtcccatctgataccgcatcttttggtagaccaaggtgacatttctgtgttcgttgctactttctgtaaatttgataaccaaaatgccacggctttatataggagggcctgagcttatatttaacttgctaacctggaatatatcatgcgggtcatggatgggtgtttttaactatgctttagtttattttaaagtgcggtaacatgctaatttgtttagagtaaccatgtctatgtattaatcctactcctaaaactgcaaggaggttgaaagcaactgaaatttataatgatacattgtaattcatatattgagattctaagttccattgtactcgtcgaatattgcttcgtagtggatgtaatacataggacatattggcttttacaatggtttcagtgtttgattatattccgatggagtattttatttaaggcaaaatttgttataggacatccaaaatttgtgtaattggctgtaggacattgtaaaatcgtgtcattgctgagggacaccataaaaatggtgtaattggctgctgggcactagatctattattttattatatttgatgctaatggagagagaaaaaccgtggaaagtacgaatgtgcccctggcactgttcttcttcttgcttcagctcaatattgagcaacaaacgggatgggtttttggggtcggtgtaggccgacctgatggtggagcgtcggcggacagggttagggagaggaagcggtggaggtgggggccgcgtcagggagaggaagggcagcgacggcggggtggccggacgcgaggaggcaatggtccaatgcaagcggcagcggcggcgatgcggaaaatttggtatcgagctttacattttgtttcccctttgcaacccgagctcctgctccatcatcagcagctctactcacaatcgcacgcggcgttcttctgcgcccacccatcattcgacttggcttcgtgctcaccttgaagccaaatacggaggcggcgaacgacatggtggtcgcaacgctggaaaagctttcatggcggcggtgctggccgagacacccccacgtttgggatactactgctctgcgctgccttgtacttcaagttgaaagaggttaattttgggcctagcgctcttccccaccggcaatgatgcccctgactgtcggcaatgacgcacctcacctcacacctgctcaagcggcagctcatccacaataagtgtgtacttggctgtgaaccagcgcttggattgtgcaattaagaggcaggggcaaacttgtatttttaaaatttctctctccactttttgctcgaaaatgataaaataatgcttccagtgtccaacagccaattacatcatttttgtagtgtcccttagcagtgacacgattttgcagtgtccttcagccaattacacaaattttagatgttctttagcaaattttgcctttatttaaagttccactaatttttggttttgaacaaaaactaactccatctcttccaacatgaacagattttgagatattaacattcctatgcaacccattcttgtgacaagagctgggccattctagccaataatggtcttcctttgcataagatttaaagctggatatccagtttttcagaaggtaacaattatctataggatctgcttgcttgctgaaagctttcaattctttttaatcaatcaatgtgcagtttgagtcacttattattgtagagattagaacaacgcgcctcctgtacatattctgtttagtaacttgtacggagtttgggtataacttgtaagcaatataaactcaatatggcagctttatatgttggatggataaaacagaatatacatattcaattgttgagaaaacatcattggtccttaatgcctcattgcaaggtgaagtccttgtactccatgagtccatgttcctccatgccaactcaaatggtccttgtactaataaatcttattattccatatagacaaacggtacctccctagatgccaactcaaatggtccctcaaattttacacttgatgaggtagtctgctttccaaaattccaagtttcttgttgaagggtgctacaacatatttacatcgttaattttcttgttggtttgtaggaaatggaattctaagaatttgtacagaggtcaaatgcgtatgccaagatttgctcaatgattggcccttgaatttatggtcattctgatgtcaagaaagctatcacatgcttgctgtttggtggctcaaagaaggtgtatatatgatcttatctgtgtgtattgctgtcccggtctccctcgatcgcggggaaggaggagcagatccattcgagaaggtgatggtattggtgaagaagatgatggctgccgttggcagccctcactctagggcggcggagaacatgctgatgcaggccagcagccagtgtggttaggagaagctgaaaaggagcaacatgacgctgctgaggtgttggtctcgacctaaaaaattggcatgctgacttcgtcaaggttgaatagccaccctcttcgactcatcttggtaaatcttcctccttcggccctatccgttcgttctttcttcttgaatggattcatatcttggagatcaacgtcttcaatgcagttcccaaaatccatgcaagtttatcatctgtttccactttccagactatccttgcgcatttacgtttcaaataaatttagaatcacgcagatcaagatctactcttataaagttattattgcctttagtacctcatatagcagttatattactcataatcctcctccgttacattacagaagcatcctctgaaggcgacacagataaattatgtacccgtgatgatcaatgcagttacaaaaattcatgtgagcttagcatattttttcaaactatccacgcacatatgtatttcaaatcgattttcatatcttatct

SEQ ID NO: 10435 - DNA, 5797 bp, Oryza sativa
ctatgtgatatgaattacagagaaaaaagggaagcacatgagaaaggaggaaaaggcataatgtgggcccacctagttgaaatataagaagaaaaaagaaagaatgggtcattaacaattaggggtgggcgttcggtcaggaccgacatttcggtccggttttttcggtctttataaaaaggaaaccgaagttgtctcaagaaacttgtggaccgacagttcggttaactgatacttcggtctcggtcttcagtctgaccgaccaaactgaagtatcctttgtggcactggattgcagacttgcatatagggacgagggcgagaaaaaaaattagtatgagatgctagtcgaagcaggtagtaaatcacaagcatacacacgcaactattgctcttaagcacaaaaacccagatctgacaaaaatggaattcaatcgttcaagaaaatgggattcaatcattcaaagattacgtgttagaaatctgaaaaaaaaaacaatcgaaggatagagagtataggagaaacaatcatcaacgagagagacaatcctctcgacagcaggccacggcgctactgacaatggcgctcaggctgcacacgcacagcaggcaggatatgagcaagacgacgacgatgacctcaccgctaccgcaccgacggagacccctcagcagcagccacagccatcatcttgtgccgtcctgccaccagatctcgcgctgcctctgtggatcagatgaagcgccgccgccaaagacgggagggagcaggcgccaagctgctaaccctagcactggcggcactggcgctctactcccctttcttgttttttttttttttagagatgttgcccaccagctgaacgtatatgtgctacgctaatgggcttgtgggccatatatacgtgagcaagagaaggtattgggccacttctgtcagtccgggtacttcggtcggaaaggcctgatgaccgaatacaccgaactaagttcggtctttaaaatcgtacaaccgaactagtgaccgaagaccgtgatttcggttttttcgggttcgggttcggtcttttcgggtctggtcttcggtcctcggtttttatgcccacccctattaacaatcatgggaaaatgcactggtgatggtattctccagcatttgtggggttcgcgaatggtatttggcagcatgtcacattcactatggcattttccaactccaatttctatgcgatggtattgagcagatttgctctaaaagatttagttttatgtacaagcctagaagggaaaagaaaaagggaaaacagggtagcagactaaagcatatcattattcatacattttccaagaaaatattcagcacttttttagagaaatacttaaggataggaagcactaagaaaagagcccaaataagatatttatttagttccgacttatctgggggacaaaattcactaataataagtttgttgtcccagatgaaaagtttgttgttgcaagcaagttacttcgtgtcgatcatccgagccataaaacattggacaacttttacagtggttctattgaaagtagaactgatctagaccttctggcttttttcattaaacggaccatatttgtttatagtactgactcaataccagtggtacaaccaatgggggtataattgtccaatgaagatccttataaagctgtgagttaggttgtttctactggtagtattactggaagtagataaattccagtagagaccactatgaaagtgctctaaacattaatgtccacaatcatgacaaaataactatcatcccttgaggaaggctattgctgactacttgacattaggcaagcagcaagcaattgatgcttggaccaggcttcaaggatgagaagccttgcgcatcttatttaatgtatcacgactagatttcaggtgaagcttttcaatttgacttattggagatgcccagtaagccttacaaagagaaggaaccaataatgaaatcagtgattaccaggtatgctaaccaagatgccttcccactgatcaaacagagctccttcaaatttagcatccctgagctgcacgagaggattaaataaagccacctctgtatatgccatgtatgcaaacggatatagaagtttcacgggcatacagaaaaatagataagtcatatgatcaacaagactgattccacaaaattaaattccccatttctggttttctactaacaagtagaacaagatgaaccagccccactgtacagtatgcaaacgaactgccattttatcatgcccaatcctacatatagatcatattggctagctaaaagcgaatcaacaaaatactcttcaatagttccatttgtgctaatgcagtttcacatgactactttgctgattaaaaaggaaccccatgattaaactctaaagtccaattgctacaatatagcaaatcagcatgatttactgcagaaaataaataaattaaattcactcctgcagacaggcattcatccattcaagcaaaatgcagattatacacatggaaagcacaatgatatgcccattcagtcaaaggacatggtacgtgacgaatggagcaacagcaaggcacgatatacctcatgagaatgtcctctaggttcttggagatgactggcgccacctctgccggccgtcctggtctgacaagcggggaacagataggcggcatgtggaactccacagctgcagaacaccacggcaccacgccacaatagaaacgcagataaattagccaaacgcgcaaagcaaaagcactatgagaagataaatcaacggcaaacataccaatagatccttcgtcgggggcctcaccggagggcgacatcacctcgagcttgatcgacgcgagcatggcctgccgcaaacagatacgggaggcatttcgtcaaataggtggtgcacggacgcctaaatcaggaagagtggcggggagagggaggggtggagagcggcggcttggggggtcgtacggtgtcgccgaggcggacgagggcggagccgtgggcggaggacacggcggcgagggcgacggtggttgggcgggcctcggcggggcggcgcgcgtcggggcggacggattcgcggaggtggcgctcgaggaaggcgagggggaagaggcggcggtacgcctccacctccatctcgccggcgaggccgccggccgccgtggcttgggcctccgccgccatctcacgggtgggtgggaaaggagcttgggactggctttgtcgacaaagggggttttctttttggtttggggtgaacggtcccttgctagggtttaaggctcttccttttttgggcatcagttcgtccggtttgcattggggattttgataattttatgtaactagcaaaatgtcggtgcgttgtaacagtaaagataatatatgcatcgtattatgttatagatatagctttaaaaaaccatgatggttgtattagagggctagaaattcttacattaagaattagactttgttagttagattataacggtgtagattaatcgatatagttgtacatctttatctttacctattataaaagtttaagatgtttttgtcaaaaaaaatttcgtacgttgtccgactctatccacgcgcgcagttatttttcttcccttttctttttaccccgcatacgggtatatcgcggttcattgagatcgacttttttccgtgtgatttccttcccacgcgttggatctattacatgcaggccccaaatcgattgtatcctggcccatgtcccacatcccacgtcatccttcaattccatccttcagatgacgtggtgacctttttttcatctatccatatctctatctccatatctactgttataaaaattagaaatgtttcccctaaaaatttgatgcgtcatctgtgtttgaatcggttttcattttatgttttagttttaatttaatgtttatgtcaaatcctttccttttatcttatgtcaaagtgtccctcttatccgagacgtgcgtgaattaattgggcctgcacttttcacgtgtcccttgccgcacgcaatgccctcacgcccgtgattttctgcatgccagattaggcccgcaacgccctcgcgtgcgcgatttgcctttgccgcatgttcgattgagattgtgtcgccctcgcccgtatctgaagatgtttttgtcaaaactatggtacgtcgtccgtatctgattcccgtcacacgtaacattcattgcaaagtaataactcgtgagtgaactgcgaaagagagttcgtgtgatgtggataccaagcgaatgatactcacagaatccgtgtggatatcacatgtattgttgctcagatcatccaattctatttgtattataagacacgatttctaggatatgttagcatgatttcaagtcagtctccacacatgattgtacgtactaccagggatgtcgttacaataaactgtaataatcaattttactttcgaaaagaacatgccaactgaaataaaggatgatcaaagttgctgatttcgtccgctatcaattcatgcccaacttgagataaagctggacaacaaatcgagctcgtgtttgaaggccttattgtttggcttatgcttattcctataagccaaattttaaattttagaacttatttacacacaaatagtcttttatttgccaataagtgattttggtaagcacatgaatagatgaaacaatgggctgtgattatttttccaccgatacatatgtataaattaaattggctctacccgttgcaacgcacgggcatcttttctagtaaagtataattttatttaaattgtagaatgggatacaattatatttatgtaaacaaccattataccaattcaataatatgttgttccgtatagaaactatgtttcgtatagaaactaaaatttccatatttaaagccagcggataactaaatatgaagccagcaggtttccaaggttgttgatatttcttaatgatattactaaaaatataatttctagcaatgacacccgaaatattactcggtattctttacggttacagatataatctgcaagcgcgcggatacaccgctgtagcattttacccagaagtattttaaggtatcatatttatttaatcctaggaaaagatatgataatagagtactatgctagaaatttatatcactcgtacagatcaaagtctaatgcaggggttcatcaattcaaggatagatagattaacacacagaaggaactaaccagaatactctcactaaaataataatctaaactaagtggagaaagaataataacataatcatttttgtacttatagtatatagtcattttagtctgcacttgccattatacaattatgtagccaatatccccaaactatgccctcctggtatttcgagaaaccacccctaattgctgagtttcttacgacaatctgttatggccattcaactggtaatagatacggaagagtacccacaccaggaaaatctcttagccctatatacgcacatggaggaatactcgtggcatacatcaccatttaatgttatctaataatctaagcaccacgattacattactaaatattactctacatctttgcagatgacatagagaaatcatataaatgaatatcaaaccaataccattgcatatctccagtaagctagctacataattattacgagacaagtatgaactaaagtaggtactcaaataattatataaatga

SEQ ID NO: 10436 - DNA, 650 bp, Oryza sativa
agatgtcgactagaggggggtgaataggcgatttaaaattaaatgacacctaatcaaacctaccctaagttgctaggcttggtaagggataagtctaactaagcaactaagttatgttttgcaatcctagggtgaaagtggctcaaataaaagtaaatcacaattcctaagtctagtttagcaatcctagggtgatatgatctcaagtatgtctctaggaatgtaaattgcacaaatgtaaatgcaacaaataaatgagacaaggagacagtagatttttcactgaggttcggaaactcgccggtttcctactccccgttgaggcgagcccaactccaccgctcaaccacaaagccaccgcacgcccccttcgtcaaggggtgggcaaggcgggagccagcccacggagaggactacccaagcctcgatcactcggggtagttcttccttcactccgaaggtggtgaactccaaaccagtcaacaccggcgccagggcctcctccacaatcttcccagagaggtcaccgggaaactcctccacaagttgtctaggaggcggcaacctccaagagtaacaagcaatgacgcggctcggagaagatcaagtgccacactagctctacaatgaagcaatgcacttgactcttg

SEQ ID NO: 10437 - DNA, 738 bp, Oryza sativa
agtcccactcgcccctttggccgagtccgactccctccctctcttacacgggtccgagttgtgtcaaacaccttggcgaatttttgtttggtgtcggtttcgagatctgtttggaaaaacggaaccggcataaattcagcattccattttttgtataattttaattttgggtttagacttttacatttgagtccctgtaaattttatatttatgtttgagtccctgtaatcttacattaaggtccttgagtcagtttttgttaaaaaaaatcaagaaaaaaagtgaaaaaaaggcagaaaggtgcaaaaaaaaaagaaaaaaaaagccgcaccaaaaaaaaacagaaaagaaaaggaaagaaaaaaaagaaaagaagaaagaagaaagaaagaaaagagaaaatactgttatgtttgagctgaacttcatatatcagagttgtgcatgagttgtttctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagctgtaccgcaagtgtttgccaaggcatcgatacatccaaccttcattggggtgcttggttgagtcggtgtatgtcaccattccacttgcataggtaagatga

SEQ ID NO: 10438 - DNA, 1643 bp, Oryza sativa
aaattgagttttccaacttcacggctgggggctaggatcagtgcttgttcaaccaaggcaggtcaagggtccaagagccttctcctccgagaacgattctctgacgacaaggctgggggctagggagagtgtatgactcaacaaactgactgatcgaagtcggtaagagagaaaacgctcatatacaaaacattggacccaccacataccatgtcttatacggaaactgacttcagatatggagggagttccggataaggaaagacaactagagttctacatggaaacgacaaggactactcggattgtatccatattgggttccctagttctacttggacaaagggacacctatgtggataaatacaaagccccctaagaggagaggggagataatcaacacccaccacaatctacagaacaacagaagccaccacatataagccaacatatgcaagacaagacgtcggatattgactccagggataagcacggctagtctcctaccgtgtctcccgatactgtcaggagagacgaaagcgctatccctgatctcgttggcaccgattcgaggaggaagactaccctattgtcgactacgagtcagatcttcagaccgccatgtcgacaacagttagataggctaccccaaatattgtactggtgtgattatgatgaataagagcaacaaccggcttcggccaacaggatgtagggttattacctgacaattcaggggcccgatcctgtataaaaatcctcgtccccatctcttttgcctcaatctcgcatatatcctagtaccaacgatccccatactatgcaaataccggaatcgtgacatcaaacgtcgacaacttgattgtttagactttaggtttctctacatactttgagttgcgtcaaccctagtcttgtctagaaccctaaaaactaacctggaattatacataactagtaacagcattggagtttcagccgatattacctaatatacatgatagtgcatgtctcataatctattttgtgtatatttgccacttatatagatagatcactctaagtaaatatatcaagtttgattgatctcgactaatccatcatatatggtgatcgattattacttgatatatttatctagattaatttggttatataagtttgtattggagtaatagccaatacattatctattcttgctctaaatattagattatcggctatttctataatattgactaaaagtgattgataaaaacaaaagagatagtattgcaatcgataggacatatttagggttttgttttacttatctatcataaagccgcaaccgattgggtttatctgtatcggctgggtcctgacgatacgtggttggctgtattagccgatcggctatctgttcatctaattacgttgggtgtctttcttgctggctgcaggatcaaaccagctggcacgttcttgtcactcaaggaaagccttggacctgcactggagtgaagcaaatctcctaggctgttgtgtttctcgtcaacacgcttttggcacgcccagtggccgacgccacttcaccattcatcattccaccatctttcactgaaatcacagacgacaacatcgggctcgatactattgagcac

SEQ ID NO: 10439 - DNA, 484 bp, Oryza sativa
acaccagtggagattccaagcttgtggtcacttgcggttggggtagaatcacccatctagcctagatggcactggtcgaccattatcatggtacatgagtcagcctactgatcgctgcagcacgcacttagtattgagtggttttatgggatgttaggggcatagcctagcctgggaacgatgagatgcgttccaagagctgggtggccctcttgtatatgcgccgacaatcggggctgaactcaaatgatgttgagccggctccgatcgtagtgacttgactcgggagtgcgccgatggcggccatgaagaagccgtcatgtgtatgggcgctgcggagtgatagaggcaccggtggggatgccgagttcgtgatcactagacggtgaggtgaggattcatgtgaggatgacactggtggcagcagcgagtcggaggacttcgtcggcagcagacgaacggtggcggggcatacatatatata

SEQ ID NO: 10440 - DNA, 779 bp, Oryza sativa
cagtaatatccatgcagtgctcggctacagatgcaatataacctgaactcatcttgctcgtattgcaaccaaaatatgtaatagatccagagcccagcgcattacgtattccaatgttcactcaactactatgtttaagtttggcccgtatatcaaaaactactaaacctacctctttttttgtaaatttaggttcaacagatgtgcaagcaaagaaagagcggaagagtgaccctgattatagaaaattaaggagagctctatgtgttggatatggtaaccagctcgctgagaggatgctgcatcacaatggttatcatacggttggatacagggcacaactagtgcaggtattgacttctgcaatctatcagattagttttgctatagtgtcaagcataaatggcaagggtaaattgagatgattctggcgaatgaaacattagccagcttaaccaaaccaaaaggtagcagttttttgtgccaaactttttactagatgtagaagccaatgaaactttcagttgctacttgaactgtttagatatgctgaatatgctttgctgagagtatgcagtttgttctcgggtaattgtcgacaaagtattttagatatgctggatattagctgcaaataatagttgtctcatgcaacaggaacgcatgaatctcacagtgactggtttaagctgtttttgtagaattttgtcattttggttttgactacattctttagttcacaaacttaattactgttgaccctttacagtttgttatat

SEQ ID NO: 10441 - DNA, 1277 bp, Oryza sativa
  unsure (1)..(1277): unsure at all n locations
cgacctatttcgcaagtacaaatggttcatcgtcgtatcccaccttagatagatctactaaagtgaaaccttccttgcggctttgacaccagtgcgtagattcacccaacggtagcggaacaaaggaaccttgaacttgacgtagtttagctcccagatctcctcaatgcgcccgtagtatgtgtttgacccaacttgatcctggaatgcatctatacgaacgccactgtttgncactgtgcatttgtcatcttgtttgacggtgtaaaatgtgtatccatttatatcgtatccttgccatgtgtctatggtccaagacggtcccatccccaacaactgtactgtctcatttgggacaaccgtggacattgtcacacgattcttgaaccattcgttgaaccgagaattatgttctctgttaatccatgcatcagatggccccaagttctcatctcggattttcgctaagtgctcctcaaagtatgggccaacttctgtcatatgttggagcacagcgtaatgagcctgcgcgtacgacgcttgatcgggcttaattcttttccttccgattgtgccaacacctgacaaccttccctcgtgacgagacgctggaactccgataggatcggcatcggacatgtaattgacacagaactcaatagccacctcggtcgtgtaaccttcaatgatgctcccctcgggtttagctctgttacgaacgtacgacttcagaactcccatgtacctttcaaacggtcacatttcccttagaaaagctggaccacatagttttgtttgcttcaccagatgaacagggagatgaaccattataacaaagaaagacagtgggaaaaacatctccaggtgacagagggtattcacaatattggtctgcagcccatctagatcttctggatctataaccttctgtccaattgcattgaagaaggcgcacagacgttggatcgtgtgacgcactttcggtggtagaatgcctctgatagtaactggcaagatttgtgtgattagcacgtggcaatcgcgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatcttgtatgggctggaattcgctgcgaatattcatgtcctgtagatcaaggcgcgcgttcaacc

SEQ ID NO: 10442 - DNA, 512 bp, Oryza sativa
ttagtatctcaatatagagttgtatcgaagtattagccgatacatgctagatctatctaatcgactacgctatgaatgcttataatcttcttgttaatatatatttcgatctaagtgatttatattgtctcggcatggcgaccgatctatcccaatcatttgatttaagtatatatcgatattaggattatatttcattaataaccacagctgatcgaatagatttagttcgttcttgtttatttatatttgcgatcgactcaaatacaacattggctcaaagatagatgatatgtcatcggcaactggccgatcggctatcatttatagatttaactgctatttttctgtctttatgttcgacgatattttgtgcattttttttataaatgaaagaaatgaagtgtgtcaaagtattaatttcgggaacggcgatataataacgaaattggtgattaattatcactaataacacaacctggcgtacatggcgtatacgtatgaatattgtg

SEQ ID NO: 10443 - DNA, 376 bp, Oryza sativa
cagatcagttgatgtaactctcataaatttaatagcatgttactagtagttcataacaaaaattctagccatttccttgcataactctaaaaaaagtatttatttgcatatacttttccacaaaatcagctaaatacatcataaacacaataatctatcactaaataaataaaaaaggctgaagatggaaactgaaagtatatgtgcactttaactgactatgtttgcagtttgctgcttacacaacaccatccacagtaagagatgtttcagctacatttgttgcaacaatgaagcgtcgacaatttggaggtgctggagcaaatacccggacctattgtgacaagggaatacatcagcaatgatactatagagc

SEQ ID NO: 10444 - DNA, 1627 bp, Oryza sativa
  unsure (1)..(1627): unsure at all n locations
atatgcatatgaccgacgcaaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaacttgaactccttaagtgtgttttacccgacaaaattgtggccaggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagagcaacaacaatcctaatcaggatgagaggacttgctttgtgtgtggccaacttggtcatctggctaggaagtgtccacagcgcaaggggatgaaggcacctacagggcagacttctaagtctgctaatgtgaccattaacaacactggagatggaagcgggtatggtaatttacctgctattttttcagttaatcagtctactaattggtgggttgatactaggtccaatgtacatgtttgtgctgacatctcattattttctcttaaccggttcgcagggggttcccccgtcctaatgggaattggttcacatgtttctgttcatggtgtgggccgggtagatctgaagtttacttcgggaaagatcgtgcagctgaagaacgtgcagcatgtcccttctatcgacaggaatcttgttagtggctcccgtctgactagagctggatttaagttggtttttgagtctaataaagtagtcgtgtccaaacatggatattttattggtaaaggctatgagtgcggaggcctgttccgcttttccctttctgatttctgcaataagtctgtgaaccatatttgtggcagtgtggatgatgaggctaatgtttggcactcacgtttatgtcatattacatttggcttgatgtctcggctctccagcatgtgtttaattcctaagttttgcattgtcaaaggttctaagtgccatagttgtgtgcaatcgaagcaacctcgcaagcctcacaaggttgccgaggaaagaaacttggcaccactagaactcttacattcagatctttgtgaaatgaatggcgtgttgacaaagggtggaaaacgatatttcatgactttgattgatgatgctactagattntgctatgtgtacttgttaaaacgaaagacgaagctctagactattttaaaatttataaggcagatgttgaaaatcaacttcgacagacagatcaaaagacttatgtctgatcgtagtggagagtttttctcaacgagtttgacttattctgtgaggaacaggacatcatacatgagaggacgcccccctattctcccgagtctaatgggattgctaaaaggaagaaccgcacactgactgacttggtgaatgccatgttggacactgcgggactacataaggcatggtgg

SEQ ID NO: 10445 - DNA, 1081 bp, Oryza sativa
  unsure (1)..(1081): unsure at all n locations
catcgttgtctaagcgtgcttactttgcgcaccggcacagctgaatgagaatccgctggctcagattgagtggctcactttcttgagaagggctttctattcgaggatttccaagagcagattgaaatctgtgttatggtttcagggtttgtcaaccaagtgcaggagggcgggtctcgctgccggatcaatgcgcaggacacacgatctacaaagctagaatttccaatagtgagaccagcttgacaagctacctttcctcttgatctgaggtgcgaagagaaacatctcttttttatgacttccacttctcgatcccggcccggaaaagtgaccgacccgaatgaaaaataagacctttgtgaccgtgacagatgctagggggaataaaaagactggggcctccgcaggtgggattgaagaaagggatttagccttttcaaaaaagaagctctgtcgctctcctagttgctaaagaatccggagctctctacgcattcagtagaagaagagtactccccttcataatgcttccttcttcaagtctttcgctagtgaagttgggggtagcattttacttttgttaagtcatggactggtttcttcagcccttnttctatgtgttaaaaaaaggtgggggtcaaggtgtataatacgagctccactttcaggcaatgagctagcttaaccctgattgcttaaggtttaatacagttggataagggtgccagtgaagaaatcaagagaatatgctttgtgtggtcacaggaacaatctgcggtcgtagcatgaaaaaaagagtaccttcatttacagcatatagaggtattagggaaaacaacccggtggggtaaagtcgtcaagtggactatggttccaaccaagattattattcacgcacctacgatccctttcttaaagaaaagaattattacttgctaatcttcccctctaacgcgggccgggccgggcttaggcgactggggaagctgaggagagatggggaaacccaactgctgccggtcgggacggacaggaaaggggcggggttatcggagtgatcggggtgatggtgatagtt

SEQ ID NO: 10446 - DNA, 7007 bp, Oryza sativa
atctaagtcgtcggctcttggatgcagtgtggagaagttgtgcttggcttatattttccttgtacaaggttaaggcattatctattgtccaacgaatgcactgtcatatgcaaagctaatgtcgttaagtacatgttatcagctctaattttgaatggaagggttggaaagtggatattttccttaacaaaatttgatcttcggtatgagtcaccgaaggcaaccaaggggcaggctatagccgattttattgttgatcattgtgatgattcaatcggctcggttgaggttgtgccgtggactttgttctttgatggatcagtatgcactcatggttgtggtatcggcttaattataatttctcctcggggggcatgttttgagtttgcctatactattaaaccttatgcaactaacaaccaagctgagcatgaggcagttctcaaagggttgcaattactcaaggaagttgaagccgatgctattgagattatgggggattctttgctagtgatcagtcaattggcaggagagtatgagtgcaaaaatgatacattaatggtttataatgagaagtgccgagagctgatgaaagagttttggctggtgactttgaagcatgtatctcgagagcagaatattgaagctaatgatttgacccaaggggcgtcgggatataaaccgataatcaaagacatcaaaattgaggttgcagcgttaacagctgatgattggagatatgatgtgcatcaatatttacagaatccatctcaatcggcttcccggaaattgcgatataaagcgttgaagtatactttattggatgatgagctctattatcagacgattgatggggtgttgcttaagtgtttaagtgccgatcaagccaaggttgcaatcggtgagattcatgaaggaatttgtggcactcatcaatcggctcataagatgaagtggttgcttcgatgtgcagggtatttttggcagacaatgctggaggattgtttcaaatattacaaggatgtcaagattgtcaaaattttggagcgattcagagggcaccagcatcggctattaatcctatcattaaaccgtggcatttagaggttggggaattgatatgatcggcatgattaatccatcatcaagcaaagggcataagtttatattggtggcaactgattattttaccaagtgggtagaagcgattcctttgaagaaggttgattctggggatgctatacaatttgttcaagagcatataatctatcgatttggtattcctcaaaccattacaaccgatcaagattcaatcttcgtattcgatgagtttgttcaatttgccgatagcatgggtatcaaactgttgaattcttcaccatattatgcacaagctaatgggcaagccgaggcatctaacaagagtttgatcaaattgattaagagaaagatttctgattttcctcggcagtggcatactcgattggccaaagcattttggtcttatcggatggcttgtcatggatcgatccaagtccctccttataagcttgtttatggacatgaggctgttttaccatgggaagttagaatcggctcaagaagaacagagttgcaaagtgatttgacagccgatgaatattataatctcatggccgatgatagggaagacttggttcagtctagattgagagcccttgcaaaggttaccaaggataaggaacgagttgcttggcattacaacaagaaagtggtgcccaagactttttcggaaggtgaacttatgtggaagttgattttgccgattgggactcgggataacgaattcggcaagtggtcaccaaattgggaaggaccgttccaaatctataaggttgtatctaagggagcttacatgttgcaaggactcgatggagaagttatggacgagcgctaaatggaaaatagtagaagaaatattacccaagttgtttgggttaatgcatgatcggccggtgttgccgatacatgataggcgatgtatttacatcaccttgaaatggccgatattggtatatcgcccttagatggtttcatattgtaatcggctgtggtctgccgatgtgcaatggccgatattgttatatcgcccttagttcaacttataattttagcaatgccttcatctttgtaaaattaggggggcacatatatgaaaagttgcaaatttttgagcaaaatgtggagttatattgaatcggcataaagattatcaagatgagttagataaagagccagagtttcttagccgattacaaaatttcctaagatctattacacaagatatcacagagacaagtaacactggatagccgatatagctctttgcctaatttgttctacttcttcaatggattgagcatcttgagcatcggttccagagatgacttttagagacttggtcatatctgcgacattcttgatagccgatttcagccttgccttctgttcttcgacaaactatgggagatcggctagcttcttgtgttccagatccagttcggcattgcattcttggagttgtgccaagagctcaatcttccgagcttcaagccgatcaatattagacatgatcgggccttcagatagttgatcaagtttggacttctcttcatgcacgagttgctgattggcctggatggtagtgtcacacctcgaagttctttcccaagcctaaattgaagttataaatggtctcaagaaaatacatgtgtaaagcaagagtaaaccttaataaattaatgcaaataataatcggaattggcatgtggaatttttcttgagttctacatgtcgaaattcgctaacaggatttttagtggaattttcagagccctagaaatagttttaaccaattaaaattgagcataagcaatatttaaatccctgggaaaagtctttttctttttcatttcttttcctttctctttttctttgaatgggcggccggcccattctccttccttcctcccctcctgctgggccggccgaaggccaaggcccagctaggccgcgcgggctggccgcccgcctcctctcacccgggtcgccgacaggtggggcccacctatcggacccgtctcccacctcgcgccgcgccgccgcgcccgcaaccaccgccgaaaccgccgccgcgcccacgtccgcgtctcccgggccacgccgtccacgtcgccctcccgcccgcgcatgcgccgcaccttccgcgcccgcctcccctcttttctcccgcccgcgcccgcgcccgagatggccaggattcgatttttgaatcccgcctctctctcctctcccactcccccgcgttggccggcggattcctgcctctcccggccacgtccggccccctctctccctatttaagctccgccgccaccccctctctctttttccccatttcaccgaactccctcgtgctccccatcactcccgcgccatgcaaccacccgccttcggcgctcccgccactccggccgcctctagccgccgctaggctcgccgccgcaccgcgccgtcgccgtcgttgggttcgcatggtcaagggccaccccgtccacccctccttcgtcgaggttcgctgccggagcgccgttcccaccgtgcgatggtgagagccgccatgtccgccgccttcggccatggtttccgatcgccgtggttcgtctccctccctctaacctctctcttttccttccttagggcattccagacctcgtccgcccgtcgccgccgtttgcccgtggtcgtcgtcgccgttcgccgtcgtcttcctccgcgccggccacccttggtgaggcgtcctctcccctctattcccctccctctccttcctaggcttagcgtcgccgccttcgcgtcgcctttgcgtcgccgcctccgccgccggttgccatcgctggcaacgcgtgcgcgcgcgcgccgtcgccatcgccgtggccggtcggccggccttgagccgagctgagccgggtcgccgccgcccgtccgatcggccccggggcgatctaggccgtcggtcccatggaccagcggtggaccacccgcgtggtcccggtccacggtggaccggcagccttgggtcgctgacccgggggccccacttgctggcgcccctctctcccattgagccgctgacatgcgggccccgcccgtcggcgccgcccccccttgatgacgtcagccctgggatttattgcgcaataaatgatttaaggactttttgttatagtaataaatacaatgaatcttctaaaattcataactaattcatccgtgctctgtttaagcccattcaagtctcagtgaatcaataaaaatgtgtagaatccattaaaaatggttttgttctctgtttcagtagtcttatagcctgtttgtattgtttgctttgtttgtcgcttagattccggttcttccaacgctccggtgtacttcgaaatagtcgccgaggttcctccagcagcagagcaaggcaagtcatgcttgtcacttgaacatgttgatcctatattgcaaatgctctattgtttttcttcaaatactgcatcattttataatgttactatgggatgtttacctattgttacagccatgctattttggtaccatgttgctttgttagcttgggttataacatgaatagactttggactagggattgcttagccatgcttagttcaactagtacataatggggaaaatcctattaatgtttagactgttggttctaatggtattgttggattagtgacaccgcttcggtgttggttaattaaaatgaatcacatggtgggctgtgggtgcatggttttgctagtcgcacccatggcaattaaggaccggttcgcagaaaacatggaagaatttatcgtgcttaccgcaagccagcgtgggcagcggctgggcttgtagtgtagctttcctctagctgacgcatctaggcaagggtgggtgtgatgaaccggggtggcccctgcgacggcctctgtcgcttccggattcacctaggcacgagaggggactgcccgctgccttgcgaggagtgggggtgaaacctgaggtgtggtgtgcttggttagagggggttatgcgaagggtcctgtcacgacctctttccggtatgtcgtggtggcatgtcggtgcacgaaaatgtgtcgtggggctgtgtcttgtgggtactgttgtacacctctgatcagagtaaaactatttaaatagccgtgcccgcggttatgggcggtcaaccagattcaccgcgattagtctcaccctagtttagtctaatgaaattggatagtataggtggatggttaggcctgtcgcaacgtggtatagcattggacagtggatgaataatattgattaattattacaactgtttaattctttcaacttctgtttttaaatgctcgctttatgcaaatgaaccactctagctctcctttgataattccctacatcatacccctattccagtatggcttgctgagtacagtgggtagtactcagtcttgctctattttccccaaccccagagtacgagtatgtgtcaaatggtggtttctccgaggagtaggcttcgtccgtgccgtcgaggatgcctgtggagtggtgttcccgctatagatcaagtcaaggcgtagctcctgttatctttcgtttttccgctgcatttatgtaagacttttatgatgtttgtaagacgtggatctgaatgtcaacattgtcgtttgtataccctggccggtcctggatggggattttaatgcatattctgcttggaattctattcgggaatttctgggcgtgacaggtagtttcaatctctttgcgttctcggcgttcgactaatctctgcttggctttctccagtttgaattgatgctgttcaagataagcagctggagtaaggacatcggctagttcttcaggaatcagagtttgaacttcgtgtagccgagccctaattgatccacagtcgaccaccaagctgtctaaagaagatgcctctagccgatgagagatatcttcaagagttttcttcacatcattggataagggggctatggctttgcttgtggtgtcctcttctgtctcatcaaagttgtccttgatgtcaaaagagaatagatcggctaagacctgcaagaacaatttcaagagagttaggagctaaatagacatagccgatctaagttcttgtatcaaagggaaacttactgggatagcaggagcggctggttgttcttcttcctcaacatggtgactccctatagccgatggagtttggtcactggatgattgctgtacaggggaagaaggaggaggaggaggctgaaaagagacaagtattagacaagatcggctgagatcaactggtgaaaaaattaagaacatcttactggtggagccggtttgagagttgttgctgccgatttcttcttcatagcaattctctttttctgcaaaggcaagattaataagtaatcggctgaggataaaatggttataaaagggaaccagggaaagatatttaccctcgagaaatgagctggggcagaaggagttggaggggtctgcttgggcgaagccgatggtgttttctctgtatcgctcacttcggctgcagcttgatcaacatcttctccaatctcttcttcatccagagcttgttcaatggatggatctagggcaggcaagtcatcggttggcttggtcttctttgacttagctttcttctttggggctagagccgatgtgtctacagccgatgctctggtttttctctttttgccggtatcggctggttctctaataagcccttggagaagagttgaagtcttgggggcatgatagccgatgacgggggtagatggcccacctccatttggaattagacctggaacatattcgatgtctctgccactattgctttggtgtggaggggaagattctgttgtctgcaaaat

SEQ ID NO: 10447 - DNA, 131 bp, Oryza sativa
acactcaaactaatagacaaatactaagcagtcggtaaactaagggaaagcgagcctaatgctcggaacggctcctgcggtcgatggagtcgaaggcgtcctcctgctcgtcaccaggtccctctgagcgg

SEQ ID NO: 10448 - DNA, 555 bp, Oryza sativa
taagttaagtgcacgttaacgatagcgggcatgggacccactttcgagacaggccccgacgcccccgcctcatgaaggaagcccgagagctcaagttgacttgggacagggggctcccatcttaagattacaagtaggaagggaccaggagcccaacttggcctaggatcctgagtccccatctatccttagggcttatgttcttcgcagagaagagtgtacaagcctataaggtttatatcttaaaaggtgtaggttatgaagggcccggcccctcattacccttgtaagtaacatattcctccttgagaagtgttgacgtaaaacacgaggcctgggatatctgcttaactccagtgcaggtccaaaactcaccttcgggtatgcaagcgtgccagttgatttgatcctataatcaacaagaaacaaagacaaagaaaccgcggttaaacctagaaacgatagccgatcagctgagtgccgatgacatatcatttatctttgagccgatgtcatatatgtatcaatcggcggtcatgaataaataagaaggaa

SEQ ID NO: 10449 - DNA, 9128 bp, Oryza sativa
aaatcgatgcagctcaacccgaaagcaagaactcgtcgaaacaaaacgaaagtaaaaagggtggcgatgcaccgagattgtattgaacgtgtgttcattgattataaggggtccggggtctatttatacccgagattacaaactatgtccatatcggacacgacacttatctctaacaaaccctaagataccataagtctttgcggcagacttttgcccaaatatatctctaaggaaattacataaaatatcctaattaatagatacaattgccttctcaggactctatccatgcatggcaatcatcttgaagcataccaactcaacccgaggacgtataccgagttgtattgtcggaatgggctatatcggctcacacagtctgactcggactcagctgatcctggtcgtagccgatttggactccagccaattttactctgtttcctaaacgatcttcatctttgattctgcctcgatctaatctccatctccaatgctgatattaccaaatttggtcgttaacacatgccccccaagtccggaatatttagcaatgtttcggatttgccatatatcaactccgagcgaaattcgctcttgcgtttttcgactgttattccatcgctttaaatactaaccgttacccccgagaaatctcacaccgtcttcttccgttttcaccgccgaagccaactctgtcttctctctctccggcgatttctccgacgcacaaggagatccccaggagacttcatttttggccaaatctctgcccacggcgatgtcgtcctccgatagcccgtctgccgcgctgtcagccgagtacgctgaggtaagttccactcggcactggatcttatcggcaaagaataagccgattgggagttggcccattccaagttgtctagctgagctcattggatgatagaactcataagagacttggatatttcttcctgatggatgccgacaggaaggatgcatgggctgattgcagctgagaaaacttccctggacttttggtatctttcatgattaatgtcctcaaacctaaagtccgatgggagctcaaggttaatttcatcaaccttgatgatggatcggctgctcaaccttcaaggacctcctctgggcagcattgagaatatagagctggcaatgttcaggagcaaaaactttaacagatggtggggtgaatggaaactgcacctattctatcaatcggcttccatgtacatgacatacctctttccagatgttatccctcaggtatgccccgatttaactttgtctgaataattgcttagccgattcataacttgactaattttctttttgacttgcagacgacagaattctctcctcctcatcagagcaatagtggtagaaatatcgaatatgctccaggtctgattcctaatggaggcgggccatctccccatgtcattggttatcgtgcccccaggacttcaactcttctccaagggttcatcagagaaccagccgataccggtaaaaagagaaaaaccaggtcatcgactgcggatctatcggctcaagctccaaagaagaaagtcaagtcaaagaaaacgaagccaactgatgatctgcctgccctagatccatccattgaacaagctctggatgaagaagaaatcggcgaggatgttgatcaagccgcagatgaaataagcgatactgaaagaactccatcggcttcacctaagcaaactcctccaactccttctgccccagcccatttttcaagagtaaacaacttcccttgattccttttgtaatcacttcattttatggccgattactcacatattttatagttgcagaagaaaaaactgctgtgaagaagaaatcggcaataacaattctcaaaccagctccatgagtaagatattcttaactcttccactagttgatctcagccgattttatctaacacttgtcttttttatagcctcctcctcctcctccttctcctatacaacaatcatcgagtgaccaaactccatcggctatagagagccatcatattgaagaagaagaacaaccaactgctcctgctatcctagtaagtttccttttgagacaagaatttagattggctaggtctatttagctctaactctctttaaataattattgcaggtcttagctgatcttttctcttttgacattagagactatcttgatgagacagaagaggataccagaagcaaagctttagcccttttatccgatgatgtgaagaaaattcttgaagatatctctcagcggctagaggcatcatcgttagacagcttagtggttgattgtggctcaattaggactcagctacacgaggttcaagctctaatcccagatgagctagccgatgtccgtactccagccgtctatcttgagcagcatcaattcaagctggagaaagccaagctgagattagctaaacgtcgggagcgcaaggatatcgaggccacaatccaggccaattgatagcttgttcatgaagagaaggccaaacttgatcaactatctgagggcccgattaaatctaacattgatcggctcgaagctcgtaagattgaactcttggcacaacttgaagaatgcaacgccgagctggatatggaacataaaaagctagccgatctcccaaaatctgtcgaagaacaaaagacaagactaaaattggctatcaagaatgttgctgatctcaccaagtctttaaaagtcatccctagaatcgacgctcaagatgcccaagccattgaagaagtagaacaaatcaggcaaagggctatttcggctatccagcaacatttgtctcagtgatatcttgtgtaataggtcttagaaattttttgtaatcggctaagaaactttggctctttatcgaacttatcttgataacttttatgccgattcaatagaactccatattttgctcaaaaatctgcaattttcatatatgtgcccccctaattttacaatgacaaaagcattgataaaattataagaacaactaagggcgatataacaatatcgaccattgtacatcggcaaatcacaaccgattacaatgtgaaaacaactaagggtgatataacaatatcggccattgtacatcggcaaatcacaaccgattacaatatgaaaacaactaagggtgatataacaatatcgaccatctcaaggcgatgcaaacacatcggctatcatgtatcggcaacatcagccgatcatgtgttaacccaaacacttgggtaatatttcttcaagtacttgccatttagtgctcgtccataaacttctccatcgaggccttgcaacatgtaagcccccttagagacaactctatagatttggaacggtccttcccaattcggcgaccacttgccgaatttgctatcccgagtcccaatcggcaaaatcaacttccatacaagttcaccttccaaaaaagctttgggcaccactttcttgttgtaatgccgagcaactcgttccttatccttggtaaccttttgttaacaaccgaatttggtaacattagcatcaggaaagaagattagatcgaagcaaaatcggaggcggagatcaagttcggaaacagggcaggaatcagctggagtccaaatcggctacgattaggatcggatgggtctgagtcggactaggtaagccgatacagccgattccgacaatgcagcttgatatatgatatcgggttggattgaggtgcttcaaggtgattgccgcacatggatagagtcctgagaaggcaattgcatctattaattagggtgttttatgtaatctccttggagatatgattgggcaaaagtctgccgcaaagacttatagtatcttagagtttgttagagatagtagtcgtgtccgttatggacatatcttgtaattctcgggtataaatagactcaagccctatgtaattttaataacacacgttcaatacaatctcggcgcatcgccacccttttgctttagttttattttgacgagttcttgctttcgggttgagctacatcggtttcgatcttcaacaagaggtaaaacttgttatgatggattgtgttctcgggattagtgcttccatctttacgacactctaatcttgtctatgtaattcgtcaagttatcatatgtcttacataatctaatctacaatcgtccaacatctgtctgtagagggcagccgattagattatatatcaatgttgacttagattgtataaggtatctaccactctaggaaacttctagcggcttgattgtctagatattgttcttcttttcatacttaatgatgcatcagttgagtttgatctattaagtcgtgcttagaatatcaatctctagcctgccttctggttgccgattagggtagcgtcggagtttcagccgaccttatctggtttaactatatttgctctgtatgctttattgacatgttaaatgtgctctttatgtcgagatattgctgtatctaggtatattaggtctttgtttgatatattatacctattttaatattctgatatagagtagtatcggagtattagccgatacatgctaaatctatctgatcgggtatgctataaacatatatatagccctgttattaatatatatttcgatttaagtgatttatactgtctcggcatgacgaccgatctatcccaatcacttgatttaagtatatatcgatataagaactatatattggaaatatctacagccgatcgaatagatttagttctttattgtctatttacaactgccgatcgattcacatatgacatcggctcaaagataaataatatgtcatcggtacctagccgatcggctatcatttatagatttaaccgtggtttctttgcctttatttcttgttgattacaggatcaaatcaactggcacactagcacacccgaaggcgagctttggacctgcactggagttaagcagatctcccaggcctcgtgttttctgtcaacacctttgcaagggctcgcaatctagactgaaccaagtcttccctttcatcggccatgaggttataatactcgtcggctgttaaatcatttcgcaactccgttctccttgagccgattctaacctcccatggtaaaacagcctcatgtccataaacaagcttataaggagggacttggatcgatccatgacaagccatccgataagaccacaatgcttcggccaatcgagtatgccattgccgaggataatcaaaaatctttctcttaattaatttgagcaagctcttgttagatgcctcggcctgcccattagcttgtgcataatatggtgaagaattcaacaatttgatacccattctatcggcaaactgaacaaactcatcggacacgaaaattgaaccttaatcggttgtaatggtttgaggaataccaaatcgatagattatatgctcttgaacaaactgtatagcattcccagaatcaaccttctttaaaggaatcgcctttacccacttggtaaaataatcggtcgccaccaatataaacttatgtcctttactcgatggtggattaatcatgctgatcatatcaattcccccaacctctaaatggccatggcttaatgataggattcatagccgacgccggtgccctctgaattgcttcaaatttctgacaatcttgacaccctttgtaatatttgaaacaatcctccagcattgtcggccaaaaataccctgcacgtcgaagcaatcacttcatcttatgagccaattgatgagtgccacaaatcccttcatgaacctcgccgattgcaaccttagcctgatcggcactcaaacacttaagcaacaccccatcaatcgtccgataatagagttcatcatccaataaagtatacttcaacgctttatatcttaatttatgagaagtcgattgagatggattctgtaaatattaatgcacatcatatctccaatcatcggccgttaatgtagcaacttcaaccttaacatctttgatcatcagcttataccctgatgccccttgggccaaatcattagattcaatattttgctctcgagatacatgcctcaaagtaaccagccgaaattctttcattagttcttggcacttctcattataaactattaatgtatcattattgcactcatattctcctgccaattgactgattactagcaaagaatcccccataatttcgatagcatcggcttcaacttccttgagtaactgcaatgctttaagaactacctcatactcagctagattgtaggttgcataaggtttaatagtataagcaaactcaaaacttgcccccccccgaggggaaattataactaagccgataccacaaccatgagtacatactaatccatcaaagaacaaagtccatggcacaatctcaaccgagccgactgaatcatcacgatgttcaacaataaaatcggctatagcttgccctttgaccgccttcggtgactcatatcgaagatcaaacttagttaaggaacatatccattttccaaccctccctttcaagattggagccgataacatgtatttaataacatcggcttagcatactacagtaaattcgttggacaatagataatgccttaaccttgtacatgaaaaatataagcacaagcacaacttctctacaggggaatatctagtttctgcatccaagagctgacggctcaagtagaatacaactctttctttcccttctagctcctgaatcaagaccgagccgattgacttctcaccggccgacagatataacctaaaaggtatccccttctgtggaggaatcaaaactggaggagagctaagatattccttaatattatccaaagctttctgttgctttgccccccaagtaaactgttgatcggctttcaatcttaataatggtgtaaaaggctctaaccttccagaaaaattagaaataaaccttctaacaaaatttatcttgcagatcatctcctgcaactctgtcttgttctctggaggctgaatcttcttgattgcattaacacttctttgggtaatctcaattcccctctcatgaacaagaaatcccaaaaactggccagccgatacgccgaaagcacactttgttgggttcattttcaagccatatttcctggttctctcaaaaaccttcctcaaatcgactatgtggtcttatatctctttagatttaacaaccacatcatcaatgtagacttcaaccaactagccgatcagatcatgatatatataattcatggctctttgatatgtagccccagcacttttcaagccgaaagtcatgacagctcactcaaacaagtcgattgcaccaggacacctaaaagctgtcttatggatatcttcttcagccataaagatttgattgaatcctgcattaccatccataaaacttaaaatcttgtgtcctgaggcagcatcaaccagctgatcggctactggcattggatactcgtccattggggtagctttatttaaatccctgaagtcaatgcacaccctcactttgtcgttcttcttgataacagaaactatactggaaaccaactcggcatatcggcatggacgaataaaaccagcaccatataaacgttaatcccagccttgacaggttcgagcatatcggctttgcatcttctcggaggttgttgatgtggtctaacccctggtttgataggtagccgatgttcaacaatcgatcggctgagtccgggtatctcataatactcccaagcgaagcaatctctgaactcctttaacagctctatcaacttggttctgaattccgaagataaattcttactaataaatgtcggccttggtcgatcacctggacctatgtcaatttcttccaaatcatcggccgacatgaaaccctgtccttgtttgtcatcgagatcatccacgacgccctcaaaataatagcttaggttctccatcttcaattggttgtatatcagaatcggacacttttagaaaatctccatcctaaacttttccagataaacaatcaagaccatccatctcccaaagagctaaatcggcactagtaacattgactgacctgtcggctggcacaatttcaatcttgtcgccttgccactgaatcaagcattaatgcatggttggaggaatacaacaattggcatgaatccaatcccttccaagcaacaagctgtaggaacccttcccatcgatgctcaaagaacgttgtagagatagttttgctgccgacggtcaattccacatttaaaactcctttggtttctgatggattgccaccaaaatccttgagcaccatgtttgtcttgatgagatctttagcgtttctgcccaacttcctgaatgtagcataaggcatcaaattcactgcagccccaccatcgaccatcatcttggacatcggcttcccattgacatagccatttatatacaatggtttaagatgccgattctctgttccttccggcttttcgaagattgcttgctctggtgacaaaatcaatttagctgattcttcttcaacttcatcgacatcggcttgcttgaccccaaattcagcaggcaacgtgaaaaccatgttaaccgatgcagttacaacacttttccctttagccaatctctttgcttcatcggctgcggcctcatcggctataggagcttgattcttaactcgccactcctgcttcggcttcattttctttagccgatgattgatttcctgttcgacctcctaaaagtgctccctgttcctcaatctttgaacccttctcttctgattctttataaagataccagaaggacaccattgagtcttcctgtcttcattgccctcttggttacaatcttggttcaccgggactaacctttgatgaacaggaactcttgtttgctttagccgattgcctctattatacgatcggcttgagctttctgcaatattaccacatccaggacagtcttcgatagatgacagcctcataccctcgttccagcaaaattaaagaactcgcagccccaatgaggatcaaa

SEQ ID NO: 10450 - DNA, 885 bp, Oryza sativa
cacctcaccctcctccaattcctggctaaccaaactatcaccgccatccgaagccaccacctcctttgacacaccaccacaagaagcatcaacagccatgaattccaaacctgaaccagtcttaacgtccctcccacatccaggagggaagcggcgcgtcgcggataccatcctcctcttgggaagcacattcgcggcttgagctaacacttgcttccaccccagcaattcaccactatttgctgccccttcttgtacaacatcctccagtgaaccaactttgcaagcgacctgattctcatccgtagcatgcgaagatttgctgaagatttgatgcacatttgcaattggatcaccaccatccaccacagcttccaacggcaaatcagttctgttgccagcgagaggaggaacaccaccgtcgccatcgcggccgcggccgtggcggcgcccgagtggaagagcggcgtcccttccgcaacctggaggaagctggcgaacggaggacaccgcgctccgcttgggcggcggcggcgaacgcgcgggccgctcctccatccccctcttcgtccccacctcgccgccatttctcttcttctccgtcgccaccgccgcgccagcatcccgctcgccggcgtgcgtgagcgtggccaaaccaccggccacggccacattcactgttctcaccagcgccatcatctcgccatctcccgcacgagccgtcccctcctcgccgcgcccccgcgctctactggtaccctcgcctgagcccccgcgcccatccgcggcgacgggaccaggaggatggcgaggtggaagcgcgttccggcgagctttccgctgcgtgcgccggcttctccatgcctgcgccgcctggagcagcat

SEQ ID NO: 10451 - DNA, 52055 bp, Oryza sativa
  unsure (1)..(52055): unsure at all n locations
aaaaacccgcaccaaataagctgttacacacatcatccaacacgccatcacatcacaacacgacgaccagaagcagcgaacacgaagaacaacacagaggcgaggcgtacggactcacctcctcgtcgtccagacaccggcggcgaaagagcgcgcggcgaggccgaggcggcgagccggcgagcacggcgacgcagttggggtttttgcgcgagcagcgagagagagagagagagagagagacagagttggtggggccgagaagagaaggatgggtgatgattggtgaggcgaggacacgtggcgggcggacgccgcacctgaggctgaaggattgactcgggtccgactgtccgagaccaaactggtccggctcggtcgcggtgcacgtggctgacccaacgacgggtgggttgtgtgtttgcttgcaacccgcctggcgcctcctgcaggtggttcgctagcttctcgttttatactggtgaggtttgtactgtaggagtatttactgcggcgtaaatttttactggactggttagtgggacgttattgctgtaatgatattgttctacgatggttgatgctgaaacgactgctgctactcctgccgtttcattttgggcctattcattttaatgtcattttttattttatcaaattttagtaaagttgctaaaaaaagtggctatatttagtttgctgctaaattttagtaactatataagaaatcctaccaaaattttagcaaaatttgataaggttttttttttcatcagagtgaacaggcacttcatgatatcattagtcgtttagtggaagaaagcgaggagggagacgtgccactggagcccactatttttttttagattgagttagaatatctggggtgtataatatctattttatatagtttatgagtgtatttaatttctaacggtggcaaaagtttagaggggttaattcaaactttttcctagttcttactggggtaaaaacgagatgggcattttccaaccgcccatgtgactcgaggctcgtaggaagaatacaggacataaaatggatattcaatattatccgaattagaatccgaatccgtgaaaagatatgcttgtatttcccatgttattaaacacatatggaaatatattataagtccacctacaaggctacaaacatgataaaatattgattaatcactattttacaagatcataggtaatattgtatatttttttcttaatttatctcttttaatactttaattgtccatctatatttaatatgcatgaattgcacatagaaatagatttccgtgtatgaatctgattccgaggaaataatatgagataggatacgggatgagtgatatgttatctaatctaacactatatctgtacatggttttaaattaaaggaaaaatataggttaggataaaaaatgccgtgatccaaccctacatgaccccattttaccctagttcttaccatggaataattcagtcacgacgggtttacttgactccaattttccacacgctggatcaagccgtccacagttcagaactgagaacacaaaccacatggggtcatctagcacggaacgaggcaggcaatctacctgtactccttgaaggtacacatgccagaaacggtaagggtactcactgaagtttcccgggaaacaggaagaaagagggcaaagcttatcttttgcaacggaatcatatgtccactactaccaagaagggtttcctaggcggctagaatttcttttcacgcacaactacgaaaaacatattttgtagcaaccaaaataggttattgttggcagtcataagctccgccacataccaagggtccatacgggtggtagagcatccgtgcgcgaatttcttttcataaatggttagggcatccacccgaaactagatgttggtaaaaattagtaggatttatatatacggctccacaaccatatgtaaaaacttgattttcttcatccagagagagatatggtttgtttgttatggaaggatagtggtttcccaccaatttagctttgatggtttacttgactccaaatttccataccgtgtgtcaagccatcaaacaatcatatatagcacaaatcacatggactgtttggtcatcttgcacaaaatgaggcaagcatcctacctgcacctctagaaagtagtaccagtagaaaacggatacatgcccaaaacggcatccattattccattaagttccccggaaaacacgaagaaagagagggtaagcatatcttttgcaacggaatcgatcgaggtcgaggtgtcttaattattggaaaccatatgccaatatcttgccatcatgtatgtatttatgtgtagtggtgtgatgatatatatatatcgattgatctacttaaaagaaaacgagaaatgtgaaaattataaaccacaagcaacctagtgctttactggttgcacctacctacccttcgataaaaaatggaaaactattaattggtatagctaggttgtacattgcacgaaggaaaattttggtttgtgctaagagtcggaaaactgtctaagtctatactttgatctatgtaggctaggagaaattgttaggtctaaatgttagtacgtactgcttttctatgttccggctatcaatgcgtcaggcgcggcagtggcgacggcgatgacgggagctcgggcggcagtggggctagggtttttcttttggaattttatatttttgtgatttttttctttttacatgcggtcggcttaagcgcccgctggttgtgctagctgcatgcaaaaataccgattttcacataccttttcacgcatgtggctgcagcaaccgcatgcaaaaatcagtttcacccgtatgcaaaaacgtgttatgtagtagtgatggtttacctagtggaacatacaaaataaaaacacacccccacaatatttcgcaaatggtggtataaaatagggagagaaaaatacatatttttagcaaagtcaatttagccttatggttatcaactactacctccatcccaaaatatttgacgccgttgacttttttaaaaatgtttgaccgttcgtcttattcaaaaaatttaagtaattgttaattctttttctatcatttgatttattgttaaatatacttttatgtatacatataattttacacatatcgcaaaagtttttgaataaaacgaacggtcaaacatattttaaaaagtcaacggtgtcaaacatttaaggaatgagggagtatatcataaatatactgataattttactagagttaccaactatatcataaatataaagataacaaattcagtaagacatcaccctgcaaaattctaagcaatagatactgaccataacatgctcatgaagaaactggctatcagtatcatcggctcctgcctcctgggtgcactgcaactatgcagcacgcagatccgtggtgaactgggtcaagcaagcaaggcaggattctaatgctcaagtgaagatagaaatatgtacaacgccgcagaagtagatctagcactgagagagtaacaatgatcaatcaaaattggagcaataatcaaaacacatctggaaggatttgtggtgttgcatccaaagccaagcagccagctgaaacaccatggccaaagacgactggccatgcatatgctaatgtttggtattggagctgatctaatacactgtataatttaaataattatgtgattagtgggttggtataaaacataagctagtttgttgggcgaggcattggctccgcctctggggtttagctagcaagatagtaacacagaatgtcctttttattactatacggaagaaaatagtggtactggttctgtttggtaatgctgcattacagatgtagccggctgcgctgcacagccggagctacacattttttaccgtgtaatgtagctgctgcagtctaaacaagtactctactatattttgcaatgtaaattcactactacaaaacatcaaatagatatcggtactataggtgccggaagtgctaaaaccggtacctataggtctttttccactttcgcaggttgaaatcgcaaaaaaaaacgatacctttaagcaattataggtaccggttctaaataagaaccgacacctattctataggtgcccccttttttttaaaaaaaatggtacctttaatatattatagatatcggttaattaaaagctgacacccacagaaatcgagccgagccggcaggccccaccacgacgagataaggccgaggggataagaggttcgctcgcttctcgatctctctcttgcccctctctctctcactctctcgctcgctcgctctcgccccctcctccttctccccacatacggtgtcggcggtggtggcttctctcccacgacagatgcggcggtgggcgaggcggcctcgacggcggccggggtggcaacggcgggtggagccgcagtcgaggtcggcgtcggcggcagaggcttctcccaaggacggagtggtggcggcggtggcggctcccacgacggatctagcctcaacggtagccggggccgcatccggggtcggcgtcggcggcggaggtttctcccgcgggtggagcggtggcggcggcggctcccgcgacgaatccggcgacgtatcggcaacggtgatttgtactataaatttgattttgtttctatgaaattgttgagggatctgtgatttgagcttctttcacatgtgatttgtgtgaaacttttatgatttgtgctttgagggatctatcattggatggatcaaagatggtgctttgagggatatgtcttggatggatcgatggtgacagtgtgtgaaacttctgtgatttgctttggatcgatggggtctcgaggtgatggggaacggctcgatgcatcgagacccccccccccttttttttggattcttgggaccaaaaaggtgccggttcctaaaccggcacatttgaatattgttggatagtagaagagagagatatactgtgaatattagacacgttgtattgagcctcagggggccggtatatataggagtacaaggggaggagataaggaaggaatccacacatatcaatcctatcctaatatgactctaactaccatatactctaacatccccccgtagtccatgcgtgagcaaagcggacacttggattggagaagaaaccagcaagagtgctcaagacgaatgattgccctttgtgccatgtcgatgtagccaaagcgaaggatgcgaaggacccgtgggcgacgaagccgtgcgtaaagtagccatggtcgatgtagccgaagtcgggaagctgatgtcgaggtacccaagccgcagagcgcgcatggggcgccgtagagtggtcgtggacgcacaggagggcgtcatggaccaaggtgcgtgaggatgcactggagacgatgacggtgacccgatcgcggcagtcattgaggaagatgatgccaaagagccgatgtagtcgaactgtaaagaagagatgtcacgccgggtttgccagactcgggaacaactcgggacaaacacgcgcaacagtgttgccaatatcgtgccggcaaggcaagggaccaccgtgaatcatacgcaaatgtcggaggagactagcaaataatgcctccgggacagtcgtggcgtgagaatgacgtagagggagaattccggagcagcgcgcagttgctgaagaagagcgaagtgtagtcaagaaagatacgacgacgctggcgatgaaacatgctggacgaagaagaaggcaaagtaggaccaacggcctggacagcgacatcggtagctatgtagaggtagctagaccactggcctagaacggcgacagtggcagcttggagacacggcggcgatgctcgaagtagacaaagaagactcgagtggctgacgatgaccagtgcggatgacgaggttgtcgatgcacgaacgacgatgaagacgacgagacgggcgacactatgacccgaaggggtgatacaggtgtagctccatgttgatgcagcgacgtgaaatccagcggcggtgaggccacagtgaggaggacgtctctccgtggaccacaggcggcaacactgcggcccgagagggcgacgcagcggcaacccaaagcttgatggcgtagtagatatgctcgcagacgatcagttgcagaagtcatcatgtatgtgtgcttgatcaggtgatcagaccgaagttgcacacaacggaacaatgaagtcgaagccgaagttgatgccgatgtcggagacacgtagatgttaacgaggcggtaggcgacacaaacctgatctctggtcgggagaaagaagaaagatacaagcaacaacacagtagcagcagtccacaccacaccacagccctccaacgcaactcatgcaggtctggtcaccatgacgtcaacgaagtcaacaagcctagatatctccacaccaatcagtctctctcctctcacttggcagcaacgcacgagatcacagcagagacgatggctagtcaacagggtcaaaaggaggcactgcagaaagtggtcacagggcgctcggccaacgactgtccagccagagatgctgacggagggcgtcggcgcagcaagacggaggcggtgcggaaggagtccggcggccgggtggagaggtcgacggggtggtgccggcagagcgcgccaggccgggggcggtcggggctcggcgacgccggccgtgcacctcgacgcggtgaggaagaagcgaccgtccacccggcggcggcggggatggctcgatgacgagaactcgcgacgcgacgaccggtagatccatgcgttactgcggctgatgcttgactcaaaccaccatgacgccgacgagggtcactggagaagatcgagatcgatccctcacgggcaaccaccatgacgacgaacccaaaaaaaaaaggaaaacaaaaaatggtgcccgcccccgtgagatcgaaatgctccccggggcgacgagcagaagcgcgagcggcggcgaccctacatcacccgcttggataccatattgatagtagacgagagatatactgcgaatattagacacgttaccatctttcgtcggtcgtccaaaaacataatagtcctagtttgaataggaatcgggactaaaaattattaaagattatttttagtcttagttcaaagaagttggcgggtctgagtcaggccccaattatcttttagtcctgattggtataaacaaccgggacgattggtataaacaaccgggactaaagatctatttttaataccggttgtttatatcaaccgggacaaaaataaacagccgagtcgcgtgccgatcttatcttctcggtatcccctcccctttcgttctctccttcattaagactcggtatcccgaacagatcgatcgatcagagaggcctcttccccttcctttccccttcttccaccttcccctctcctctgatccccctccccgcctcctcctcctctttcccctttccacggcggccgggcggcggcggcggagcgatccggccgcgcggcaggcggctgtgcagcggacgggtggcggcggccatgtggcagccggtcgggcggcggcggctgagcgagctggctgcgtggcaggtggccgggcggtggcgacgtcggcccacgctggatgaggccggcggtgactggcctccctaagtgtgaggccgggtaagttcaattgttaggagcgagttcagatcttggctcctgacactaaggagcttttttttttattttgtgaattgatgtgtagatttgtttgttgatttggggatgattggtggattgcggaagggcatgtatagtggatgattgtgtatgatttgtgaatggttttcttggatgatttatgtgtgtgatttttgtgtgattgtgctcgagatataaacaacaaaacaacaatgaaaaaaaaaagagaaaaaaagtaacaccaaccgagactaaagatccggttatttcaactggtccggattcatagtcccagttataaaaccgggactacagggggttaccaatcgggactacaaaaggtttcttcggtagtgtaaggaaggattacaaataggaaggaattcacacatatcaattatattctaatatgactctaactaccatatactctaaccaatattcatatatgtgccgcttctatggtgctggttgagaaaatcggtaactatgtggggttcctaaccggcactgatgtggtgtagtgattttctatatcttatggtttgatatctccctgcagtgatcaagctaggcatcaaatattgaaaccaccgtcgatatgttggtggagacgcagagtggagttataggtgcataagcataactacttatcaaatgtagttcggttgtgcctaaggctgtgcatgttcgatacattgagttgggaactaatctcttgcgcatgcaaaacacagagcgacttattagcacataattaattaagtattagctatattttttaaaaaatagattaatatgtttttaaagcaactttgctatagaaaatttttacaaaaaataaactatttagcattttgggaaacctgcgtgcggaaaacgagaaagaatagttgatattagatgacaagttttatagtcacatctaatattatccatatcatcaactaatttactaggggacattgtgaaaaggttgctttttacatgaggggtcgttcatcctctctctcctcttttctcttctctaccttatcatttaagcttatgtgttatctaggagctcgtgggctcgtgcttagatgcttatagtacttgccgatactgatagataaaaataatctcgttaatcttattttataggaaggatgtagagtattacggttggaataagatcactttgacttcctcaactgaccaccaaatctaaatcatatccctcaaccgcaatactagaaattttgaacccccaacttacaaaaccggtacaatttgactcttttggtggttttggagagtggttttgctgatgtagcgcacacgtggcagtgttgacttggtcttcgtcccacgtggcgttgacgtgacacttatgctgcattaaaattaaaaaatatatgcgaagcccaattgtcattcacacaaaaataattgtgggccccactgacatgtggttcctacatgtcatcctctctctcaccacccttctttttcctcctctctcccttatttctctctctccccttgacatgagccggcggcaggtgggggctcgagcggcggtgcggtcggagagctcggcgaggagcgcgttgacggagagcagcgcggcggtggagcccgcgatgacaccgagcacgacgcctgtggtgcccaccaccttcccgggcaccggccactcgatcttcgacatctcctgcgcgacgccgacccaccacccgctgctgatggccgcggtctcggcctccttcagctccgccgccaccgtctcggggctcttctcccctcctcctccttcccggcctcctctgcgccgtccaccaccgtcatggacgcctcctgctgctcctgctcttgccccttcttgttctcctccgctcttgcgcccttggacttggagccgcgagggcgaggcgtccgcggcagctgacggcggcggagcgggagagggatagggagatcgcgggagggtagaaggtggagaaggaagcgcgcgaggcagcggcggcggcggctgggacaaggcgggcggcgtggtcgccatggcttcccggtttgatgggtccagcggcccgtccgccaccgccattcggagctctggatctaggccgtcgccaccgccgattcggacgccgctccccacgcacaaagagaaagagggagagatagagaagggaggagagggaggaggaagaagggataaagagaggatgacacgtgggacccacatgtcagcggggcctacaattatttttgtgtgaatgacaaatggacccacatatattttaaattttaatgccatgtaagcgccacgtcaatgccacgtgggacaaagaccaaatcaacgctgccacgtatatgccacatcagcaaaaccactctccaaaaccaccaagggagtcaaatcgtaccgattttgtaagttgggggttcaagatttctggtattgcggttgagggatacgatttagattcggtggtcagttgagggagtcaaagtgatcttccattacggttacggtaaatagtttatccgatccgtttgccttggtggacggcccaatacatcatcacggcctatcgaagttcggcagcccgtacgggcccatgactagcgaccacagtccgggcccacacccacaccgcccaaccaccccactcccctccccgccacgtcgccattcttcccgctcctgacctttctctacccttctcctcttctcttctcctctcctcccccaaataaccaaaccaaaccctgtataggctcgtataggccaaggcagaagcttcccaaaccctcgctctgcccgtcgatctccgtcgccttctgatccccgcgcgcgcggctgcctatatataagttgcggtgatcggcgggcggctgcaccggcatggggctggagatcatgacggacgaggctgctgctgcgccttcgcccgctgcggcggcggcgcgtgtcgagatttacccgctctgccgctactacttcggcgccagggatgttgccgctggtggcgcgggtgcggggttggagaccgccgccgaccgcgccctccgcctcaaggccaagtacgcacgcgcgcgcgcactacccgccacctgctcgatcaaatgcgtgacgatcatgtaattttgtgtgtgtggtttgattgatctgtgcagcttcgcggcgcacgggctccggaccagcgtccatggcgtcctgctggttgagctctttgatcatccgcacgtgctgctcctgcaagtcaggaactcctccttcctcctccccggtggccgcttgagaccaggggaacaaggtgctcatcaatcatcattgctgcaatttcccaagttttcccgtaaaaattttaggaatggattgaattgaacctactattgaattcttgccatgtgcaagtgtctactgccgagtaggatgtgattttctcctcgtgggagataatgctagtgcaccggtacacttgcaatttggatgacacgtgtgttgcctggtatctctgcttcagatgtccaagggctcaagcgcaaactttcaaccaagttatcggtagctggacatcaggatgacgaagacggcgacggggacgacgaatggcaggtaactggagtgaacagagatgttcagtaatgttgggagtgagaccaccagtatgatccagcaaattattcatccttttcacgttgattatcggctatagattggagagtgcattgggatgtggtggagatctgagtttgatgctgctccatttccatatctacttccaaatgcccgtgcaccaaaggtaaagagcttgacatacactccggttcatccatgaaccatgtggtttcctcaaataatattaatgtgcttataacctgagtgaatcattttattgttgcctgtcatgaaggaatgcataaaactgttcttgattaaactgccggtgtctcgccaatttgtcgtgccaaggaacatgaagctgctagctgtgcctctatcccagattcatgacaatgctcaggtcagtttggttatcaccatccaacacaagggattttaccatctttttttaagctcagctgcttcagctgactctttttttttttgcaggtatatggctcaatcatagctggaattccaaacttgttatcgaagttctccatgaacatcatcagtgactgagatgcatgccacatgccgttaagagctgtcacggctttacatgagactagcatattcgatctagtagtagaacatgttgtgtataaactgtacctggtagaaatataaactttggaattcacgagctggtgctgtcctgtatgttgtgcaatcttttttttttcttttactgtatagaggtaatgtattgtatttgtatatgttatcaacaccaggtgtggtgttatttttgtaacccttctgatatggctgtagaaatgaaacagttctgtacaagatttgtgattttcattgccagtcctgacaaaagctgaaccaagcacacctcgctgcgaggaccaaacatgtcttttcgattgcccaagcaaaagatagagatagaactaaacaaactttaaaatatgatcgttagaacagccacacccggcacaacctttcgaagaacatttgtgttgtacgatcctccatgagcgtacaaatagctttagcccaaaaggaaggctacatgtcgtgctgcagcagctcgttcactgtctgagcaaggttaggctcgctcctgatgctctcgatccatctcgcgctgatacggaccctctcgaggctctgcttcagtgcacgctcgaacgatggtttggttttaccggcgaagaactcggaaacttcagcagccttctcctctgtggtgaactgatcatgcagagaaaacggcgaatttagcagcagagcaaggagaacaatgaagcaaaaagtggtcggtgacttcgcgtacccgtgaaacagtagatttgacgaagtccgatatgagtgaacttgatggccaggtcttcaagacatgatcccagttttcctgcatcatgcacagatgggctcatggtcataaaagtacaacttactctgaactcctaatcagacttgctaaaaataacagaacttattaatgtaacttcttcgtttagctcattattactgcctctgtcccataataattgtatttataggatttgaatttgtccaaaaatagttatcacaacagaatactaatggtctcattaatcatttcttattcaaatttctctctattttaccttcaactaccctcccactcttacctatataccatttaataaggggtatcatagtctttcttcttaaaccttaatatatgctaaacaacctagaattacaattattttgggggcggaggtagtatcaaatagtgtgttatgcaggcagcatctcttctataaagtggaaaaatgtgttctattgttattcatacgctacaagcttggatttccctcgaatagcagagagctatgcagaattgtggactcgtgaatgggtttggagatttaaatctcatggaggtgatcatcgaaatttttttagataatggaataagtttcccagccattggtaagggcacaaagctcattagcagcatactcctatttggtgcaactgcataaacggcttcagttcatctgtcagaacagctttcctatgatgtactgtgtatctcagtaaaaccttttgcttttttgttttctggttggctaaaagagcaggaccaatgatatttggtaaaatagattgattgcgccagttttgggtgaagagacctaatcgtgcaaagtgtgaacagggagggaacatcattcaattgcagtaacttggatattggcacggtcggtgcaaaggaagttttgataatttcatcttccctatttcatctgttttagttccatcgttaacttttaacaaattatttgttcttgtattgagatagacacctagcatgcattggcatttggcagaacaattgaactttgaacccctcacaacagtaaaaatatatatatattgagcaccacatacagtgcttatgttttttctttcaaaaatatcagaaatgtgtgcgttgtttatcagataactataataatccactttaggtaccctgcaactataataacataccttcaaccaggcccatgcaacttctcgtccttctaagctgataccaccaaggacataaaatgcatcttgattccgtacctaacaagcaagagagagattagattggcttctgtaccaatggtgtataatggttctcattctaccatttactatctggaatcatttgttcagaataagtaaaatataaatgattcagagggttaacctcatcggtaagcatgaagtttagtgcctcaagaacaatatccttatccaggcatgaagacaatgaacctaaaacagaagaaacgttactttccaggacaactcatcagaaaattcctgctgtcgcttaagctagacggttggaatgcacaaacctaagatgcgtgacttctcctgagcttcagctgtttctctgtagattttcaggagggcatcataaccagctctgctggaggtagtaacagtccgcatcacagcaagatatgaagcctgcagaccaatgcatatcagtatgctagatatcatagaggtaacactgcagtagtatgttaagcaaaagcctgaacctttctagtgtctgggggaagaatgttagttttgcggtcttttatgaagatatggaaccgcctaactccctcatttatagtctcatcatgtccaagtttgacaagggcaatcaagagcaatgatctaagcattacatcaagatggctctcgccctccttgggatcccagcctagtgttctgatatttagaagtacaagaaggatttcaatatgatcatagaaagaaaacagcaggaatatagtagacagaagtttattaacagaaacaaattcaccagtggcatgcgccaactcagaagtaaatatacaaatgcacataaatgataatatccagattcgtgaaatccagataaacatgatgatgaaaatggtaaaacattaagtttgttagcatacttggcagctgatagaagaagattgatcaaaagctgtttgatatctctggacaattcaggagtagcatcaactgatattttatcaatgcctaagcatacctgtcaaaaaggatgcatgtatttaatattgagaacaatagttgataccatagaatcaatcaaagatacaaggtatatgatttcattggaggtggcgaaaggtttacttacagaggttacatgtgaaagcacagtgtaatcagactcattgcgataagcattcagcaggcgaagcaaggatgtcagtgtttgcttgcgagccacagaaagggagtatgaatcttccacaatacctgcagcaaaatattgtgtttctgttgtcaaaatcttgacaaggatatattatacgagtagtattgaaaattcatcttgtcattaccaatcttatccattaaagagagcttattggctttgattgccttttcaagtccagctgcaagttcatcatcatacttcactctataaaatccagtttggtcaacgttcaatttgatccaacagttttcacccttctctcctccggcattttgggaggcagtgaggtctatatggaccttatcagtcttgcccttcaagagaaactttttctgtgcatcatatgagccacaacatgatgttataggaacaatccacaagcctggaccagaggatccgtccgatagaaactgtgcctgtaatagaacagacttcagtaagctcctctttttgcaatatgaaagcactgatatgggccagaagaacgaaattttctagttccaatacttcgaaatctataattttgccagttattggatgcatttgagaaaaaaaatacaaccatacacttgtgaataaagacatcagcagaccatacatgaataacgaaagataacatgaaacacaaagcacactatgatattctcatctccagttattatggttctgagtttctgatcaaggtgacatgcatgttgtcctaaaagtgtgtatgaggaaaggtgaggtcctctagacaactatgagaagttaaaaacaaaagaaacaaactaatataagattagatgtatgaataaaagtagaggttctggaaagaagcgatcctgaacaagtgactagtacagctaaaacttagacatataccacctcaaatccaaataaaagtcattttagtcttttactcttttcaatctctctaagtgcaagttactgtagaatttttgaggcagttttctcttttttccctccattctctttctacttgaaagctactactattatgaataaatggatcgtgtttttaatggaataaatgaagggaacaacaccattttgctacttccttagttcttgggaataaggccaaaaagacttagatttcagattggacgaagcataaggcaatggaataaggcaaggccgatggatacatatattcagttcttcatgtatgttggtataacatgagaatgagaaatctgccagaaaacctgttcaaggtgcaaatcatgtccatctagttttgcataaataacagggtatccttgttgcttagtccatgtagtcatcaaatccttaacaggttccccagattcctcctcaagaacagcccatagatcttctgttttggcattcgagtaagcatacttctttatatatgatgccaaagctttctgaaagagtaaaaaattcacaaaatcagcacctgccgaagactaataaattgtgataataaatacaaagtcaataacatgacacaatctcatagaaagacaacaatatgctaatatgggtactaaaattctaaacgttgttaccgagtattcaaaagaaatgatgtaattgtaaaattatgaatatcttttctttatttatttttcctgtaaagagactcttatcttgggtatagtaaagctggatcaatcttcatactttggtctaaaaacttatgagtatctttcatgaaaaaatcactcacaccattgtttatatatctcaactatatattctacagcctttggtaaaagttgatatgacttgttgaccgcatgcattctatgatatcaccttctttactggaaagaataaacaaaaactaaaaaagaaaaatccaaactcaagatattcttcagcagattcaccacagatttgcaaaatgaccagaaacaaagtcaaagcaaacaattacgatgccctttattatttttggtcaacaaaattttcttaatcaatctgagttaaatgcaatctggacttctgtagagccatctagcgctgagttgtttatgaagaatataaatataacatgcgtggataagagtgtcaattcaagagcgctgatatactagcagcaggagatgctggaggctggaccattgcagaaaacaagattttggtaaattcattcaaggagaaagaagaacaggatttaacctgaaaacgctctgcaccaaggtaactttgcagcatgcgaatgacggaagcgcccttatcatagcttatggaatcaaaaattgcatcaatttcagaggcatggtttatgtcaacctgaacgaacataccaaatagccagattaacaactgggacaaaggtgctaactctgtgaagacagaaatagtaaaaaatgcatggcagcatattgacatatttgagtttctacccaaaaaaaaatctaatttctaagcatcaacacctgaataaattaagcaaagatttataaaaatatcaaaaattggttgtattgtatgactagtcagtattagggatgaaaacagagcagatagttcccgtccgctccggagaaaaacgaatacggatacctttcggatcggataattcttggatagttcggatacagatacgaatacgaatatggtatcggagtttctatcggatacggataataattcagatatccgcagaagccatgaggcataccccgtttctttatctttttagattttaagagtagttcatctcttaacactagtccacactattaatattatttaaatttttaaaaatatttataaattatactacattttatataaaatgagctaattatatatgttgatatttgtttctattagaagttgagttggcttacgtgttccgagaaaaaatttgtttccgtatttgtgtccgatcatgttcgattcttattcgtattcgagataatccgtatttgtttctgtattcgagctatccgtattcgtttccgtatccagcaaaaaaatatgaaaacgaatatggtatgagcattatctgtccatatccgctctgttttcatccctagtcagtatgcatgcacaatttgtatccttgttaattcacttatcttactgctttcatgtacttccatatctgtaatgcatatttgtgcagcatcaaaatattatgtttcttatccatcagtgacttcgccaaagcatactgaagaagattacctcaataggatgagactctgcaagtgcatccagtctgagaccagaggtcgtctcatcaagaaattgtgtccagttattccattctggaaataatgcttccacagccaaataactcacctgttgaaacatatggaataattagccggtaagatacacaacaattggacaatatttctaatttctcaaacaatagttttcagattgaatacccaggaagcaaaaccctcatttagccacaagtgagtccaccactccatggttacaagattgccaaaccattgatgagccaattcatgtgcaacagtgattgcaacctaaagagaacagatgttaatttttctttctttctttcttttttaaaaatagcagtttacctggccaaaactacacatgaggattcaagtgcgagactaactctccaatagtaaatgaaacaaatgaaattgataaagataaatataggcataacctgttgtttattggatgctgaggataacagctcatcataaagtaaagctgtttctcggtaagtgaccaacccatagttctccatagctccagcagcaaaatcaggaatagcaaccatatccaacttcggtagcgggtaaggagtggcaaaataactgataaaagaacattattagttattgtagtgaaataggcaccatccatggtattctgcctcatctttagaaataaagcttagaagcaagactatgttggaagcttactctttgaataaatccagtgacttcactgcaacatctagtgcaaactttccttggttactcttgccaacttgagtatacacacgaactttggtgcctacattaaattaacaaaagccaatgaaaaaatgtgtaaagaccaggcaaagaagggacatatcatatagtttgaatgaaagagagcaaacaatggagacagaaactgaaattctaccttctaatgttgagccctctatgtaatcaaataaaccaacaactatagccactagataagttgacataagtggcgattcctcataatagacggtcttgagaggtccatgaactgtctccttaattactggcatgttggacagtgctaccaactctgatggaacttccagtgttagcttgaacttagcctaaaccagaaataaccagacaagaggtaatgttattttagataattgatccaaccttccaaattctacagagcaaggagccaaggaccatgaaaatattagttaagacctgtgtaaaaactagaagtgcaaactgaatttttctttcattacaatattttcctgtctgaattacatcaaaacactcctagggaaacaacattgtagcatgttaaacaccttaaatgcaggttcatcccagcatggaaaacatcgtcttgcatcagcagcttcgaactgtgtaactgccatatttcttgactcccccttgtactcatacttgctgcaatcaaacacggaaacaccacccacaatgcattaaaaacagatcacaaggatataaagaaagtacaaccggtgcactccaaactacactgattatgtaatgtatacagctttgttacaaaaatgaagataaaatccaaacatggaggtcctggataatatatacagtatttatacatcacactccaatcatgaatcttggtgacacaaagacaggacaggagtaaactaagacttacaaatggtatatagcacaggaaggtactagttacatcaaattgtggcaatttcaaataaaaatggaaataaatatcccaaaaactatgtttgctatccaagccctataatattacaacatgccaaaaaaatcataatcaaaactacattattaagatggatatacatatgctaatgctctatagggcctggtgaacagtgggtgctaggctgcgagttatggatggtgttatggtagtatggagagcagcatactctaccaatagcgtatagtgtgtgttttgaagacaagatcaggatcctaggcagacacaaatggttcaataagtttaatgaagagtgtttcaggattaacaaagagtggatggtcgatcattataagataagattgtagattcaagctcacatcctaaagatcctgagatcttagtcactttctaggacattaccaaataagatatagatactatccattgtcttagcacatcaagcatggcaacaatttttgaaccggtacacctagcccttgttgttaaagttcatgtgccaatgctattgattgcttccaaacacacacttgcagtttccatcaagtcactgctcgaagcctagttactcataacaacgaatagcagcttcggacctcatctagtaggtgtgaaccccccatggttcataggtattcaagtggatacccaagatatttgaaaacaatgcgttatatcataaagcttatcttattgtactggtttaaagctttcttattatatatcatgtcgagggttcgattcctgcatcctcaattcttttttctcctctctttattaggtgttcaatttttttgtcttctgtttgttaggatttcaatagcttgtagtaattgtttgttagaatttcaatagcttgtagtaatactagtgttaggtgtcttggactcttccatacatcctatgtagtatgtaatatttttcttatttcctcaagtttcaattggtcgtctccagcacgaagaatagatattcttaagtcttcttttttaactaatattggagtaagaatttgaaccaattatacattttcagaaaagtagcctccaaaccaaaaaaattctccaaattcatgtaaatcatccaaactatggaaaactatttactcatttttaatggcatatcaaaaatgatttttcatagatatcgtgacattgttctctaaaactcgattctctatctagaaatcccacgtccgcgactaccatctaataaaccagaactgcaagctgttgctgctggaatgcctgttcgcacctcatgtgaacgagagactagcaacaatcaccagttatctgtaactgaaagaggtggcaacgatacctcctgtagaagcctctcatctgatcgttgagcgtcccggtgaagtccatcttgagcacgccctcgccgatcggcagatcctggccgaacccgatgaccacgatctcgtcctcctcgaactgcaccacctcggaaggcaccaaatcctacaaaaccccatcatacaacgattgagcgaccctgaaacgaacacacggcaacaacgcaaacagacacggatggttaacgggggaggcggtgcgcgcgtgcctggaagcggacggaggatccgtcgacggcgagctcggcggcgttgaggacgaggaatcgggtcggggcggagacggcgacggcgacggcggcggagccggagaaggcgcaggcggcgaggtcggggcggaggcggaggtcgtagctgagcggggaggcgcaccgcgggagccgcgcctggccccggaactgctccggcgaggccgccatttgcggcgggggcggtgtggcggtgcggcggtgcggcggcgggagttgcgacggcgagtgggggagtagagtagtggggaagggagggagggaagaatacgattatgcccctcgccgccggctaaaaaggaagggaactcttgttcggttgcttccgggccaggataagcaccttggggccgccacgtgtacagagcctgaataggtttagggccttttggcccggacccagagggaaccttgggcactgttttaaaagcctgagatccttaatactccgaccccgtttgatagggttttaaactctaactccagcaagagctaactcctatagaaactgaagtgggtacgagagtgtttggctagattagtcagctccactccaccacgttccttgtaggcattttgtcgaacacatggttgcatcgccttgctactgtcgtcgccgccgccacccacgcgtcgccctacacggccgcggccgctgtcgctcgcccgctgccaccactgtcaccactgcccgtgcaccaccttggccaccacaacccatgcgccaccgtggctcgcgcgcctcccgtgcaccaccatcgcccacgtgcccgctgacgccgccgccgcccgtggctctcacgcgccgcgccgtgccaccaccgcctgccgccgccgacgttgacgccgtcgtccgtcgctggctcgttgttgactgctgtagggagggaggaagatggggagagagaatgggaggagaggagatgtgaaggggtagttcagtggtatttttgtgtaaatacataaaaattttaaagggtagtgggtcttttgggtggagtggagctgtggagcagcaaaaatccagctccacccccatagttgattttttaggagtagctctaccagctccacttccaaaaatggaggatctggactgtttggcgcaactccggctctaggtaagttggagttgggagctggaactatgccaaacggggcctccctctgtccatattataagtcgtttgacttttttttagttagatttatttttttagttagacttatttaagtttgcaagtttaaaaataaagtaacattttcaatacaaaacaaacattatatcaaaatatattcagtgttaaatttaatgaaactaattttatattgaagatgttgaaaatgctactttatttttctattaacttggtcgtacttaaaaaagtttgattaagaaaaataaataaatgacatataatatgaaacaaagggaatagtttattttctaatttttgagctattaaatcagaatgtggataagagtttagacggtttggggaaaacgaaaactattattgatcataaaattacatggactttttctataaaattgaaaaatagtttccgattcaccaaactaattcttatctatttctgaaggaataaaaaaaatactagaattcttaatttttcaaaaattttctcattgaaacaatcaaaaattaagaataggttttgttggttaaagtcaaaaatttttcatataattttttattgcatatgctactacattttttttcatgtaagtttgagtactttttcgtattattttgtaaatataaatcaagtataaatttataaaattatttcatgtttaggatagaaaaatcaattttaagatggaactttgtttaaatatggaaattaaatgatgatagcgatgagagctgttatatttttcatcaacgaatgagaaaggtaactgaaattttacaaatgacctgaaatctaaaccctccctgcttaaatgacaatattatatcaagacaagatttttaatggtgtgtttcggtttgccgcttatcaaattattttgacagggtaataaatgaaacttgccatatagtattatccaactaggctccaaagcattgcaactgaggatccctcgagtgtgttgcatgttttctttgtagcatgagaattatgcacaaataaatatcaggacggttcacattgaccctacaagataggtttgatttagttcctaaaattcttttacccaaaaacgtcacatctaatctttgaacacatgcatggagcataaaatatagataaaaacaaaaactaattgcacaatttgcatggaaatagcgagacgaatcttttgagtctaattagtccatgattagccataagtgctacagtaattcacatgtgctaatgacggcttaattagactcaagattcgtctcgcggtttccaggcgagttatgaaattagttntttcattcgtctccgaaaacccctttcaacatctggtcaaacattcgatgtaacacccaaaaatttccttttcgcgaactaaacagggccatagctcagttcatcactcgtgaaaaaaaacatatatttatttttagtgttaaaaatgagggatgtaattaaaggagctctttcttctcaaatacgcaagagagttggcatattattgcatcggaaaaggagaaaacataatacacgacagactcaacgcatcacgaacgcaccacaaacaaaaagaaaaaagattacaccctaaactaacaataggatctttgacaccaaagatcaaagatggcttcttcttgatccaccagttaccaagcacaacatcaattatttttttatgggaattactgttatgtatttgtccaacagtatggcatttattaaaaaaatatttacatcatacaaaaggacatgaaaaccgtagaaaaaaattacaaagattgtaatcaatcaagaacattgaatcaccaaccaaagaaagaaatcaaagcattgactgagcccttgactacaatgtagtaacttctacatttgttagagttgattcttttaactctctcgttttaattcaacctgtaacagtctctcactcatgtactcttaatttggatgtaaaggaggtacacaacttaattctttaaaaattaatattgattaccaccaagtttaaccccctatagcatcaatgcagtagctttgttagagttaattcttgtaactctcttgttttaattcaccctgtaaatagtctctcatgtatggctatatatattttaaagtttgcatgcaattgacagtaagaattatctcattccatctctcgctctcccagttctttatactttttcatgcctggtatcttatgaatcatatataggttgttatcattataagacaattttcattaatggaatagatagccaggtaggttttcttgctagctagtagtactacagaaggaaaaataaaatgatgctattcttagctgaatgagactttcactcttatcctcacaacagcatgcccaaatccatacactatcctaattatagagctcaattttagtttgtatatatccatagaactcaattttagtttgtatatatccgtactacttgaaattggttttgttgtccacaagagtcaaggctcacagaaatctcaccacagataatcttgttagtttcttgagaaaggcaagctagctaagctcccattccctctgcatttgaatctttgatttgagaagcttcatatctccatttcatgaaaacatgactggtgtgttaattccaagctaatattgtgaacattgcatcatgttctctgtcaatgcagatggaagctgcagatgtagccaaggaacatcacaaggaggagaaaaaggacaaggtaaacattcttctggttttttgaaaaaaaaatttgttgacaggataagacttattctcactcatgattgtgtgagaatcataagaaatgacagtcgaactaggagagttctcacaataatacaagataataaatactagtcttcaaaaccaaaaagaaaggtgatactatatttgatgcttacaacaagaaattctcaaacaatcacactttagtcacacaaccatgtaacattgctcaccaaactctgacgaacatctgcactcctttttgcatggcaattataaatcatcatcatcaaggaacacgccaaagaggcgaaaccggagaaggagaagaaggagaagaaagagaagaacggcgaagaggcggcgaaaccggccaaggagaagaaggagaagaaagagaagaaggagaagggcaaggagaagaaggagaaggtggaggagacgacggacgtggccaagctgcgagccaagctggagaagctggacgccaagatcgacgacctcaaggccaagaagcaggagatcgtggcccgactcgtccagctcgaggagggtgcgacggcaaatgctgctgctgcagatgcggcaccacctgccagcggctgaggaggaggtgatctgggattcttaggcagttcttgcaattggacaagaggagaaattacaaacattttcagacatttgcaggatttgcagctagtgacgatctgtttctgaatggaagctttggtacagaaatttttgccttcttacgatgatgatggtctcaagtcgtctttgctgaagaccatggcgccattgagtgttgcttgtatgatatgatcaggaagtgaaatttatagcgcaaatgagtttcatttgcaagatggtgttggagattatgtatgtgtcacgataattttacgacaagatcgattcaaattttctaaaagaatcaattactacagaaatgtgctcctatacctaatttctctcgaaatttatatcattgtttctgcatgtcctgtaaacaattactagcagagtaccagtagagctgaagaagtgaagaaatgcttttttttccctcttgagttcgtgccatccgttgaaaacaaacaggaaaaggcgaataatcttaagcacagtttctcgattttcaatgcagaaatcccagattcccatctccaaacctccgagcattactaacaatccaccaataatctatcccttaaactgaaaatagaaggtgaaaaaaccgcttcctccaagagatacctaaattgaatctcaaaaactaaaagtgggctcttctgttaaactaccaacataaattgttaaccttagttttttttagaaattgttaaactaccaatagaaatcgtttttttagaaattcgagtggaaggaggggattgggagtcgttctctcgccctcaaatacacgtaccgagaaaattggagatgggaactccaaaacgtccagagctcttttgggaatctgttggaccagttttttttaaccaaaatcccaaaaaattaggattgaggatggaatagatagactgttggtgatgctctaaggcactgcactggcagagaaaaaaagtatggtactccctccgtttgaaatacttaggccaaaggaaattcataaaaaatttaaaggattttattcttatagaaaatttttctatatatccctttgaatcaaaagaataaatcctataaaaccatatgaaatttctatgaaatgtctcttcccagacaagttttagagaaaatttaacataaggtagaacctcatggaaagaatatttctccttaaattctggtgtttttcctgtgacttaatcaaatggtcattcctatcttctactgtgttttacaatcctctgttcctatcttctactgtgttttacaatcctctgttttacacttacattcttgttagaatcatatgttttttttctattcctccgttttttcattcatgtaatttaaaggggcccttttagttgtagatttgttctgtcttaaccatcaacttttaaaaatttgtatagattaacaacatgtgaattatattttatgaaagcatttttcatagtaaataaaaaacataaaccttatgatgttaaacgaatttttaaaaattaatggtcaaagctacaaaaaagtataacttaggacaaagcagcaagaacgacaggtaatctcaaaacggagggagtatttgatatttctccacaagcagtattaaactctagcattctggaaatcatcatgacatcacataataagatgggacattacttaaggtcactaacatcaacatgcaaataattccaaacagcccggtaacacttaggaattatttacagaaacatgcaattcaagaagtatattgacactcgtctagggaaataacctcaggaattactatgaacaaacggtactgaagcacgcgtgcatgtgatacttacaatagaacttcttttgcctaagtttttatctcacaaaatatcgaatacgtagataaggtattactgcagactttcgtaatgcccaagaaatccagaacatccattccctgccatcctcttagatcaatttggcctggagctgaccatctcttatctgcgcagcgatatctttgacggcacctggcccgtgagggatgaacactgaagaggacttggatgaggctcctatctccttcatggtgtcgaagtattgcgtaaccagaaccatatccatgacatccttggcagaggtcccaggcacgttctcggagaaggcaagaacactgtctctcagcccatccactatagcctgacgctgccttgcgatacccagaccagccaagtacttggattctgcatctccttcagctctcttgatctgaagaatcttctctgcttcagctttctcattggctgccaccctcagcctagcagctgtatcatcaaataacagcagttaaaactatgttgccgtccagcacatttacagccatacagctcatctttagaaaaacaccagaccaaccaaacatatatgttgcaggcccttaaaaagcacgaaatatttacttgactagttgaccaacacattttttgttgcacacaatgtaatcaataggttgcagttacatgtgcctgtgttacttatgactgttatggtgcaagtattcacgaagttaatattcataatatgttatgtacatctatatataacttttcagtgttccatctatatataacttacagtgttactgtgttgaaagcctaaaaatatttgtggcaacaattttcagtgtttcagtataaaacttgaataaaactagacaatataaacatggttttgtttctcggaaagagaatttaacattttcatgtctaaacaggagaaaattgtttccaatgcaagctcaaatgtcaagcataaacaccaagccaaataatgtctctgaagaaatggaatgaattgatgttttaattaatacttacctgcgttgatttcattcattgctctcttaacatgctcatctggttcaatatcaacaataagagtttgcacaatctcataaccatacattgacattgcctacagagtatatactaggtcagtataaaactccactatgctctagatgaccaccaattattgaacacaaaccttttcaagctcatcttccacagcttttgcgatctcattcttctgctcaaatgcatcatccaagttcatctttggaacactagccctgatcactgcgaggaagaaagttctgttagcattgaacaatagaggcaaaacatagagaaggtaatcagaagagtatgaactgcaaatgcatcggatgcatgaatgttcacagcatacaggaaccttaccatcaaaaacatacgactggatttgctccctggtgttgctaagcctgtaaaaggcgtctgatgccttctcagcaagagcacggtattgcacagatgccacaacattgacaaaaacattgtcctgcagatatccacaaaatggtatacatcgtcagagagctcagaaaaggtgggtttattctttgatgcatcatgcattagtgtaagtgaagaataaggaaaacagagatatgtgcacataaccatcatcagtatgttatcataaaggagtaaacgaatggaacaaaatgcaagaattttgagaaccattttttatcatgcctgacaattgctccagacacttgccatgaaatataaaagaaaccagagttaagaaaataaactggggaaccttagtctttgtttcacaacggacatccagctgctgcacacgcaaggaaagatatccagcgatctgcttccctatgcaccagggtaaaaagtggcatccaggctcaagaacctcatcaaacttcccaaaggactccttgatggctactgtcgattgatctacttgtaccaaaccgagtgcttgacccatggcttatctagaaaggaagaaatgcagaattacaaatggtgccatatgctaacgaaacaactaacaactgaatgttttgccataatcttgcttatactccgttggtgttaacttctccaatggaaattcatatttcaagtttttagtacatacaaacagaaacaaaagatatgaattaaaaaagataaagccatggcttcaaatgaagatgaatgtatgtcaggacaatagattgcccaacgcatcccaaatgaaaagtcaagcaattgcaatttcagataacttagaccaaacagtgttgcaaaaaatatgtatatcttgttgaaaagcatatcatgataacacattactcaaacttatactgtgtaatcattccctgaaaaatgcctaagattactactccctccgggctgataatacttgtcgttttggacaagggtgaggtcaaactttagaatatttgattatataaatcatttttaaaatatttgtctttcaaatatggtgactacatatatagattggtcttaaaaagtactttaatatgatcatatatttgttaacacttttttacatattataataggaaataatggtcaaagttgttttttgaagaccgtgcgcttgtccaaaatgacaagtattatcagcccggagggagtacatcacaggctcacagaagtcaacagggtaatagatgtagccatacaaaagaaaagaaaacaattcaccatagaaatgcagtaatgaaaaagaatgacgcaaaagaaaacctatacgtgccgatcaacttagtgctgatagcctgataggataaatctgcttcaggatgttcttggccactacagactacagacaagccaaatatatcatataaatagttgaagctaaagattatgctaatcctgattatacttgggggaatgattatacttttgattaaatgccagcgcaagccagcaaactctggcgatgcaagccaaagggcagacgaatcaaacaagacacttgccaagcaatcattgtttgataaaagtcaagagcaagaacccacagggctccacacgacgaggtgacaactaagaaagtcacaatctttagcgagtagtattcatctgcgtcataactaaacaagaataaacaatacagccacttggatactgttgttgagaattattattatttttagctgaggtgggtacagttcgacgttaacctccatctcatggcctagtctagcaaaaaagatgtgcttgacttgactgaaaaaacctcctgaaatttccaagcagtatgtggacaaagctggaacagcacaccatcgaattttacccccactcgcaaagcgcaagccctaaatctgtccgcacagaaagtggaaaaaaccaagaactcaaaccgcgtccaagaaccaaccgcaattcccaggctaaactcaaggaaaaggaccggagaatcgacgaaattacccaccacccgattccaacatccccctccccctcccccctccgacgaaattatccgcccaatctcctccacgagagctaaatccgtccccaaaataataaaaaaaagaaaaaatctagaggaaaccccaagaaacaaacgctcgccaagaaattccaagaaatcgaggtcggggctcgggctgggcgcccgccgaaggggagagaggctggagaggagcggggtagggcttacctcgaggaaatctccggcggcggcggcggatgggacgggatcgtcggagtggcgacggttgcctcggcccctcccaaaaaaaaaaataaaggaaggggattgaagtatagaagtgaggagggcaaattctgaaaatcgtgggggcttccgccgctgcttatcaagtataaaccgtccctgtttctttgtgcctatccgcaagcatgccaaaattaatactccctccatccaaaacgagaactgcttctaatattaatactaatgtgacatatcagttttatgttgatatttattcgacggatggagtacgtcacaaataaaaaagctaaaattacacctctatccatatgattagtcatcaaagcattttctcgataaccagaacaaatacttcatctataaaaatacttaatctagtattctagtacaacgtatttgaacatactatattgttttttttttttgataaaaatgagtatacgctagatgacacattcgcaggtgtgctcataagcatttgtatttgctcggaaaaaaataacttcctttattattctaaaatataagtatcggtagagttttgatatttataccgtaatatattttttaaaatatatattctaatgaatggaaatctatatatttcccgtcactaagatgttaggaaagaatttaacgactaaaataactataaaagagaatattttctctctacctttcgtttcgctaaagaaactaaaaacgcttaaagtttgaaacgggtgatgtattaggtaaagtcgtcaatctatacaatcgtagtatcttccaatgccaatctacatactatagtcaacaatcatgcggataagacgagtttagtgccaaaaggaagttgcgggtcagagggcaccggatcacagagaaaattaattggactgctagtggataggagttgctgactagggggtgtttagatacacggcggtaaagttttagaatgtcacatcgtatattatatatggtatcgtatggagtgttcagacactaataaaaaaactaactgtagaatccgtcagtaaaccgcgagacaaatttattaagcctaattaatccatcattagcaaatgtttactgtagcaccgtattgtcaaatcatggagcaattatacttaaaagatttgtctcgcaaattagtcgcaatatgtgcaattagttattttttagcctatatttaatactttatataggtgttaaacgttcgatgtgacagggtgaaaaattttggggcggaatctaaacaggacctaaagacgtttcctaattcttactccctccgtccctaaaaagacaaccagctctcctaatataacgaatctagacaaccctctgtccagattcgtggtactaaaagagggtcacatcccctcctatgttgctttttttgggacagagggagtatgcactatcctccagggcaatctgcacttattgctagtagatataagcggagtttttattaaaagaatatccttgtctgttacagtgaaacagcatcggactcaccacgcgtcgtcctcgtgcaggctgcgggcggcttgagagccctctcatctctcctcttctccacctcaccgttgtcggagcacactgcctagagaacctagcggtgagtcatgatggtggcgacgaggctaaaccaaccccgatacgcttcacctcttgtgcgggtgaggcggtgtggagcttggcaagccaggagaggctacagtggtgaaccattagtatggggttgctgatacaacatcatcacgactgatctgatggggtgtccctagtccatcatctccacgtcaaatatgactagggtcaaacggcgggggcaatgggaggctggcgtggtcaggccaacgacaattaatggatggccgacctcgccggtggcgacaatagtgggaggcagtgctgggcagccggcatggcaggtgggcgtgacaactagtgcactcggtggttggtgtggatgacaacacttgtgatgatggcatgtttgttatgttttttttaaccttactgtgttgtaatgttgtaatttttgttatgctatatcaaaataaaactttgcactatatcaaataaaactttgcaatatctaatgtggatcattttaaaaaccttgatctcaaatatttcattatccatcgttaaattcaacttggccactaacgatgactttttatacggttagactactatgattgacaaatctatcttactatatagttggtgctcactaacttctaaaactcaatatgcaagtatgtcatattatcatccactaataattattatctagagtattttaaatatcatgcaaacatgacatatcatttacaattttgttgaattttttagaactcaatatgcaagcaatgtcaaattattatcttcacatcatttccagattatttaaagatatacatttaccatttctataatgtataacatgtattcatctacatatctcgtaacaaagcgcatggtatcaactagtaatattaatgttagcatgcaacacgctttaataataaaacatcttttcagatatttaaatttgtttgtgaacagatcgtgatcaaaatagaaatagtatcaagcaattatttagatgagtaaatttcacaaaacttctcctaataaaattcacaaaactatatatatatatatatatatatatatatatatatatatatatatatatatattgatcaaactatcataaaactacatatttaatgcattgtatcacaaaacaacaaatttagcgtaaaatttatcaaaaaaaactacagatttaaagccaagtatcacataactatatatttaatatcgaagttatcacagaactacagaatttagaggtcaaatccttagcactatcaatatgtttgagctataaacgttgcagttttatgattaaataaacactaaacctttagttttatgataaatttgctacttaatctatagttttgtgataaacttaacactaaacttgtagtttttttatataacatcttaaatctatagttttgcaatagtttgatgaaaatatttgtagttttataaaatttactctatttatatcaaagtgcaaatagtatcaagcaagtatttatgaatggagggagtatgaattactctgtttttctctattttgaccttgatgagatgtggagtgaagttaactagttcggaggtatggatggtttactacataattaattatgtattagctaaaaaacataaaaaatacattagtatgattttctaaagcaacttttctatagaaaatttttaaaaaacacgtgcgcgcaaaaaataaaggagtagaagttggtaactcggaaaaaagaacatagcctagggctagttcgtttcctcggtttggagggagatttccagagcacaccaaacaagaaatattattagcatatgattaattaagtactcatttcatcttattatatagaggattataccttttttaaaattaataaagtagcaaaaggacatgtgataggaaaaaaaatgatgggtgaaaaaagtactcatttcgtccctaaatataaggtattttggttggatgtgacacattctaaagcctatctagattcgttgtactaagataagtcacatccaaccaaaacatcttatatttagggacagagggagtagtacaaaaggtagatgagagaataaattattacaaaagtgaatagtgatggaataaaacagtacaaaagttggtaggttgagaatacaataccagcttaggatcccaagatctcttatattttacaaaaaaaaattgaaggaaaaaaccatctatgttatgggatggaggagtattaaatattttaaacatgaaaaataaatttatttgatttttaaataacttttatatacaatttttttccatgcataaatttaatattttgaaaagtgtactattataggacgagaaatttgaagtttagagttaaaagaaaataacaaattgttaattaaagtcaatataacaacatattgttattatattgtctaatattattataccctcttgcacgtatggatattttcatatagtaacttaggagttaataatgtcttatgatataaaatgaaatggaggtaataacttatcataattataaattgaagtgagtagcggataaatgctactgcccccaaaaccaattaattactcttcatagttcatgctttactagaaacagaaagtcagttttgtaaaatttgcaaatgtcaccctaggaaacacgagaatttaccatccacccccaccaatccatcgcccatccgctggctaagctacgcccactcgatcgccgctaaattagctaaaaagctacttaaagcaagctcacgagaggacgtgggcggcggcgcgcgcgtccatggcgacccggacgaacacgtcctccagcgtcgcgtccgccaccccccacgccaccaccggcgccgcccgccgcgccgcctccaccgcgcccagcacgccgtccagccgcgcccctcgccggggcacctcgaaccgctgcgtcccgcccacgccgtacaccttcgccgcgccggggcaccgccgcgccaccgcgcgttccaccgcctcctcgtgccccgccgccgtcgttatcgtcagcgcccgcacgccgccgtacctcgccttcagctgcaacatcaatcaatcaatcaatccatcaatcaatcaatcaatgcacttattactgaatagccggcaaaaaaaattcaaactttcagatgaattaattctgcattggctttttttaactgagtttttgaggtgtttaaatttgattacctcctttggagttccgaggcactggaaattgccgtcgacgaagatgccgacgcggtcgcagagctcctcagcctcctccatggaatgtgctgaaatgttcagtgttcatgtatataaattcagttctagttgctaaattagtcacaaatattgcagtttgcatgtatagctggaaagaaaaaaattaaccaagaggaggagtaattaattactggtgagaatgatggtgcagttcttctttgctctcttaatgacattccagagattgctcctcgatgtcgtgtccaatccggtgctcggttcgtccatgtaaacaacctgttcaacatcaatggaatcaatgagagatagttacagcagaagttttttcagagatgtgagtggaagggaatgaagaacagttcatggtaaatttactacctttgggttgccaatcagtgcgatggcgacactaagccttcttttcatgccaccactgtacttgttcaccgatttgtcgccgaaaccgctgtggaacagatttacactcttcagggattcattcactgcctggatcaagaaaagtaaaatctgatgatcaaatactagaattgtttccaatgtcatgtgtagtactacaaatggagtgaacatttgcaattttacttgtaagaagtatagtaggagtatgagatttgaaactcgcagtttgactgtataaagctagtgctgtaattttacatgttctttccttttttcatggcttcaattaaactaccttcagtagagcagcacctgtgagattcttcagtcggccatagaacattagatgctctcttcctgtcagagtttcccaaagcaaactgcacacacattgaacaatttcttttttgttggcaatgatatcactaacaaaaccatcttcagaagaaatgcaaaagaactagccacttgagatcatactcgtgctgtggacatacaccaatgtttgcatatatttcattcatatctctcctcaaatccatcccatgtatgtaggcagttccataagttggcgccacaagtccaatcatctgcaaatataaattggtccaaaaggtgtatttgttaggttttttcatgttatttcactactaggaaaaatggataaatttaagtactacttgattcatgtgaaaaatgagagctactttgaagtgttgatgaagcagatataaatgctattttgacaaaacatcataagaagcacaagaatattgtgaaatattcaccatgttgatgaaggatgttttccctgccccattgggaccaagcattccaaaacactgtcctttgcgcaaagcaagcgacaatcctttaacagcaagcttatcagggtttccattctttccagggtacaccttcttcaggttatggcatatgatcatattcctcatgtccatttccttcagcaattttttcaccaccttgcgctgaaaagtagaattttgaacaacaatttatgacagtatccttgttgcatattatagttctgcattacttcattatacttctatcttggaaaacgccatctattaacttctatagacgtgtatttaatcacacctattgcagataaaaaaaaagaagcacgccaattcagatggattgagatcctctaccttcgaaatcaccatgcctttgtcccacatgtcagtgacaaagtcacatgactttgaaggtaggtgatcctgatcctattcggatgtatgcttaactaacctcaaggaaaacatcaggttttgccatatcagcaaacacctttctggacctctgtttcactttgtctggtatgattgttggtgaagagtgctttgttgacataaacccaaagaggaacagtggatgccatgtaggtctatgatccagtaaaaatgccacaggaagcagaagtatccattctatagacattagaagcaaaacatctttcatcccattgatggggtcattcaagtccctccattgcatcccaggctttcccatttgccttcctgcaaatgcatactctgcgagctcgtaaaatcctcggtagagggcgaacccgggaacaagctccattgtcacaagccattgttctaataaacaggtagaatggtagtttttaatgagtatccaataaatattcagaataattcctgggaaaaaaatttatatgggaacaattgcagaagtgcttatacttacttgggaatgtaatatcttcaatgaacaattgcagaagtgcttctccaagaaggcttgatccaaagacataaatgtaactaattactgtaacacagaaaatatttgattctgaggtcacttgaagagctatagaatgaacagaacagaaggtttgaattttactaaccactagcagacttgacagacgagaagaaagacgcaagcagaaaggcgagcacgatctgaaggttgatatatagaaaatagaatacaaattgtatgctgtagctatttaatctgaagatatctagccctgtaataccaaaaagagttctctcagtgatttcgaagattactcgaatgtgctaaattctcaatttccatactctgtagttaactagcacagtacctataagggacccaaacatcacgaagaacatcatataagctgctgaaagggacaaaaaataggcgtaagatatcatccaataaggtccatcctttagcccatgcatcttcatcatcagtcttaaattgtgctgcttctcataaacaagatatgtcaacattacctgaaaaaaccattgaaataaattggtaaataacttatgtatgaatccaagatagctttgataagagattgattgtgggacgcgataaagttaactcactggaaggaggagttgaactgtccatgtaaagaatagtgcatcaaggagtgtggtaaggtctagcctgattttcattgcagcttttggcatttctttcaaatattccaggcgcatttctacattaggtcctcgaagaaacttcagatatgcggtggatgcctgatgaaaatgcataacagtagtgataatactaagttatttaggacctataacagatgaactcatttttaggaaaggactctgaaaaaaaatggcacatatatccatctgggcaacaaaaacaacacaaatgacaagaaccatgaagtgttgttgtagaagatgtgctgtttttgctacagtagccttgttttgatggaacagtacaggagtgcaccatgccttttatgtagcacttccatttctagttcttaccatatattttttgaatgcgggtatccccattttccattaagcgaaatggtaaaaatcatgttttccggttcttactatataatgattgatatttctttagttcagataaatgccctttaatattcaatggagtattcctctacctaaaagtgaaactgtaccacaacaggcaagttaagtaccatattaaccaaccgtgcaacacgcaaaactgtcatgggatggtgtccattgtccctgctgaaggtagagttgtatgagacatacacatgaaacctcctcttgcttgtatcaagaaaatcatagcctgcaaaaatggaccttaaaataagttagttgttcaacccgccaaaaaaaaactgaactgctactttagtagcacagttgcaaggaaaactaaattaaagtaccagcaagatattcgttcgatgtcctcctcttattcccacccttataacccttatacaaatggtcattcatcaccgctgaattccggcaccacagtgataaaccttgaacgcacttcacatctattacaattaaaataaaaaggagtgcacaaatgcacaagtaattcagggttgaaaacatttcatgctagttgctacgacttcatacaagcaagaaacaaacaatcttttaccgagttgaattggcatcgcatcagaacttctagaagtattgtgcgaatcccatatacattttctttgaatcacatatagggtactattgggcacaaatcctggttctatgaacaatacatgcgctggtaatgtgcttgtaccctggaagaagaaatattcggtatcacctttccatcacaaatcagagttaaaaaagtatcgaatcttttgtgtaaaacgccactgatcactcaaaatttcaaatattcaactcacagggactatttttgataactcatcaatataagatgaattgttggaattgggcacaccaagatagtatgaaggagggacatctgggaaaaatccccttccaaggcctggcaaaaaaaaaaagttccattcacaacaacaaaagcaaaagcaaaagttgtagcaaaacacgtgtgatgtgtgtgcgtagtggtgtttgtaaggaaaatgatcctctggcttaactgcatgtgtaattgagccactgacatgtgagctatagtaaagtgagactcacatgttagtgacttaactgtcagaggatctgcttcctacgtgtgaaatttgacattatgccattgtcacaagtgggtttcgcccaaataccattctccaaaagggattcgataaaatgccattatcaactcatgcctactcgctagaatactatttgggaccaaattacccctccactcctcttcttcatccatccacagctccattccctctccatcaaggatagtggcagcggcccggcgagctatggccatcgcctcctcctcctcctccctctccaccggggatagcggcggtgccccggtggtttccgggcatcgccacctccaccttttcctccctctccactagggataccgggggcgcctcggcgggcttcggccatcgccgcctcctccctctacaccggggacaatggcgccacctaggcaagctctggctatcgcggcagggagttgagtgcgacccctctcttctcgtcactacgcatgagcggctcgtgaaggatggcctacatcaagcattgcctcgaccaggttcgccatcgactccagtgtaggtcaccttgtcgtgcacaccgagtgccgatgacgtggcctctgctttcttgctaatggttagtgccctatctcgctgactttgggcctcaccgactctacctctccctctagttgttggcccaccggcatttggtcccatcgccgatctgctctcctctcctctctcttgtcatgtaaggggaaatgtttggactagctgagaggggggagaagagtggagggtaatttggtcccatataatattctagcgtgtaaccgtatattgatagtggcattttatcgaatctctttttgacagcggcatttgggtgaaacccacttatgacaatggcataatgtcagattattcgtgtatgggtgcgtctttcatacaataaagaaaaaacaaatttaaaaaatcgaaagaaaaaatgcagaggagctacatgaacaacataaaaatatactacatttgctggtttgcatgcaccttcagtcagccggcggttctggccggtggtgagcacggcgaccgggcacggcgcctccgacgcgccgctgccaccgtcgccgcgacacctcgccgggtgcacgggcgtcagcgcgcggtacggctcgtccggcacctgcgtcaccgccggccacctcggtggcgccggcacggcgcagctgagcgcctgcgtggccgtggagtgctgcacgccgcactccgtcgccgcgcacgcgcccgcgcccgcgcggccgccgtcgcggcgcacgcaggcgcagccgcaccggaacggcggccggtccagctcgccgtcgatgacggcctggatcgtgacgagcagcacgcacagcagcgccgggaacgccgcgatcgccgcgttcgccttggcgttcctcctctgccatcccaagaacacgaaaaaaattcagcaagctcttgataacatattaacatctcaagaaccaaacattatcttcatccaagaacaagtttgaaatcgatttcaagaaccggattcgtggatggatgaaacagcatttgcatcaccatcacctacctggaaagagaggttcttgaggaggagcgcgtggacctgcctgaagaacctggagcaagaacctgccgccgccattggagcaagcttctccgagctctgacagatcaaactcgacgcaacaacaacgatcgatcgatcagcaagctcgcatatatagcaaattagcaacggtttgcagatttgcagtgttgactcaactcaaaccgaccagctgatcaccacggcgcggcgccgtgagaatcacgcgtcggttgccgccggggcatcaggcgccggacagggagagatcagcggaggattgcagatgaagcttcactccttccatggcagcaggcaggagcactctgatctcactccaagaaaagctgcgtcatcgtcccttaactatggcgggtgttacgcttgcattttaattgtttaactcaagcttcgcagtaactgaagttttgcttcatcagttacatgaggagagcagagagattgacaatggcatggctgcattgggatttgatccatgtgtctagcaaggagtgacatatatatgtatattaaatatatactatatagttaattagtgactggtcctaaattcttcagagtttagagcattgtcacagtgcagaagtcccttctatgaattcagtttactagccacctttcttgttttggagttcagtttgggacttgggagttatctgaactcatggtagctagtagctgagacatcaagaagagagggacagggattgatggaataagacaagccttgtgttcatcgcttctaaaacggtactaccaaatggactaaatcttgtggttgcagtaacttcccatgactcatctttcaaggaatttagattatcatcagttcatgcttccatttttttttatccccttgttattctattttccctctgatgctctgttacgcaagagttttcgttggtacgaagactgatgctctccatctccacattgatctcattggaagaaagaaagaatggtattaaatgatattagcagagataggtttaggttcttgagtactactcaccttgggttcgtcagtaatgtgatagcttcatgtgaacgaaaggtatcaccgtatcagtactgtagagtgataaaatcatccttggtgccggcaaattcaaagatggatcaaaggaaagcacagttaccaacataagcaaattgacagtatcttagtttagaagttagagcaacctcccttcgattccagcaaattgacttttgtttacagcatgacatactaagcaaaacagttgacagatgtctgaggactcttatatctcctccgtttcaaattacttgacgttctagatttgtcctaggtcaaacatcaatttctctaaacttatatagtttaacatcataagatttatattttaatatatccatcacaagaaataatttcatgatatataattcgcatattgttaaactatatagatttatagaaattaatgctcaaaaatagaaatatttgatttaggacaaatctaaaatgacaattaatttgaaacgaagggaatatatatatgagagtgatatgacttgtacttgttccatgtgaatatagattttagatcttacagccaaaaatctaatgatgcattctaagataatatatgttgtgtgacttctgtaagtcctggactattagaaattcaaagagagcagatgactgtagatgctttcctccaaggactcttaaaaacaaaatcttcaggttcttattttttaacaccaagataattatttgactaatgacaatagtttattcttgtggttggaaccagcgcactaaacaaaaacacttcatgtggtagctgcacaagattacagcatctgaaatccccaatcaaataaattattcagatagatcagtacccaatgctattttgcttgcaatttcagttacggccaccctataattactggtcaaaattcaaaagattgacaaaataacaagaccttattcagaggcacaacatctcagtatgagaagaggtttgaatccattatctatcctattccaaataaaataatactctagtttttttttaaaaaaaaattccgatgctcccacaatgaaatgatcattggtaactatagcagtataaaatcagaataagtggtctctttagttctcagaagctattaatgtattgttcaggatgtcattgaaggataatgaatcaaagaaagatacaagtagggactaggtaatgtgctttcttaacattgttttcaacattttactaaataaaataaaatcgcatatagctttctgtttgcgggaaaaaaacccgatatagttttaaatatgcacattctgctcagctggttttagtcaaaatcaactaccactaaggccatgttcggttaatccccaagagggagggattggaggggatttattgcacacctattgtgatgtggaattattccccctcaaatccctcaaatccccttcaaccccctctaaacccaaaaaggcctaattggtgttatacattacaatatgaattccatggttgctaaatatacaactttaccatactacatgaacaactcaatcacaatgccaagtaaaggttagcatatagttcaaacaaactatatacaacacatgatcctatgaaggaaaaaaaataaccacctatcgatccataatattatttacgcgatcacattgactccttgtgctcctttggcaaccttgatgaagacatcctccaaggtggtgtcgacgaggccccaagcgtgtatgctgaactgtctttttgccttctcaactgcatggaaaacgtctgctatcttcacctcctgttttggcagctcaaatttctgcgtccctgatatgtgatatatcctgtttgcacttggtgacaaatgctgaaccagctgtttgacctcctgttcatgttctgaagatgttgtcatagtgaacacatatgtgccaccatatctagctttcagctgccaaaacagaatgcaatccaaatattcagatattaacaaatgtttataataggcatgttacattaagtgtatttatttgtttttgcaggtaactatgtaaattacctcctttggattcccaaggcattgaaaaccaccatctacaaaaataccgagtctatcacatagcacctctgcctcttccattgaatgtgctgaaaaaaaacatactggattatccactattattgttcatataggcaatttaaagaaggtcaggaaagctcattacttgtaagaatgatagcacgatttttctttgcctccttcacaacattccacaagttatttcttgatgctggatctagtccagtgctaggctcatccatgaaaacaacctaaaagaactttttcagttgcacattccattgcattatgtgcagttgaaaatcaacacacataaatcatattagtaccttggggtccccaatcaatgagattgcgacactaagccttcgtttcatgccaccactgtacttccccacttgcttatttccaacaccaccgtgaaacaggttaacattcttcagggagtcatcaactgcctgatagtatgctatttgtcagttcaaatattgatatattcatgtgtaatattggaattgttaccacaagacaaaattaacacaccaatttacagtgaaggaaaataaagagatgagtgtgaagataactataccttctctaattcagcgcctttaagattctttaatctcccataaaacaatagatgctcttttccagtcaatgtttcccaaagtaggctgtattttaagcagcattagcaaccacaatatattttgcaatggattaccataaaaatggtactaaataaattagttttagagcaagaatcatactcgtgttgtgggcatacacccatatttgtgtagatgctatccatatcagtgtttatgtccatcccatggactaatgctgtgccagatgtgggtggaatgagcccaatcatctatggaggaaaaaacatggaaagtatatgccaagtaaggatcgtgcaacattgtctattttttttgtcagaattgaagagctacttgttgccactgtaccatgctgataaatgatgttttcccagctccattcgggccaagcataccaaaacattggcctttagggagggcaagagacaaccctcgaactgcaagtttgtccgggtttccatcctttccatggtaaaccttcttcaggttgtcgcatatgattgcttggcttgcatttggttccagcagaagttgctcgactacctctctctggatacaatttagcaaaatcaggaatgaaacatttatgcaatttgagaatatgcaacaacacgatttcaacatatatacaaaatcaggattaacttacttcttgggaaacatcagggttgtccatttcaacaactactttagacccttgtctcccaaagctcctccgcagtgatacagcacgatttttgaaacgtttcaagaagaacatgggtgttttacgggctccactacccaatgatgagattttatccaaataaaatgctaatgggagtagaatagcccattcgacaaccatgataatcaagacattgcgcattccattctcagagtccctcagattagtccactccataccatttgttcccattgcatttccagagaatgcatattgaccaagctcatataaccctcggtacagcgaaaatccagggatgatttccatgactactatccaaccctctttgaatggagaaaacaatgctcgtcatgcataagatataaaaaacaatagctaaaataaatagaaaagaaacctactcggaaaactagtagactccacaaaaaacctcagaagaaatgcccctagtaagccagaaccaaatacatatatataaccaaccactgcagcacagaaatttctcaaattagtcatccacgagtcttctttggaagttgagcatttgaatcacaaacctgtggctgtttttacagaagaaaagaaggccgcaacgaaaaatgcaagtgcgatctgaagatttatgtagatgaagtagaaaacaaactgaatgccgtagttatttgttttaaagaaatttaaacctgtaaggaagaaagttaattttgtaagcatgataaatttatttgcaaaaatacaatggattgaagaaatttccagttgattacctatcaaggatccaaataccacaaacactatcatatagacagctgatagagcaaagaagtaagaatatgatatcatccagtaaggctcatccttcaagccgtgcatcttcatcataattttcagcttctgttgcttctcgtacacgagatatgttaagataacctgggaacaaaatgaagtaccaactaatttgatgtcctctgcaacttatgtaagagttaagaaaggttgcatctcatactcactggaaaaagtagttcaatgatccaggtgaagaacagagcaccaagaagagaagagagatcaaattttggtttggttcctacttttggcatatctttaacgtattcaagcagcatctccactccacttcctttaagaaatttcatgtatgcattggatgcctataggaaagatggaatgagttgtattagtagttgtagtgcatatgaaaattgttagacttgaggtagtggaagttcagtgtacgtaccgtgttaaccaagcgtggaactcgtagcaatgagatgacgtcatatgcagtgttgttgttatatgtagagttgtaccaaatgtttatttcaagaccattgttgtttgtgttcagaaaatcatagcctttggaaaaaaagcaaacttagacataaggtaaggaaccattacatcaatagtggcagacacttttctctgaggggatcagaagatgaaatcacctgcaataaattcatttgtctttcctcctccacctcctccaccttgctgtctataacctctaaatagttcattattaatttgtgatgcactttcacgccataatgataagccttgaacgcagtctatatctggacattgcgaaatgcatatcagatttggacattttcacaggtgtaggaaacatatatgaaagattgaagggacattgacagactttagtcttactgttgaagtataacactggaattcaacatcaacagaacattgctaatcaaacatatttaaatctagatttttatagtcaaatgatgttatagaactttatgccaatatggctttggtgtcttatttaataatgcctcccccagtcccaaatacatgttgtcttgaacatatacacagtttctaaaatgcatctttgaccgctgatttctgttgcaatatatttataaaacgcgatagacctataatattacaaaagagcatttcaaaacgacttgtatttcttactggagggtataactgacaaataacgcggtacgactactactctttttaccaggcattaagtctgactattgataatgacgaggaatactgtgcaattccaggtccgagaatataactgtgaccagtgctgaggtagtaattccaaatggcaatgatttttttataatattatcataattacctacttattcggtataccatatgcctttacttcctagtacatattaaattaaataagttaggcctagcaagttaccctgttttcgctacctgcttccttcaaacaaagatgcagctgaacgaaaaactgtgaaaagaaaagcaacttactgagttgaatgggtacaggtccagctttgttagaaattgttcgtgataaattggacgaacactgaggctggaccacatataaagaatgccctggggtaaataccggctctatgaactgcgttgtccatgtccatgtgtctgacccctaagacaaataaatccaatcaagagctccacacattagagaacatggcaaccatgactaatgactgtacaagcaattctgccattaggcacgaataaactcacagcaacaatcttggagaacgcgtcaagataatccgtgaaattcagagagggaggcacagcagggaacaatccaccccaaagacctgccaacagtaaagcatcaatgaattaatgaacacttttgatccaaagattgaacaacaaatcagatgtttttttccccttctagtatgtcttcgaactaagaacatactttgagcaagcgagcggttcattccggtgacaaggacagaggcagggcaagaccctgtgtccctgcaggtcgggtcaggcaaaccgtcgaacggctgggaggcgatcctgacggcccgggactcggggcgggggacctggaccaaggccggccatggcgtcgggctcttgatcgggcagctccccacctggtccagcgtggagtgctcgacgccgcactccgtcctccggcaggtcccgtccggcgcggcgtccacgcaggcgcagccgcactggtacttgggcttgttgatctcgtggttgatcaccccctggagcaccacgaggatcacgcacaggaacaccgggaacaccgtgatgcacgcgttcgtcttcatgttcctcctctgcatcaaagcaagaaatcgcaagcaagcaagaaacggtgaggaaatcgaaccaaaacctgcgaaatcggggagacgcgccaagaaagaaagagggaggaggggacctggaagcagaggttcttgcggaggagggcattggcctgcgtggcgaatccggcggcgcccctcgacgacgacgaggaggaggtgtctgccatcgtcggaggcgaaggaggtggggggagaagttacgctgcaccggcgatcgccttcgtctccgggctttatagccgccattttcaaatggctcccgccaaatctgcgtcgtcacgccgccaccgtaaagggaagaagggggggggggtggtggtcgctctccgcgagggaccgtattgtaataaagagaagttgggagggggttggatgcaaaatctgttagccgttagggtcactgtcctccgtcagggaggccgttagcccacggttcagtacacactgcctcctgaaatctgaataccgttagcatgtttggtaataagaaaaaggttaagagatcactaggatgagtgccaactgccaatgtactgctaaggacgaattgatcaagagttgctatttggtgaaatctaaacatgtttgataagaaaatacttttggcatttcccgcttgtgttaagtgttagaaacatgcgtaactggcctttttgtcgaaactaattattggagcatttgtcgagactttgggtgtcggtccgttgttattacgcaccctaggtttgacgagcattatgtaaaaataataaatttactattggcattcactaatcactaggcttggattcgaggcgaagaaagaacaaaatctgcgttgaagaacaacaagatcgaagaggagaaattaattgcaacgtgcatctaaaccatgttatcgtgaagagagaatctttgacaaatcaaatgaaatatccaaaaaccaagtcaaagtcaaacatgtagagcgagaggggaggatttcgtacaaggggcttgtacttgtacctcacaaagtgacaatggacttcaagtgtgtggtataggttgaatttgtttaaacaactctgttatttaagttggaaaaacgataccctgcggcatgatgggattccatatacgtggattgcaaaaggtccactcgtattgtataatctgtggaagggtaggacttgttaattactccatccgtattttaatgtatgacgccattgactttttaacaaacgtttgacctttcgtcttattcaaaaaaatttatgtaattatcatttattttattgtgatttaatttatcatcaaatgttctttaagcatgacaagcatttttgtatttacataaaaaaaaattgaataagacgaatggtcaaacattggttaaaaagtcaacagcgtcatatattaaaatacagagggagtacttgcttaacatttccttgggcaccaagagatttagtattaaatttattgtgctattgatcatatgtggttgctaagatgatgtgggattagcagacaaattaaattacacttagaataatatccaaacaaaaatatatctaccgtaaacctcgcaatacttcctcgaagacctaaagaaagtgattttatacttacatattctagtgtaatttttttatctcacctagcgtaaatgtgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagactactg

SEQ ID NO: 10452 - DNA, 3629 bp, Oryza sativa
ttacccattggcatgatataacctttttgcttttcacccattcggctgctgctatctcggagtcgtcatcatcatcatcatccgatccatatatgtaaggacagacatgattaacccttttgaagttcttcctggcttctgcaaacctctgttcatgcaaggttaccttctgtgcaagatgtgacaagctatcaaagtcttgaaacgagaatttctccctgatcggagcaatcataccctgaaaagccaaatcggctaactgggcatcagttaaactcaagctgtagcacttattcctcatctctctgaatctctgaatatactcatgcacagactcatcatgtctctacttgatcactgttaaatcggacagtttcatctcatgaatcccactgtagaaataactatgaaattgcttctccaaatcaggccaactgttgattaatccacatggtagagaagtaaaccaagtgaaagccgatctagacaaagacaaccggaacaacgtaaccctcaaggcttccacagccgatgcttcaccacactgagctaaaagtcggctaacgtgttcataagttgacacactatcctgccctgagaattttgaaaagtctggaactttgaatcggttaggaagaggaaccctctcaaaccattcagggtaaggataccgatacaaatttctagcgtctttcggcctgagcccaaactactctttcatcacatccgcaatcatatcggcccatggtcgttgctttggtaatccttgaggttattgtggcatgagctcgaattgattgtattgaggaacaaactggggttgagccgatcctccctgctgatattgaacttgcggtgaaggaggctgatactgataattcaaattgcccccttggtaattttgaaaatttggctgaatattgtgcaccaaatgctcggggacaacttgaggtattaccgtctgatctggctgtacatgatgaaccaagtgctctgaaacaacttgattcgcagcatgctgccttggctgattgtcaggtgttgcaaacccagccgatgcattcatcaagccttgctgttgaatcggctgaataatttgttgccttaatggcgtctgctgaattggttgcaaaacctgccgcctaggtggcgtctgctgaattggttgcacaacctgttggattggtggtgtttgttgaatcggctgtacaacctgctgccttggtggtatttgctgaatcggctgctgctgggttggatcaacagtaggttgaggagataagaacatagctgcaacatgatcctgcgttagccgattcacattctatccactatgctgtggtttctctctcaccaacaatcgaggattcactaattgacctggtgctgatgacggtgcagcaggtgcaggagccgatactggtgccgtcggctgagccgatggtgcattaagaggaattgattgaacagctggctgattatcagtgactaatggccgataattcaggaatacccctcctggtagataaaccggtcatgtagcctgatattcagccattgaaccatcaaccattatcttcaccatgtttgacaaagtgttgactaatattccagattgattgatcaaagcatggtgcatagcatagtcaacctgatcctggaagttgttaaactgtaactgtgttgcattgccatcttgattaagacctccaccttgaactccctgaacaccatcaccttgaattccttgagagccaacaccctgaactccttgagagccatcaccttgatctccttgaaagccatctgcagcacctttattactcggttgagccgcgtcatctagagcttgtttcacttctccatccttagaagaacctgtcccaggaacatcaccaattacttttactttgtacttttgaacaagtgttcccttgcgggtctccgtgaatgagctcaagaactgattccgtgcttgctacatcattgcctcaagatccttttgctgctcgggtgtcaatttatccatagtgacgggcacaatgttggcttcatcaacctcagatagacccagcttgtggatcttggctttaacatagccaggttcaccagccgaggacggcgatgctggcggtttctcggccatgggaaaaactgttgttgtgattctgacttctgatctgtcccaccaggcgtaccaaaagcgtgttgacataaaacacgaggcctgggatatctgcttaactccagtgcaggtccaaaactcgccttcgggtatgcaagcgtgccagttgatttgatcctacaatcaacaagaaacaaagacaaagaaaccgcggttaaacctataaacgatagccgatcggctgagtgccgatgacatatcatttatctttgagccgatgtcatatatgtatcgatcggcggtcatgaataaataagaaggaactaaatctactcgatcggctgtagatattaacaatatatactccttatatcgatatatacttaaatcaagtgattgggatagatcggtcgccatgccgagacagtataaatcacttagatcaaaatatatattaataacgggactatatatgttcatagcatagccgatcagatagatctagcatgtatcggctaatactccgataccactctatattaagatattaaagcaagtaaaatatatcaaacaaaggcctaatatacttaaatgcaacaagatcttaacataaagggcagatttaacatatcaacgaagcatatggagtaaatatagttaaatcaggtaagatcagctgaaaccccgatactaccctaatcggcaaccaagaagcaggctagagattgagattctaatcatgacttataagatcaaactcaactgatgcagctataagtatgaaaagaaggacaatatctagacaatcaagccattgaaagtttcatagagtggtgaatatcctatataatctaagtcaacattgatgtctaacctaatcggttgccctctaccgacagatgttagccgattgtaggttagatagcgatattgctagagattatgtaagatatatgataactcgacaaattacataaacaagattagagtatcataaagatggaagcactaatcccgagaatgcaagccgccataacaagttttacctcttgttgaagatcgaaatcgatgcagctcaacccgaaagcaagaactcgtcgaaacaaaacgaaagtaaaaagggtggcgatgcaccgagattgtattgaacgtgtgttcattgattatatgggatccggggtctatttatacccgagaattacaaactatgtccatatcggacacgacacttatctctaacaaactctaagataccataagtctttgcggcagacttttgccccacactgtccttgtaggttacacatacctccttgagatgagcgtggaaacgtacaagatctacatattaaaattatggactggatggagcctaggtcccgatctggtctgggacccggccccccttggtccttgtacactacacgttccttctgaagaggaccgtggatgcatacaagatctacatattatacatttgttcatcaaagacatcttcgagaag

SEQ ID NO: 10453 - DNA, 56859 bp, Oryza sativa
  unsure (1)..(56859): unsure at all n locations
tccccccccccccccccgccagctataacccaacgatcacatccataaatgaaacaaatttaggaaaaagattccaaaccgatgggactgaaaagacgtggaaaagacagtagcgctgagtcattagggacgatgcgagtctggacacatgtcgtacatgcctggcaacacccaattcggccaactgggcaagaagagagccgtggcgccatttggtgaggccgggattcacctggcccaccacatgacacatggtggacaatgtgaaagcccagttggccctctaattataatgtcctaggtttagaaggttattgaaagggtcaattaggcctagaggagggatgaataggctaatttaaaactttatgcggaaactaaaattgagttaaggtcggaaagtctgatccacagtcagactatccgaaaatattagatagtctgatgttggatcagtttgtctgatccactaaacaatcacaacaagcagatctagcacacaaacaagagtatagcgcaaacaacgactagatctatagcagcacaattaagcaaagctaaagagaggatgaagagatatcaccaacgatgaagttcacggagttgttcccggagttcaaatccttcaggggattctactctccgttgaggagctcactaagagccgggtctttgctaaccctttcctcaagaggttacactaagcactcctccttccactaaggggtatctctttccttgcggaggcgagatcgggccttcacaaacttctcccggccaaccacacgtagatcggtggctcgggagtgacacctagccgtctaggagtcctcatcctctaagagtaacaaacaccacacaactcttggtcaaaccctagtgctcaagatcgagtgaaacacacactaggccctcaaataccaaatccacaaccaccaagatacaccacacaatgaacgaggagggatttgagagagggagaatgagctcaaagatccaaagcaccttagcaccaagctcaacccaaagtgaatgagaatgaaatgagttgggtaaccctagaaaagggttaggtggggggtatttatagaaccccccctcccccaaaaaaaaaatgtggccattggaggggaatctttcagcccacgtcggatagtccgatattttaaacctccaaggcaacaagaaacagagaacgaagttccatgaaatttcggactttccgagacatcggactatctgatgttaaatcggagtgtccgatattttagaagcaaaaacttcgtcctcaaatagagactcaagttccatgaaatttcagagtctctgtatcatcggactatctgatccaacatcagatactccgacaaatagaaaaactcactcgaaaggatttttcaaacaaagacagagagtgaagttctgtgaaaaatcggatagtccgatacatcggatagtctgatttcaaatcggatagtctaatgttgctcaagtaaaaagtgcaataactttttactccgaactccgatttcgaagattttggactctatggaaagctagtttcgtgggctatcaaacccaacataaaaaatggtccaaaaccttcaagatatgttgaaaaacttgcaaagaaacccggtgtaagtgttgtgacaagtgaaacaactcgggattaaaattttggcttaggtttttcaactcacacaaagatgaagcattttgagcactagtgttctaccaattatatgcatgtggtatccctcttaatagtacggcattcctacgacacaatgcaaggtaaaagatacaatataccatttgatcattgccgcattgcatcgtgatgttgcattcatggggtatgcatctcattacaacatgtcgaggacataacaaccttcatatttgcttgaataaaagtgttattcctctctaatcgcattgtaatcaatcatcaaaatcattaggggcctagatgcactttcaggtattaagaacataagaactggcatgatgcataattagaaagtagttaactttcaggatgttacagctgcctggcttggcatggtcaaagtgccttgccccgctacaatccgcatcagatggatgagagatcgacaatcatatgtgaccatgccactgtttcaaagatttcaacatatccattatgctggtggtaagtacactcagttatgtaaaagataaaacaaggttcaccaaacctttactcaatagtaccaccatgtgaatatggcttgatcgtatatgttatgcttcatttgtttatttttgtatgctctagtttgggtgtgttcgtaagacatccatagggtttttgatttaagcatggtgcttaggtcaaaatggtctgcgttaattaaattagacatgatgttgaattcgattaatgaaccattagagctagtactttcatggacataggatgcatattgtgacattccggcccagggcttaatagaattaatagaatactcatatcaacaagttgcaacttcttttccggaagccgatttccaaagaactccagggttaagacttcttttccggaagccgatttccaaagaactccagggttaagtgtgcttggcctggagcaatttgggatgagtgaccgaccgggaaattcttcccgggtgcacacgagtgaggacaaagtgtgcagaaaagacatgtgttggtctgtgaggacagtctatgacctataaaagcgggcctggcctaggggaaggcaggatgttacacatatcttctacaaagtgtgcagaaaagacatgtgttggtctgtgagggtagtctatgacctataaaagctgccatatgtaagcgggcctagcctgggggaaggcgggattgttacacatatcttctgtggactaaccctgtaggaaagttttcgaattaacacaataaattacagacatgcaaaggagtaacacatcatcttagtgtgcagaaaagacatgtgttggtctgtgagggcagtctatgacctatataaaagctgccagatgtaagcgggcctggcctgggggaaggcgggatgttacacatatcttctgtggactaaccctgtaggaaagttttcgaattgacggatgagtcctcacgttcaattcacactagaggtaagtcagggctcgggaaacaaatcaataaattgcggacatgcaaagaagtaacacatcatctttcaaggtgcacggtgagtatactgtcaaatgctcatttgttatgttcgtgcaattttacctcagccatgtatgagttttgcctaaacgaaaatttggtgaacaataaaaaaaattaaaaagggggttttcagaagtatctctaaaaaaagacggcaattgtgtgggatcgatgcttatcaaattttgaacccaatttctctttaacatgaatgtgaacaaataattttgaggctatgataaaatcttttcaattctttgtagtccctcggatatttgttatccactaaccttttgtaagaaataaaatgacaactaaggagcagtgtacgataacttcaacaccaatacctcactccttggtcttaggaaaaatagatgctcagggaaccaaacagaacaaatgcgaaactttgttgcattcaattcgattctaagcttggcgagacctatctagtattttggaaacataagaaatgctgaacaaatgttacagaattgacaagaatgctaaaaataaaaaaaaaaccccgaacagatgatacaaaatccctattatgaaactttaaggagcatcaagaggcgattcatagaaggccagtgtatactgtagtcgtagaagaggtgaagtaacatattaattaccactagcactctaccatccttgtttgaagaaaacaggcaggcaaacaaaaattaaatgtgaacatattaaaagaaagaaataagatagtctgtacatatttgaacattgtaaaagaaccaagcagaaacaactagaatgtgacagaatttcatttcaggcaaataaccaacaattgcttgcactgaaaaacacataacctgcaattcactgaaaaacagacagaactgccgcttggtagttccctgttttgaaaaacacaatctgcagtaacgctgctaattttccaaataataggtacaggtggagatactccctccgtcccaaaaacacatacatcaacctggagatcaacctaggagagatcacatcccctcttaattcttatcccctcttaattctttttgggacggagggagtactgttgaagaagtccgatgacattttttctctactgatcagtatgtacaagcattcacagacgtcctcctcccatatttacaaattgcaaatttgcaacaaatgctccctatacattcgtgtcttctaactagcagagcttccaaacgaacatattcttgggtctaaaatttcgccatctcactccaatatggagagtatacctggagatttcatctatgaatcatcacatacaggcgcacagcaaaatacatgcctagctagctaagctagtctcagttgaaaactatgggcaacttcagaacttggccagaagccacccaaatgtccagccaagaagcagccctgcacctgcaagacctaaaccaacggcaaataagagcgcgtcacagaaactccctgcatttttatgccttctgcctttcttccttgtccaatcttctttctcatgatctggtgtagtccttttctttagtgtaatccatggaatatcaggtatcatggttgctatctgatgctctctgtgtttaagctggaggcagatgttctccaactgtaacattttcagccattgtttgcacgcaaagagatgcgaggcctgtctgaaaaatagcttgatgacatcgtctttttcactttgtgctttcttcccagccatctcagcttccctcgcccgtgtttgcgagtgacaaagtgcctccaaaagttgagcttgctctgcaggattctggtatgttcgcttgcctcgtggttctgtattgatgcccctagaaaaatcttgtgcatcactgcaggaaaattggatgaaatgataaccagaaaaacacaagaaactgaaaaataatggagcacatttgaagtttccgagtgcggattatggaacataacttaaaatagatgaatgtagattgtgaaattgtgtagttcccaatcaacaataggaattttttttaaaaaaaaaactctaggtattgattaaatgaaacaaatataacaagcaacttttttgaagaagtccatgaactcttttgcaaacaagggcaatggcaccattatcctgtaggcagtgagcaacaatgtatctctgaaatgaaccaaaactgaaacttaaccagtataataagttttcctttcaaaaagagaactgaacaggaacagacaaaagatctcactagcaccaaacagcattttagcgaacacaaagggaaactcctacttagcaccaaataattcagactacagtaatatttagcaattctatttgtaatacagaagtaatgcaccacctgaacttcagatatcaactaggaaattaaaatagatgtgcatcaaaatttaggtatgcttacggaaattacaattatggcatcagggtaaattggtgacagagtaaggcagaagaaatacacacctgcgtgcaacatttctttcctgctgttgccaaactccatcactggttaaatccacctcatctgtgcttgctgtgctgtaactgcattcaatatgttcacattgtccagtatcaggatatgacattgtacctgctggacctgatgaccccctgtacctacccatattttcatgactgcgtgattcagtaccctgaacacgaactatctgggtaggtcttggtaaatcgcaattctcaatatgctgcattgctctttctgcaaccagtaaagccagctcattctcatcagtgatctgccaccatggttgactcctttcacctcctttccaaggcgcattcatatcaaaatcgtccttctgtgggttcttcgacggtggtgggttaaaatttttgaaatccaggaattctttatcattgaacaaacagtcactggcattttctttgcacttcgaaggaacttgggaatagccacctatatttttcaagtcttgtaagcctgtttcagaagaatacttcatggaagctgtggaaaccatccacgaaggctcaaaaacatcctcaatcttctcaggattggtgtcgaacatttcacaaaataatggttcgtcgtgtatattcttttgtgctgaatcctccacttccttatcactgatctctcttcccagaaaatataggtgctcacctgcaagattcttctgccctcctaaatttggttgtaactgaagccaccatctaatatcaggtggcagactggagttcatgggattccagctcaatggcatgaaattgggcacagggcggtcttcagaattcctacaatttccattgcttttgacatgctgctgttctgatgatggtggacagcaggctagttttggtgctctttttctatcctcctgaacgatgcaacggtttgcagcacgctgccaagcagcccttgcttcagcagcggccattattctcactgatcagagaactggtcactgaatcataaacagaaaacatcaacatcagtttaacaacagaagcacgctcaaagcaacacacagaaggaggataaaataaactcaagcaacagagcaaacacataatccacaaagtgcaagcatgcatatcagtgcatataaaatgctggctaaattctaggatttcaatttttaagaaatactaatcttgtgttctactgttgtacttcaaccgttgtttcaaatgaggttttcaatggaaagagttccatggcttgaaatgagagatatgacactgctttaataagcatgaactaaggtcatcatgtagttcctttttctcgggattgaccaatacacattaaacaaagctaggtaatgcacagagcataaactgatggccaaggccaacttgaaagcatgagagaccaaggatatgaacaaccaagaacacgatattggcagatatacaagcattttcttgtctctgtcctcctaacactgcacgcacagtaatcagagcatggaggatgaacaaacatctaatcagaacccggaggatgactcatatttgcaatttgacaacgttattattgttatttaggaacataggttgaatcctgtattcctgtcatatgaatatcagtaaagaatcaactgaattggtcaagtatcagcattacataaccaattcttgtgccctgcatcttctatgcagacaaagtactaggcaactggatttgattttgaactcaaattttctgctcatccttgaagaaagtttttaatatgcaaaattataccattcggcaatgagttaactaggttccatatttgccaactcacaaatatcctttttttcaaatagttttaagtccatttataggattcatataaaactgtacagatgtaaaagacccaaaacactcaacaccataaacgtgtttatgatgctcccgaagccttgaaaaccgtgaaaaaggaatataattccttaataacagaaggtgcccacatagatcgatctgcctccagcaaagggggggcacaacgagaatcgatcaacaacctccaccaccaagaaacccaagccctgatgttcttgccacaccacacaaaccatcatcccccttcttgctcgattagaccaacaagaagtggcagagagacgggcaacacggaggggggagagaaagaaatggataccttgatggatctagggacaagaagacggcggtggcatcgcccgcatccgtgacctcgcttcgttgcccctcgatgcaaagattggggcatccgtccggtgcgaaccaccggtcgctttatgggaggagggcgagagaatcagccggtggaaatcccacagaaacggagcaaacgatggatgagatgaggtgaggtactgaggtgacgcagcagcaacagcagcagcggcagcaagctggattagactaggtggatggagtgagagtggggatttctctctccgcccccgcgggacaacgacgcgtaagctcgcgacagggaaagggaaggaaagcaagagagaatcggagaggagaagcaacgaaggtgaaagcgtaataattctgcacccgaccttctgctgcttgtttttattcgtacaggtagcttgtacactagtactccgaataatcatgatatttgctcttgctgctgccgccgctgctactgctctattaaaaatttaccgctctttgaccttacctcctccgtccaaaaaaaaaactgaattatttgatttccatgtccaacgtttgaccgtccattttatatgaaattattttatgattacaatttttattattgttagatgataaaacacgaataatacttatatgcatgacttatctttttaaatttttttcataattttttaaataagacaaacggtcaaacgttagacacagaaacctaggaattgagtttttttgaaacggaggaagtaccctccaaatcttatcttatccagtacagtgcttgtttcatattataagttatttgatatttttctaattaaactgctttaaattaatcaagtttataaaaaatataatagtattttcgaaaaaaacagacatattatcaaaattaattcgatttatgaaaggaggcgtactcccccgtacttgtaaaggaagtcgtttaggataatatttaagttaaaccttaggaatataaatcatgaataactctcaagttgttgagtttaaaaatataaaaactatatgaatagatttgtcttgaaaaatactttcataaaagtatacatatatcactttacaataaatatttttatagaaataagaagtaaaagttgtgttttggagatcatgtcgctgtccaaaacgacttcctatacgagtacggagggagtacgttttaaaatatagctgtttttaaagtctttaataacgagtaagaagatagataaaaaaaaggctaaattgccaatcactggttgtcccacttaatagaaagtaggtagggtcgcagagataagagtggagtgtcttttgacatttcatctggtatttttggcagttatattttggatatttaaattttgccaaatttaaatgctagttatgctactataccttagaacgcagagcaattcttctttaccagcaattagaaaaggaagagaatttagtacaggcagcagcggcctggtgacacatgcagacccggtgacgcctgcagatctctcccgctaacctgctctctctaaacttatccaatttggtagactaaaatttgttcttaaccaccaccaccaccacacgttgatgattgatcggctacccaaagatgagaggaaactgctattatccaagccgaccctgatttctaaacaggggccccaaaccaaaagcatcagcaagatagcaacacgtacggaatggaaattgaccaatcaaaatgtcagaatacgtaccagccgctgttatctgtcatacgcaaggccatcaaaataagctgcccccacaggccatcaaaattgttgaccaccaccatgacaactccactctctctagtctctagtctttcttttgttcttttcagattgggattgcaacatgtgctgatgggttttttattattatttaaactttttaaaattttaattttaaaaataaatcctttcgaaacttatttttaaaatctgaactttttaaccacgctagccagactagcgtgaaaaaacaacactgtcacgccagtctggttgacatggaagcattatttggtcacgcggtctggttggtatgacagtgttacgtagtcacgcgccaccttcgctagcatggcgggacaaaactatttaagcccgctatgtgtggcatgtcggcgtgtttttgctatgttagagcgctgacgtgaccaaaaggtttagattctagaaatatgttttagaagggtttatttttaaaattaaaaatttcaaaaaattaaaaaagttcgtgctgatgcaactatttccctttacttccgtcagagtcaagccacagtctaaagagagaaggggaaaaaaaataaagctagagcctgaaactatgggtttgcagaaaccaccaaccactaccagcagcaggtaatctttcggtaatgcagttctgccaatcatcttttgagctgcgacagttgtgaaaagctagtgctgattgctgaatctgatggctatgcccaccgatctgatcaagaggagttcgttcgttcaacctttgcctagctgccaaaaacccgatgtttggttgctgatttgagtatccagtgcctctcagatcagccactcggtctaaaacacatagcctgtgagaacgaggaaatcatatcacatcgagagataatcgtgtcagtaacagtaaggaatctcagaggttaacaacggttggaaatgaattagaactgtaaacctggtcttgatgcatccagctgtccaaggtaagcaaccccactgcgtcatgttggagctaatcaaatcatgcagagaattttgtgacagccgatttcttcctgtgataaccagaaagatatgataagaactcaaaggtatatctgttcctagctagtagtgatatgcaacacgtcagtatcctacctaactgaatccacatttttactgataacttcactctcttgccgccaaaaccagtaatcatgcccaccgattgatcaagacttcaaagagtagttcatctttgctacctcggcactcgctgcgacttctagtgatcctcgacctagggtacaggttgcagcacatggcctgcaaaatgaggaaatgtttatcccatcaagaaaattacctttcgaaagaaaactgggggaaaattttaggggtttagaaagaattatgagagtcaaaattcgaagatattcctgaatgcattgaagataaaaagggttcagacttcagaggctatgagctagtaaaacactctatttgctgcagaggacaaagcaaatggtaaccaatggttaacatcataaccacacatgtaatcccacgacaagtttaggcaaaacccaaatcctgaactaatttcatcacatgtatgtgcatctccttgtaaataatgcactacctttattatccctggctaaacaccaaccatgtgctgaagatctgctcaaaactgcgactagttaattcagcagcatagataaaagcagcaccatcagatattcagttaagaagcctcatctggcaagacaaggaatcaagagaatggcacttaccatagcaccttattggttggaacaattcagaactatctggtttcagtatccacaagtcatatcatgatcatctgaaaattgagatactgactgaacacacagcaaccagaaacttccccatcaaaaaaagctgtccaagtttttctaaagtaagaaaccgagcaaatccatcataaactttcaggaaaccagataaatcatacccgctttcaagttactttgaaacttcaattcccttctctaaaaaaaacactcagtgtttgactgcaaaattaactctatagtttattggtctttatttaacctacttttttttattgaaatctgcccagaaggatataaacaatgtttctcttttcagaggaaatatcgcttacttttgaaaaaaaatgtctatcagcatccacctctgcagaatttattcttttgtaagtattcttagtccaataataggcttactatggaagcattgaaatgagaatgaaataagttgaagttatatcaagatcataagctaccaaagaaattgacataaatcaaaacagatttgaccaaattagcaaaacaaaacaaaatggaaatgttattacttttagtccctgtgttgaatgtgcaaaccattctgactcagtgaaaattgtgtgttgtgcttattttcttttctgaattaaaagttaaaagaagctcttcctagtgattcgcatagttcacatcaaggcgaccagtacccacagtaatatattttgaagtgcaagttgacgagcagtattgctatacaatcatagccacaaacttgacaagaactcaaacaagcaccaagttaatcttgcagtaacaaggaaaggaccaaagattctacaagaaagaaaattagctccctctataagtccatcagttataacaaaaatataaaaaatatcaatgccatttgttgccaatggttttcattacgagtttaccacactatcatacaatgttctgaaaagaatcaagtgttcccatctgtttgcagtgtacaaagagttaaaaacaccttatcaggggaaaaaaatgcgtaagaatgtaatggggaaaaaagaatttgcacagtaggttgattgcaatacttattttgacaattttatgtctcaaaaaatgcatatttggctgttcatttaattgccacacatcagcaaaactgtaatatcatgatccttttagtggtatacatatggctatgctgatttctcactgattataggtacatcaagtgtgaaattcagaattcaaaacagcatacataggcattcttttttactggaggggactagctcctaagttgtgctaagtgttctgttagtcatatagtaaaagatttaattgtcaatcattgcaacttaaaaaccttctacaagataacaagactacaactaggaaattcttataacaaagataggtattgaacgtctagcagagataaaggtgattcatctagtcatacattggttcaaaatattgcttcgctagcacaatagctattgcagatcaagcagattcattgaacattcatatcaacggcaataatgttatactagtaaccaacctcacacatgaatccaaagaccaaaagactacctcccaggtttcaaaagcacaccacacatcttgtccatcttctgattgtcctagctcattgttagcacaaatgacataaatgatcgttatgtaaaataacagaagtttgattgtgtacctgctttcaactgcagtcctgtccagattcttgggatagttcaaacaccaagccaattttattcaattccacatatattctggactcagcaacagtgtcgcaaacgggcaagatatatattaccacagtactatgcaagaatctgcatttcgctgtagtaggacaacagatgtacagaaccaccaccaaccttactgctttttaccactaacactccatgttatccatgtatctacaaagctctcaaatgacaacaagcaaaacactaactttacaaagggtttttgttcaaagaaataccaaacctagtactatcagtcaaccatgccctaatagagcctgccgcagcactgtggagaaccacaatggcaatctttaacttttactctgccattcaggtcgcggacttcacctattttatagttatagtcataagtgagctcttggagtggaggaatgttctctgcagcaaagaacatgatatggggcaccctttggtcatcatgatcccaaagcacattttgtgcatagaggttaggtgagcaactatggttgataaatcttccaatatttccgtactcagacgcatctatcgtgaagcacacatcttccatggtctgagagcaaccaccagaagagtttagactagaaatagttgatggcctccccttggagcaatcctcatcatcacaattatggcttatatcaaacaagtattcatcgtttgttctcttgtcagcttccttgtcagtcaacaggataccaacatactcacatataaagctgccagaagagatggaccttagggatcttacaccccaacctttattggctgtcctgaaaacttccaggtggattttcatacccttctgacttaccctgttgtggcatgaagaatggcacctacaggatggaccacactcaaaaatgaggggtttatcatggacaattgcaccattggagttgaatgggatttttcctccattcttcacagcacaaaagcacttagtagaatctatgcagccatctgagcaatcgcaaccatgatgctgaggatgtctttttgtaagccatgacgggtacttgattctagagatgtactgaaaagatgttggatggacattactaacatcattgatcacacagatgggatccatttctttcccttgagatatatcagctatgcagaggcctggacgtgaaagagaccttctcagccctttagctatgtgcagaggaagttctggttgtccaggaatcctttgtaatttgtatttgaagatccttgaaccttttagtccttctgtccagcaatccaccacaaggtacaacccatcataagtaaatgttaggatttgtttagctcttgaatgactgttgtcctctctattttgacctttgaatccatgaatcactcggacaggtgtctttgtctcgatgcaattcttcaaggcaaggttccccctctctagcttttgatcctcatctttcttcttaccagcaggctttcctccagaaccagtgtatattagttcacctgagcttgacaattcatcaggataacctccagaacaaacgatgcttattgcaacaagcactccattataatcggtggtatcaattcctccctggtatgggcgatggagaccaacaagggctagctcaactctgtacataaattcgtcaccaacttccactccattaacatttcccacagtaggtccaggtttggtaaagcctggcaatttcctgatgattttatcagctgcaaggtcaactcttcgaatcttcaatgaaccctgttcgacggcatgtaagagagccctgcatataaactgaaacctcctgcacaacatcctgattttgctcctatcatcagcattcccacttccatgttgcctatgaagctgaacgcatgagggaacattgagatacacctcaagctttccatcatgaacaactagtgccttcaaaatatcatcatcttccaagctcaaagccttttcatcgataaggttgtccttgcccgccaatccagatgtagaggcaatcttcataggaatatctttactttgatctggacgttttaccttcaacttcttatgaccaaatgaagcactatttgtggagaagggtctatgcagagtgttcaatggaggcttatggcttgctctgacaggtggcttgactacttttctagctgttgatagtatcttacttctcatgataccatcaccaaatactcctgttgcaatattcatcgatgatttagcagcacctttgggtaaggtccctttgtatttgttcatcaccttaacatcttcagcagctgcagatgcacaaagccccccctcatgtctaccagttgtagactcgtgtgggataacatgggtggcaatttgagcatcctgaacacggtattcccctgtagtcatctcaacgtcctccagttcttggtcaatttgagcaatgccaccatgatcttcaattgcaagactgggaacttcccctttcatgccatgactccccaacactctcttgccgtggacaatttcatttgaaggaccaccaaacgaacatttaggagaagcatcaggtaagatagtttcacatttgcctcccattggcaagtcatgtacagtttcctgcgcagcatcactgcccccttcttgcaatgccttaatttgcatcatctcatcataagcgtgacttgtcaaaacttcagtagcagcaaacgttacaggaacaacaccctcatgtctttcacctgcagaatcatcaaaagaatcacaaccaacaactttttgtgactctacatcacagtatgcctcatcagccacctcaccctcctccaattcctggtactgtactgttccatccaaaacaccgacagctccaacaatgttcgccgtacactggttaaccgaatgtttactgccatccgtagccatcacctcctttgacacacccccaccaacatcaacaggcatgacttccaaacctgaacccaccttaccctcttctctgcgagcaagtggagctgcagcgtccctcccacacccagcagtgaagcggtgcgtcgcagatacagtcctcctcatgggaagcaaattcacagcttgagccaacacttccctctttcccagcaattcaccattgtgtgctccctttccccttgctgccccttctgcaccattctctggtgaaccaactttgaaagcaaccagattctcatccgaagcatgtgaagatttcatcaagaccgtgtccatcacagcatgatgatgcacattcgccattgaatcaccattacccgcagacgccaccttctcacccagaacagcacgggcaggcgccccatccgacggacgaacaccaccaccacggccccggccgcggccgagtggaacagcagagtccctaccgaaatctggtggaaactggcgcttagcggacaccaccctgcgcttgggcggcggaagcggggcccgcttctctagccccctcttcgtccccaactcaccgccgccatttctcttctccttcgccaccaaggggccagcaacccgctcgccgccgtgcgtggccaaatcaccggcgacggccaccgcatttctcgccggcgccaccacctcgcgctcacgctccattccacctcctctgcctccaccacgagtcgtcccctccagcacgcgccctcgcactgtactggtgccctcgcctcgcccatccgcagcgacgggacgaggaggaaccgcgcccgggcgaacgtcacgctgcgtgcatcggcttctccatggctgcgccgcgtggagcatcatctcggagagttccagcgtcggcccgtccatcgatcgccgccctacaatcaccaccaccgaacacaaaccgcaacaaatttagccgttacataggcaatccatacgacgaacccaagcagaggacgtgatgaaccgaaacagaggcgtgctcctaccgttctccgctcgcgcagcaacccgctccgcgccggacgtggccgagccaccggcgacgacggccaccgcattccttccggtccccgccgcgtncttgcgcctcgcttcgcttncaccacgactcgttccctncttcccgngcccncgcacttcaccgttcccctcgtnngcacgcccacccgcaaccgcgggacgactaggaggagggggaggaggacagcgagccggaagcgcggtcgagcgagcgttgttgtcgncgccccacttccgcccccattcggttttncttcacgtatgccgncgcgcagcgctgcttaacatctcccggagattcagcccgctcatcgatcaccgattcaccgcccctgcaaatcacccaccaccaccaccaagcacaaaaacccgaaccaaattagccgttacgcacacatccacacgccaacaccacgaaaccgaagcagaagaacacgaacgacgagaacagagccgcgccgaagtagtcccgaggcgcgcgcgcgccctcacctcctcgtccagagaccggcggcgacgcggcgaggccgagagcgcggcgagggggagcgaggctgcgagcctgcgaggagttgggggggttttgggcgaggagagaatcgagagagtgggtggggccgtgaggggtggaaatgtggaatgggaggaaggaggagctcgtgactgatacgggtaggggccgggagggatgggttcgcccgccacgtggcggccggacgccccgcacctgaaagattcggattgactcgggtcgggtcgggtccgaacctccgagtctccgactggctcggtcgctgtgcacgcaacgcaagcaaacgagtggggtgagaaaacggttgggggtagggccgtcaacgagccgagcccgagcgagcttacctatataggctcgagctcggcaccaactcgagccgagctcgagtcgagcctgtttaaactacaagcttagaaatgggctcgagttcggctcgctcgagtctcgagctttctcgagcctaactcgtgtgccctcaaataaccaatacagatgaaaggaggctgcatgcatgcttgtcgagtactactagtactagtagctttttcaagcataatatgacaactagtagtactattaaatagagctgcatgcatgctagtagtactaataggctagtgctgcagagtaatgtagtactagtaggctagtgcctgcacggtacagctctgcacgctctgtgtttctatactgcttttcattgggagtaagagtagtactagctgttgcattgaaaatttaagaacttgacagagggaaatctgggctcgacgagctattcgagctcggctcgtcaagctcgcaagcttggagctaggcttgagttcggctcgaattgttgacgaatcgagctcgagccgagtctacagcgagccgagctcaagcagctcgcgagcctcgagcttttttgatagccctagttgggggtctcagcaaccttcgcttctctttttataggcggtgacgctgagtcggtgacgccgcggtactagtactccattactgtagtgcatttactggggggcgtaaatacaattttagatggttgttattgcggcattgattctactctacaatggtgaaacggctaggtgaagatattttccataataagtttataattatgattttcacacggctaatcccatattatctactccctccaatcacaaatattttatgtttaagatgaggtttggtcaaattttaaacttcaaccataattttagtattagaatacatttatgacatcgaataactttatgatgtctttttttactgttaagtttatgatatttaatgatagttttaaggcaaatctacatacgtgtatttttcttaaaacaaaacatttaagaaattattaatggttaaagtgtgaggaaccagttaattaaaaatggacacaattatatttaaaactcttgctaagtatttatttcattattttgctaagaaatataattattttggacctacttgtcattgacactcgtgtcagtctagcaaaattcagctatacaacgcatgagtatagctgaattcagctatttttttaccatgagagacgggtcccactgatcattcacattctggtagacatcagccacaccatgcaagttactccgtaactatacttcgtaatctttactccccattaatcatccaaaaccaacagcaaacacacagactttggtgcgccccctgaacggtgtatgtcggttactcaaacatgtcacttaccggtgggtcctccttgcagcgccgctgatttattcataagcactatccaaaggacaatcacacagcaggaaagcgtatctatttaacagcttcggctaagtttggtaatatccatctcaaaatataaatatgtttagctaaaaatttaaacaattatatattcatatttataattaaaatttattatattttaacacgaagatagtaattctataaattatcgcgcccttcacatcaatgatctacacaagatcatccacactttttatctcacccttttctactgtacacatcatgcttaattgctcattcgcttagtagcaggagcagtacggatcgggatactccgcattagaatattatctctttttttaaactacattggaatattattgatgcaagttatatcatttgcacaatggcccatcctatccaccctcgatttaaaatgatgggctagatcagggatccggatcctctgcagtaatgcataggtgcactattcatgttagtagcacaataaatcaatgcatcaaacaatgtcgatccattaacgaaaatactgtcaaacattgatgagtattgtagcatatttattgtagcgcacgatctaatccatctgatcaaacagtctccattccctctaatgttgggtattgtagatcaattcagaggatcctgattcttagattagatattcagatgctaagtaactatatgatgaggtactggtcccgatcttccaataggtagtgataactctcgatttggcggaaacttgacacacacgattcagctttcgatcgacacgatccgaaccctgtaattgtagcaccacgtctcctctggttatcaaccgtgcactgcccggttgacctcaaacaatccgtacatgcgaatcgaagaacacaagcaagaataaggtagattgcaacttaattgcatatgaatgattaagcgcttcaatttggagttctacaaactgagcaagcagcaaaactgtaatggcataaataatctaagcaaaaccccattctaaactatgatggctattgaataaatatgataagtgatgtccgagtttgccctaggactccacctccttgcgcttagcccatgacataattataaggctcaaatcaaactcggactgtataaggtacgtaacttgttttgcagactcccaacacctcgataggaattttgatgtaggaccaaaaccatctgaaaaagtagattccataagctttccaacaagtactcatgcgccccgagattccttctagatcaacagctaggcccgtttgaaatgatgttatcaagagaccgaatccgaatccaaaacgtgtataacttcttcttttgctttctatggaccaaaagtgacgtggtaacatgggagtagacttagggaaggtcttggtttggtcccaatcagcttcttaatttgatcatccatgtatttctnnnnnnnnnnnnnnnnnnnnnnnnnnnnnnnnnnnnnnnnnnnnnnnnnnnnnnnnnnnnnnnnnnnnnnnaatgacaatgggaagcaaggctgtaaggcggagcaaatccggaaagattgcctcaatttggattgttctctgcaactcaggaacatgaagttgaaatcgaacgtaatgtcaaagaagtggctcggcgaggggctttatgctgattcaaggccgaaggacaaagctcttcctcttcgtgcttgtcctaaataatgatattcactgaggtgtgctggctctgcttcaatccgttttcttgctccatgccaatcgaagatgaaccattcaccgagccgagtatgtgcaagacaagacacggctctcgcactcggtctcttttcctttacccaagcaaatatctttgaaaatgagaacacgcaaaactcatagtgcaataatgtttgttcaaatatatgacacttaaatcccacatagaaagcatgcacttggtttatgaatatataaggtaatcatggtcatatccaagctagtaatatcctcatcactatagctatagttgaatctgcacaacactatcgacgggctatacccgagaatggtatttgtagagtatggaagtcatcggtaccaaggtatacacgagattgtagtaagaagacggggacaatgacttttatgctagtttgggtcatcaagatgagtaataacactactccggttcatatgtatatctctggaaaagtaccacactagttacaatcgaagagcaagttagctattctaacccatcaactaggatccgtcgagtaattctcgacgagatgatgtccgcactagggcttatcttcctcctggctatcttttagtgtggctctggcttgggcttgcaattcaatgctctttcctcttgggaggggtatatttatacggctagatacatttttctccaagtagaactcgaagaaccctgttaggatataggcaaaggaaaccttgcctcttctgggccaaacttttacgtcttctattcctgcaaaagcagtttcctttcttactcgctttatatactttttgtataatattagatatgtgtatttttgtatgtcataaactcatgtataggaggtatgcactatctgtaacaccaatacttacttctggaacagtaaattcatcactatacaacagtgcttttttcctaaggtattgctaaacctggccaaatgggccgtgccaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtaccggcacggcacggcccaggcatggcacggctcaccggcccatttatttttcctacgattttctaatttttcccatatatttctcatattttttatttttttccacattttatcctatttgtaccatatattttatgatatatttcctaaattttcctcacatttatcctatatttatcattttttcctttatattatgttttttctgccttttttctttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctataggagccgtgcctaacgggccgtgccctagtgggccgtgccgtcggcgtgccgtgtcgtgctgggccgggccgcccgtttggcctgctataggtattgctgcgctcaccgtccacacaaagtcaattactgttcaaaacagtccctttctctgcgttactgcagagaaaatgctatgcataggcaagggtcactgacgccgctataatggttgggaggacatgggaagccgcaaccactgccggtgccgacgatgtcaagggaggacgagggagcactgtcgccgtcactgtcgagaggagaacatcaccggcggcgccagtgatgtcaagggaggacggtggagcaccagcgctataatcgtcgaggggagaccactgccatcgccgagagaggaagccataaaggaaggaacgataagttgatgaaatcagatttcacacaatggggaatggagatatataccttaatactatctccgttttaaaacatagctatttctggcacagtaaatatttacgatattttgtatataagaccttttattttgtaaatattatgaagtcaactaggaaggtaacccgcgcattcgcgcgggcatatattatagtttgtgtttcaaacactgtacaacattccagaatataaatcggaaagaaatttcgtacagatgcacatgcatctttttttttattaaaaaaaggagtgctaaaaggaatcatatatcactatgtatatatatactgtaagagaatttagattatcctacaataaaaaagaaatatgtttaccctaaaatagatgatagattttaatatactactaatgtgataagagtgtctcttagatttaaataaaaatccctttattctggtcatatataaactggttgtttgtcatcactacttactatcattgttttaagagttaggtgcacttttaataaatgaaattgtattagtaccactaaaacaaacgatacattattaatacattaaaaaattcatctacactacataacctgtcgttcatcacttatttttacgtatatgtataaataagctaaatataccatatctaccgaataatacgataacaccattaaaaataaacatgaatgcctctctaatgtatgaagtcagctgtatctgccaaccaaggcttccatatgtaatgccttaaaacatacaggtctcgcattgatatagccatgcccctaaaaaccatcgtagagtacaattttaatacttagttcactattggtacactcacaattgattatatttgtaagtacatcactttagttacattgcctatgatagcctttcatggacaccaccttaactcaaccatgtacatgcccatgcaaatttatgatggcatagcaggtattgcaccctgcattgaaggacaaagagggacagaaagaaggaggtgatgaaaataatttttttaagttttgagtcgattgtggtagagaatagataaaatatgtatatgaagttagtaataagtacttctcaaattttaatggaatacatacaatattatgtttctcaaatgactggggttaatcattcgacactacttaaaaaaaactataactaaagagacgtaccaccacgaaaatctgcaaaacaccatatcattatttatattttgataaagatttatactttagcgccaaatttgtttccaccatatgttgcttataactatacgagactcatttactaattctaagaatgtacttatttcacaaacttatttacactaactaatttgctagagtgcacttatagatgggttcagtggtgtataacattcgtccatcaattatacctggtatattagaatttctatcaactataaaaaaatatcataagtagtttgatgcgtattttattggattattcatgttttgccaatactacttggcaaagaaaatacataattcttgtgatgaattaagggttgtattctagcaaaacgattgtctaaaatcttatttatttatttttttttcacatctatctatcatgtatgcttctcactcctcaaatagcaataaaaaagttttgaaaaatttcagatagttttagaatctcaatctcacccaaaataaacctaaaaagatccacttaaaaaccaaagctcaattatgttgttttattaccactcgctaaaatttaatttaattttctcatcaatctattaattgtgcttctgacacctcaaataagaaaagttttgaaaaattccaaatactttgagaatctcaatttctcccaaaattaaataaacctaaatagatgtacttaaaaaacaattctaggttttgttattttaattttttacatatgtagattcaaattaacgttatatatttgtcaagtgatatttgaaaccataaaatatcatatgaaattatttgaaacattattatcgcattaactattacatgttggtatcatttgccatgatatatttatcactacaacaagtttacgattaagtttaactgtgcatatctatgtagtattatttttaataaaatcgtagattaaaggttgttgacaacaaattagtgctgaactgatgattttatcaatatttcttgccgatactactatgtacgtgtgcgtgctttctttttatttttttctttatcttttttcgatcatatatggtgtaggtatttaaattttgtttttttcttgggaaggagacgatcgtacgacttaagcacgccactttttttttaccgggatagagattagtagcataatcccttttttttgagaaatccgtccgtttctttaaagctctaatccaatgtttaaaataactggtccactaatttaagtgaaaattgaaggttggatggttttctttttttactctaaatttctaggatttctcttattttattagagcgtcacatgataatgtaatgtaggagtgtttgcaggacatttagtagacttttagtatataatagatttttatgatttctctaaattattagagagccacgtagcggtgtaaaagcgtttgtagaaagtctaatgtacttttagtatataatagatagatttagaagatgctttgaaagaatattgattggatatttattatagatcttaatttaactgaatatatttatatttgtgaagtaatatattttatctttatattgtagaaagtcatattttaaataccgttgatttttatgaatgtatgtttttatgtcttttttatgtatatgtgtatttgtttttcttctagcaaagattaggaaagttttgttttcaatcatatacgtttgtacgtacggaaagtacagcagtggcatttgtaacgtacaaacttataagtacgcttgtatgttataaacatgaggatgttattattttctaataatagatctaatctaattgtgtaaaataacggatccatcaatttaagtgaaaatcaacggtgagattagatagtgccatgtggcgacttaggagcgtttgtagtagtgccacgtggcggtttgagagcgtttataaaatgtttaatggacttttagtatataatagaagatagatagatagatacttgtgtaccatacctgatattgtaaggtatcacccttatatcgatgggatataagggtgaagacggaggagaagccatccccgtcgtcgctgccagaaaggtggatctagtggcagaggctcccacggcggatatccactctccccggtggcgatggcttctcgttgattttgttaatggattttgtctgcggatgtttgttttagtcgtgattgtgtgcttgtattcttggatggggatctcatggatgattgagagctcgatgcctcgatgcattggctcgacagctgttttttttctgaatttttgggacctcaaaggtgccggtcctttcatttctctcatatgtgccgcctgcttgctaggtgccggttgagcacctatctaggttttttttagtagtggccacacctggcccaaccgcacaacctttccaagaacatttttgtacgaacttccatgcgtgtaaaatcttctagcttagcccagaaagttacatttcctgctgctgcagctcatgcactgtacgagcaaggcctgatgctctcgatccatctcgggctgatccggaccctctccaggctttgcttcagcacacgctcgaacgatggttngaacccttcaccggcgaagaactcggaaaattcagtagctttctcctccgtggtgacctgatcatgcagaaaacaaatagaaacataaaagggaaggagtgaatttagtgcctgagaaggaagagcaatggagagaaaagggggtaacttcgcttacccgagaaattgacgaagtctgatagtagtgaatttgatggccaggtcttcaagacatgaaccggttttcctgcatcatgcatagatggggactcatggtcacagatatccaacttgctctgaactccagaatcaggcctgttaaaaataacagaacttattactgtaacttctttgatttgctcattctaagatgtgcattattcaggtggcatcttttctgtaagtggaaatatgtcgcgttcattttgatatgctggatttcccttaaattgcagagctattcagcgtcatgaatggggttggagctttcatctcaccgaggtgatgatctaatctcttttagataatgaaataactcagtcacaaccgctgcactggtaggtacacaaagctcattagcatactcctatttggtgcaactgcataaacagcttcacttcatctgttagaacgttgattcccacgttttctatgaagtactgtgtttcttttgttctgaactatcacagagttacttgggaaaaccttttggatttgttctctggttttctaaaagagcaggactgaatgatagtagtattgagcaaaacaaatgattgcaccagttttgggtaaagagacctaattatgcaaccagggagggtaacatacacacaattgcactaacttcgatattggcgtgaacggtagaaaggaattttgataatccagcttccctatttcataattattttgactattttagtttcaaaccataaactttagagcaattttacggtccttaaggaggtacaatgaggtaccaaattttacattattttttttgttacctcatgatacctcatagtacctaggtaccaaatttacaatagaaaaagtgatacctcatggtaccttctcaaggaccataatttgatttggcatagctctgtgtaaaatctaaatttgattctcgtattgatatatacacctaacatgtattggcatttggtggaacttgaactttgaacccctcataacagtaaaaatattgagcatcacaacagtgcttatagttttttcgttcataaatatcagaaatctgtgcgttgtttatcagatagcaacataaataacccactttaggtaccctgaaactatagcataccttcaatcagcccatgcaacttctcaaacttctaatatactaccaccatggacataaaatgcatcttgattccgtacctggcaagcaagagagagactagactggcttatgtatccatggtgtagaatagaatctcattccaccatttactgtcttgaatcatcgtttgttcagaaatttagagcttaacctcatcactcatcagtgaccatgaagtttggtgcctcaagaacaatatccttagctgggcatgaagacaatgtacctacaatagaagaaatattacttttcaggacaacacaactcatcataaaatccctgctgtgtcacttaagctagacagtcagaacgcacagtcctaaaatgcgtgacttgactgacttctccagtgcttcagcagtttctctgtagattttaaggagagcaccattaccacctctgctggaggtagtaacagtctgcatcatagaaagatatgaagcctgcagatcaatacatatattagtacactagataccaaagacgtgacactatagcggtatgttaagaaaaaatctgaacttttctagtgtctggtggaagaaggttagttttgctgtcttttaagaagatatggaaccgcctaactccctcatttatagtctcttcatgtccgagttcgacaagggcaatcaagagcaatgatctaagcactacatcaagatggttctcaccatccttgggatcccagcctagtgttctgatatttagctatgtgcagaggaagttttggttgtccaggaatcttttgtaatttgtatttcaagacccttgaaccttttagaccttctctccagcaatccaacacaagatacaacccatcataagtaaatgttaagatttgtttagctcttgaatgactgacgtcctctctattttgacctttgaatccatgaatcactcggacaggtgtctttgtcttgatgcaatttttcaaggcaaggttccccctccctagcttttgatcctcgtgtttctccttaccagcaggctttcctccagaaccagtatatatcagttcacctgagcttgacaattcatcgggataacctccagaagcaacgatgcttattgcaacaagcactccattatgatcggtggtatcaattcctccctggtatgggcgatgaagaccaacaagagctagctcaactctgtacagaaattcgtcaccgacttcgactccacgaacatttcccacagtaggtccatgtttagtaaagcccggcaatttcctgatgattttatcagcttcaaggtcaattcgtcgaaccatcaatgagccttgttcaacagcatgtagaagagcgttgcatataaattgaaacctcctgcatagcatcctgattttgctcctatcattgccattctcacttccatgttgcctgtgacgctcaacgcatgagggaacattgagatacaactctagctttccattatgaacagctagtgccttcaaaatatcatcatcttccaagctcaaagccttttcattgataaggttgtccttgcccgccaatccagatgtagagacaatcttcataggaatacctttactttcatgcgggcttttcaccttcaccttcttcttaggaccaaatgatgcactatttgttacaacagactcctcttttcccatggagaagggtatatgcagagtattcagtggtggcttgactgcttttctagctgtcaatagtaacttagttctcatgataccatcacgaaatacttctgttggaacattcatggatgattttttcatcccatctttttcacactccctcttagccttgaagtgttctttggaaggaccttcagcccaaggttcagccgcagctttggatttggtccctttgcatttattcatcaccttaacaacgtcagcagctgcagatgcatatatcgtctcctcatgctgtgatgtgtttccgttcttcacactagaaaaatgcctaatagaaacttctggagcagtatttgctgaaacagctgcctcatgtctactaattgtagactcatgtgggttaacagtggtagcaacttgagcctcctgaatatggtcccctgtagttaactcaacctccaccagttcttggtcatgagcaatgctgccatgatcttccattgcaagactaggaacttcccttttaatgccatcactccccaacactctcttgccgtggacaatttcattgaaaggaccaccaattgaacatttaccacccattgacaagtgtttttcagttgcctccgcagcataactacacccttccatctcatcagaaccacaccttgtcaaaacttcagtaacagcagaagttacaggaacagcactttcaagtttttctccatgaccagcaactttttgtgactccacatcacagcatgcctcagcagctacctcaccctcctccaattcctggcactttactgttccgacaatgttcgaggcacactggttaaccgaattattacggccatccgtagtcaccacctcctttgacacaccccaaccagcatcaacaggcatggcttccaaacttgaacctaccttactctcttctctgtgagcaagtggagccacagcgtccctcccacacccaggagggaagcggcgcgtcgcagatacaatcctcctcttgggaagcaaattcgcggcttgagccaacacttccttccttcccagcaattcaccgccgtgtcctccctttcccctcgctgacccttctgcgccattttccagtgaaccaactttgcgagcgacctgattctcatccgaaacatgtgaagatttcatcaagaccgtgtccatcatagcatgatgatgatgatgcgcattcgccattgaatcgccaccatctacagacgccaccttctccaccacacccggaacagcagaatcatctttgctgccagcgagaggagcagcggttgcctcatccaacagacgaacaccaccatcacaaccgcggccgcgggcgactggagcagcagcgtcccttccgcaacctgggggaaactggcgaatagcggacaccgccctccgcttgggcggcggcggcggcggcggcgaacgcgcggcccgctcctccaatcctctcttggtccccaactcgccgccatgtctcttctcctctctcgccaccacctggccagcatcccgctcgacgccgcgcgtggccaaaccaccggcgacggccaccgcatttctcgccggcaccgcgtccgctgttctcaccggcgccaccaccgcgccctcgccttccgctccaccatgagtcgttcccttctccccgcgcccccgcactctactggtcccctcgcctcgccaacccgcagcgacgtcgggacgacgacgacgaggaggaggagagcgagccgggcgagcgtcgccgccccactccgcccatccgcttcgccgcggctgccaccgcgcgccgctgctcaacatctcccagcgatccagccctgcaatcaccaccaccaccaagcacaaaaaccgaaccaaattagccgttacacatccacacgccaacacggcgagcccaagcagagaacaaacagaggcgcggcgcggcgcggccggcggaccggccgaagcgtacgccctcacctcctcctcgtccaggcaccggcggccacggcggcgaggccgaggcggcgagaagagagcgcgcggcgagcaagcagctggggtttctgggcaacgccccacttttctccccttctcgtgattgatacggcgaggccacgtgacggccgtacgcgaggccagccgcagccgcaccggaaggcttgactcgcttgactcgggtccgagcccgccgacaggcgacagctggttcggctcggtgcggtgcacgcgcacgcagctcgaacggaggctgggtcgcagcgcggcgcgggtggcgtgagccaacggtttcttgcaaccgcgttgttgacgcatgagtaatttttaagaaccccgctatgcatccgatgttctttgtcacatcataataattattaagaccggaccggtcattaaaccagcgatgctctcaattcaatgatttattggttcaactggttaaagtgttgaaccactggtttgaagcggttcaatctaatgtaaatatattgtttatcccttcaaaacacaaggtatatcgtaatctagtggttggttggtttacttttatacatgaggtcctgggatcgaatcccacccttttccctctccagctgcgaaggtgaccacgcacaatgcagatcgggcggcccaaccggtatataccaggctgattgcacaaccggtcttttagctggactagaccggcgtacgactaaacggcaaaacagcaaatgcataacggcgtgacatttcggatgtatgtgtagcattttcgaatttttaactatgttagaaaagtactcgtgcgttataacgggatgtaagtgtttggagttaaaaaggaaccggtttcggttttttccgatccaaccgccggtccggtcggttccaataactaggtgtcccaccggcgtacgactaaatggtaaaacagcaaatgcacaacggcgtgacatttcggatgtacgtgtagcattttcgaatttttaactgtgttagaaaagtactcgtgcgtgtaagtgtttgtagttaaaaaggaaccgttgtcgataattttctgatcgagccgttagtgttcatggcagaattagacgacaacatgcttaaattgaagtgttatttgaggaattattaaaaactacgacacgttttttgagtggaaagctttgaaatataactatactataatacaatataatttatatgtaaatatattataaaatatgtaactttatactctatatttatataatgttacaccgttgttatatgttgtaattacaattgaaagttcgcgatgattttttttggcaattatcttatttaaatcagataagtcgcggaatattttttagggaaaaatatgtatttaagcttagtctgatttttattatcgtagattaccttatattttgtttagagtaaattgcacccacggtacaacaacttggcaggtaggggtggacaaaaaacttaggctcgtgagcttggctcggctcgaagactaaacgagccgagcccgagctccctccacagcttgtttgcaaatcgagccgagcccgagctagctcacgagccgctcggtaggctcgtcaagcctgtgaaaaacatgacctagcctagcccattaacaagttgtctcagtctggcccataaaaaacaacagagaaccctaccctaactgctccgtccgaccctccccattccccatcccacgcaggtgcaggcacgccgccgcacgcacgcacgaccggcgtcactagcgagaggagttgccggccgccaccttcggctccatcccatgcgccgccacccatcggcttgccgccttcctcccccgtccccagtcgctcctctgtgccgccggctcgccgcttccctccctgcgccgcctccttcccctgtgcggctgcgtggctccggcctccctcaccagcggcgctcgacgctccccgcgccaccacggcgccgcttccctcccccatccccagtcacccctatgtgccgccggttcgctgcctccctcccctgtgccgccggcccgccacatccctccggcccgccctcccatgcgccgcctccctcccctgtgcggctgcaccggctccggcctccctccccagcgacactcgacggtcaatggctcgacactccctatgccgccgcggcgccgcctccctcccctgcgctgcctccggcctccctccccagtgccgctcggccaccctctcaagctggctcaagccggctcgagcttttaaatgagccaagccgagctgcactttttgctcgttccatttatcaagccgagccgagccaagcctgttcttgaccaagctttcacgaagccgagctcggctcggcttggctcgtttccacccctatcggcaggtgggtgcgatatagtgcaagaacttgagaattgaatgtccgagtgcaacaacttgacaagtgggtgcgttctaatacaagaacttgacaatttagtattttggtgaatcaatttgctaagcatatgctaggtgagttttttccgatatcaatatgccaatacatagtaatcctatggatattatcttataatattgaatttaatctttaagaattatattgcacatacaatttacattcagttttctttaagaatttttttgttttcttcaccttctcaaatatcaaccaaatataataatttctacatccagtttaattaactttcagttattagttattagagttattagttattaggataaaaatataaatatgtttatacaaatccacgctagtatattgtcaaaataaatacttaaaaatttgaatttatataaaaaatgctccaaataattaagttgtcacacaacttcttaatttattatatcaaaatcgtacttaccttgcaaagttgctgtatttatacgatcacttataaagttcttatactaaattgcaccttcttgccaagttgttgtaatagaacgctcatttttcaagttattacaccaaattacacccacctaccaagttgttgcaccgtgggtgcaatttactcatatttattataagtgacggctcgagcgatcgataaagtttgagtttaatcaacttttagtgcaagctatgtgtaatataaatggaaagtgaatagctgatatatatatatatatatatatatatatatatatatatatatatatatatatatagagagagagagagagagagagagagagagagagataaggatagctaggggaatgggacggggtgagtctgtacccacctgttcgatctaaggcaccttagtcatagttcaaatgttgaataagcatggtcgagcaaaattttgattcgttggctgcaatgtgtgacattgatcatggacccacgtagaaaaagaatctctaatcacatgcgtccatccctctctcgtgcagccagccaacgactgcaaattaccttttcatcgccgagttcgtctctccttctgtggtcgatttttgctctaacatataacagttggttgctgtagtgtgttgtattcggtttttcaagtatggttcgattttactcgtacactggagttgctctaatgcaccatcggaaccttgtctcctgcctcctggggctcggtcatctccatgtacacacagcacgggcgcgatgactctacgatttccatcttcgctgccttctgggaggcctcctacgtgcgtgtacacaatctaaggctgttttattcggtaagcaagtgaatgggattgacgtcaagttggacctgaatgctaatgtctatgttgggactacgtctatcctatgttacccagatacggggatacggtatttttcagaaaacatggatacggagatacacctatacaaattttattttctaaactataaattttgggatacgcccgtatacaaataaagatggatccacacatgtccatgacaaaaaaaaagaaatatgatgaagcttgattgtttcataaaatactgttagtgagcctgtaggctgcaacaacattaccagccgtaccttactactcccaaaccctacataaaaaacgaatgcgcctgtactttatggaaacaaatcaaagaagcaacaaaccaataagcaaatacccagcggtgcatgggttgtgttcaactatggcgctgcgcctgaccactgaggaggaggccccactgcgcccagtaggcagcagcagcgcccgagcggcggcgggaccacgctcagcggtggaggtaatacgtccaacggcggccaaccgactcgcggagggggaagcattacatccggctacgacggggacaccgtcagtgccacacccaatagcagaggtggagctatggcgtccgacagcggcagcataggaaccatgcgcttgtaggggcatcaaatggtgaacaagatcgagccagctcacatggtggttgccatggatttgtactgctcagcgatttcaagcgatgtatcaaggcgtatccacgaaatatccagatttactttgttttatttgttagttgtgaaaatcatggatacgtacgggacacatatcggagcgtatccgataccgtatcatccgatatggatacgtgatttttttgccgtatacaggtaacgtagtgcctatcaacttgtatgcaaagcttcgcagcatggatgaggcaatgttggtgtttcatgcactcccaacaggaggcccaggcgcccaactacttggaatacggttatcacaggatacgctcagattgggtgtggtggaaggatacgctcagattgggtgtggtggagtagccgtagagttgtttgacagtatggggatttaaggtgtccgtcttgataggtttgtactaacaactaacaagtgctctgcacttggctttctaaagggtggcaggcaaatacatggttacgcatatgtgacacgtgggcccaaaattttctttttatttttattttagtgtcacgtaaacgccatgtcgatgccacgtgggatgaagaggggaaagttatacctggttttgcggttgaggggtgcatttcaaccagatgcatgagttgagggacgcatattagacttattcctacatgtgtcgaagttttaccaaatgggcttcaacccaataggcccacgtaagctcggcccatcgacgtacaaaccagccctccgagacggaaaacccaaaaccctcgtctccctcactgtcccgtccctgcggttgcgctccactcgtcgccgccgccgccgccgccgccgccgccgtcgtccgcgtctccgtctccgtcctcgccgaggtatcccgtctcgtctcctccgctccttgcgtcatctctctgctgaacaggggaggggcgccgatctccatctggcgagcagagcaggggaggggatcctggtgagcatccacatcctgattcatctctctctcccaccgggactacttttgtctggaatttgcttgcgttcgttaaccctagctcttcttctagatctggaagaagctcctctcttaatttcagagccttaaccttaatacaagtaacagtttgttgtttgttccccaaaaagtttggccaagttggatccgccgctgcctagttgcagaaatgggatgacatatctcttttctttagttgagacctaatcggtggagctcgcttttctgatgtttattgatgatagtttagtttaccaacagtactgcatattctgcattgcagaacattgtgagaatggcctggagtcagagtgctagaaagcccatgattgggcttctgtttcgcgcccaacaacattctgctcggggttactcttattcagcgttccaggctcacctttcgagcagcaatgtcgatcaaagcgccacacttctcaggagattcagctccgaagttcctgcgtcggagcaaatgaatctcatcaaacagctgagggagaggacgagcgctccaatcaaagatgtgaaggcttccttagttagttgcaactgggatattggtttgtgcttatttctgattgcattagcattacttcatcggcatacttgtttgtatctgttaatcctattgacagtttgttgatttctttcagatgttgcacagaaggacctaaggaagagaggggtggttcttgctgccaaaaagtcttcacggactgcagctgaaggtttgcttgctattgcacaagatgagaaaagggccgctgtggttgagcttaactgtgagacggattttgtggcaagaaatgatgttttccagtatctggttagtttttatctcagtatctttatgccattcctgatgcctactttttgtgcatgctaaacatatagtgtatttgagcatgtaggtatagcttgttggttgtggcatatcaaaatatgaacagaatcattttgtccatgttttaactttcagtttcttttgtaggttttatttgagtatttcaacattatgacattatgctctgttgcagttgtactcttgaacttctttgatagctgtgtatcttgtaggatattcttttccctatcttagacatcacaacagcatacttatttaactgccttgattgttcagcttgtgcttgtgcgtggtttcaaggtagttaaacttgatttatgatttttttttatatctcatcaaacttgcaggcttcttctttagcaaagttggctttatcagcaagggatcctggtgaattggtttttccttttggtcctgactatttggaggtatgaagttatccatatattaatttgggttatggcgcatttattgtgtaatttatagaagcaccaccaattttaccagtaattgattgactcgtcattttacaaatttgaaaccaactgatctaagtcttcattaagttccatttcatgtaaaattctactttaacaggtgctgtgatcaatctcatgttatcttttcaataatggtgtatctgtatttaagcccactacacactaccttttcaaatagtatggattcagtgtgctgtactgatagagatattaagatacttgtgatcatatttatgtaacacccaccacacagctgcaagagcatccagccatccacctgactaaatcaccaccacgaccaccaccacccccaagccaatccagtcggggatggttgatacgcgattggtcgcgcgccggcacacccgcgcgaccagcgctacccatctagtctcagtatttatacgtttgtatatataccacaatacaaagtttatacgcatgtatatgaggtatatatacatacgtatatagacgataaaatatgtgtaaactttgtatatataccctacattttttatatgtatacgcatacacttttgatgtataaaaaatatgtatacatgtatacaaagtttgtatacaacgtatacaaaatatacaaactttgtatacatacgtatacaaagtttatatacgtatgtataaaaaaggaaaaaatatacatgtatacaaacttagtatatgtgtatacatagtttgtataacaaaccgaaaaaaaaaacccgaaaaagtgaaaaagaaacagaaaaaaaaggaaagaaacaggaaaaggaaaaaaaaaaggaaaagcatggctgtctgccgccctcctctttgcgcgacgcgggggagggtgcgcacgactagccgcgaaaaagcagtttcgaatccagtccaccacagaaagcaggtgcagcaagaagcaaagcaagcaagcaagtacaagctttccatcaaggcagcaagcaacaccaatttaccaccaccaccagccgcacccacacagcaaagacaagcaaattgtggaagaatatctgatagtgtagagtagagtagcagagcacacaagaacagagcagtatatagatactagagaatagactgtagcacagcaaaggccaaagagcatggcttacttgctcaattcctcagtgttggccataattgtgcactgtgctggtgtgctggtgcatatgtccaagcggctggtggcgtggagatggtagatggtggtgagtgcctggcggggagaacagagggacgatggagcagtagaagtcgcagcggagcagtaggagtcgcagcagagcaggcgagctgccagtggatctaactacggtggcggcggcaacgtctatggcgacctcaatcgccatcgcctctcccaaaccctagccgctgttgcacgtgctccaatttggggattaggttgggcagctagggtggggaggtacttatatcctcgcctgtactgagccgcctaggccactagtcgccctcttcactgcatacttgctgccacaactagtctgagttggaccgaggatgactattgaggtggggcagctgccgagctcaccgccaaagtgctaatcgcagtgccaagctgccgcctggcaccgaattgctacctacagctgatttttagcacactgtttatgttggatataaaaggaaacaagttaaaatggctcaaccatttagtcatatgtgacacaagaacttcatggcagtggactggaaatgccatgataaatgtgacttggctctagtattacagaggatgctatgtggagatgatcatgatacaaatgaacatgtttgcaataccagcattaacaaccacattgtagatattgtagccattgtaaatatgtatatatatcctgcttttttaaactacatgaagattttagtgcttatcagatatttagtttgggtaggcttattctacagcccccccttagaataactgttgcgcactatctccctccactagagccatgctctcagagaaaagccacgttgatgtgcgagcccaggatctctctctctctctcacttcctgtgccctttgcacagagggcacagcttcttatcctgtgcacacagtaatgtctgttgctgttcccatgatatgatttggttagcttcatatgatatgtttatcttcttttcctggttttttccatgtgtaagtagatattataaagttgtctcaaactctcaatcatgcagaaccttaatgtcaatcttgatcatcctaaacttagtggggagacaacagtccaaagtgctgtcacagaagttgctgccatggttggggagaatgtcaaattcagaagaggtttcattatgtccacaactgcacatggtgttgtttgctcttatatgcacacatgtccccagccaggtacatgcacaaatctctgccctttggcttttatcaagaatgtagcatgcatgttttccaatcttcttggctaagtttgagtgcacataaccaaatgaaagttttctagtgactactgagcatggatcatacttgtccttgcctttatttattttccttttttttttgtgccggggggtggggtggcagtgggttcagaaatctaaatttgttggactttctggacattaccttccttaatctaaattatagttaatctattctcttagggttgtccagtgatgaattttagcttcttatttatttatttatttagtaggatgcaagctcatttgtaaaaccattgatagtaatacgactttagtgatacttgcctcttacactgagctggccaagcttgctcgcattattaatttgattcctaacagcaatccatattttatgttcttcagaagtatgaagttgtattgatatatggtaaatggtgcaatttctcgttcactgaatgaataagctttttcttttttttctgaaataaggtttgggtcgtcttgctggcttgatcacactagaggcagaagacagcaatgctcctcttgatgctcttcagagagtcgggaaatctattgcaatgcacatcgttgcgacaaagccgttgtttttatcaaaagaactggtctctgcttcagctgttgaaaatgagagggacatactccggactcaggtacgttattctgataaatgttacttcctttgcaccggaaaaatttagcatcactgtaattctatatgattagcttacaattgaagaaatgggcgtgtgctttacatagagatatcaggtatcataaggtcataccataccaagtgttctgatgttatcttaacagaaaaacatacataggcaataatgacctatagttgagagaaaaatgcatatcttgtgataagtcctaactcattataactaaaagaaaatgaaaggaaactgttgactcacaatagaattttctcaattagtattcctgtcacattgttttatgtttatgtaagcaagacagctgggctgttagaattcagagatgagctatgcaatggaacacaatgtgaatccgtatattagaagtttatgataccaattatgtttatttttccatgaattaaatagcaatatcttttgtcatcttctggagacacatgggctacatccatctggaatatgactgaactgcattcaagttatttaagatttagtgacacactactctgaaactttttaggctgaaagctctggaaaatcccaaatggccatggagaaaatggtggaaggccgactaagaaagtattttgaagaagttgtgcttttggagcaaaaatatgttgtcaatgacagcacaaacatcaaggtgaactgataaaaccttttccttttttttaattatgtagtactagtttgaattgtgaattcatggtacataatggttttgcttcttgatgtcaacattttcagagcgtcctgaatgatttgtcaaaggaagttggctcaaaagttacagttggcaattttgctaggatggaagttggcgaaggagtttcaaaggtacaatatatttgtcacagcaacaatggattgagcattttttgggttttggtgggggtggatggtaattttatctgattaattttttgcagttgtgcatatgcactataaaccttcctgtcctttaacagcagatgcactaaacaaactgatggcccataaaaaaagcaatatgttcttttagatatcaattgtttgcgattttactttatggttcttgctaattttctcatccgacttcagtttaatttgacctatccctaattcttcattgctttttttttctccatataatcaactactaaccaaagttttgtgctcatcaggcctgatgagtccactgggtctgaagctacggctcgttctgcatagttttcaagctgacatgaatcaaatgtgataattgagatatgctgaggtttctcttcttctcaagttagatttattagtctcctgagaactgtactactttttccgcggtttggctccaacaatacggtcatatttttctacaaatgctatgtatcaattagtttacaagtgaactttctctagagagtattgtaacaattcgaatttaatgaaataatgtttgatctaaacaaacaaggaatacaaggtcacgctgactcctgcaaagctgaaggatccagttttaatttggtttctttatggtctttcttgatctggatctgattgatgtgcagtgtgaattcagaacgcctattttagtacagtatcagcaaatgtgtacagcttccttttatattccttttatatcacacctggatatggcatatacgggttcatcttgtcgtctatatttagatcattgcaaaataatggaataatggcagcagagaccatgattttgcaatgtactcttgttgcaattgttcagatgatcacaagttgccaaccagtttgacgtagtgccgtgtgcccgtccatattttcctcaaattctgttttaccattccaccccatatgctagatgtcagaagattcacatttcgtatgtcatcaaatcagaatgcagatctgaacatgaaaaagaggaaagagagaagaaaaaggcagcaggattgaggataatgtgctcagagcgtgtgaatgaatgaaaaaaatgaatagtgtcaaattattacttcgtgtgctgattacctttctttattcagcttagtagtgtcaaattattacttcctgtgctgcttgattgcctttcttttaattcagctttttcagcagatcttgatcgtcaccgggaaaagaaaagaatggatcttgtccaagtgatctgcagcacaaaaggatgttgaagttctcttgatatggtctttttattggtacttgtgctgattgcacctaattggattatttgtttttcttaattaccacatgccaaacagatgttgtggatgaaatgcaggaagtatacagatcaaccattagcttcctagagtgcagatcagcagaagtttattgaggcttctgagcacaattgatttgccactcatggtttgataaattcctttcaaggcactaaaaactaactatacatgcttggtgacatgtaaggagttgcccctattttagttgcataatggctagttatcaacgtaattgtaggtgtagaacattttagataaatatattttactgaaggagaggttgatgacttatgcataaaaaaagggaaggaaagaaaaagagtagtttaaaatgaataaaataaaattacttgcacctagagctaacatattgcatatactatcttctaagtgagataacagtcatcatctccaagagatatcaaatttggctatccaaatctccatttaaccatccatgccaaaagattccctcattcttgtgctccaataaactttctattttgactctctaatatatgcctttccagccttccctagttaaacaagacaggtgaacttgggatttttagtgtctctaggacaacgttgccctgccctcttctccaccactaccttggcttttcttcaattctctagtgacgaagacttgcctcgacggtgttctgactacaaagatcagttctccttgcctctctctctctctgttgttgctgcccatggagttttgggaggaggtgggcgaggtcaaaactgatgtggtgctaggaagaatgcaatgaagtcaagccaaacgacgttgagtttggaatcttctgagctcgagatcactaggtacgcagatcaggactagacctagaggcagtagagcagcttgtctcgatagagaggtagtggcattgataaggagaggccaagagagaaggcgggcgacatagttcggctcggcaaggaggtagcgatgctgctcggcttgacaaaaaacgatgatgctcatgtgggatgagaggtggggatgatgcagggaggtcgaggaggaggcaatagcataggtagggggagctgactctgcttctattgctggcatgagacaaccaacgtagatgagcggtctaaccggtgtgcatacagtggttagaccggctatgccaaggacttcatcaggttagaggataaacttttgtttccgctaaaagtttttgttcttgatattcgtaccattcatccctctctggtaggcttggtttttttgtgttcgatcctataaggtgaacagggagggaacaaagctaggatctaccagctaagggtgtgttcttctcctaaataatatgagtgaattatttgaaatttacacagagctataccatgtatttttcaaattcaaatcatgaactttaacaaatttgatttgacatagctatgtgtaaattctaaataatttattcatattgatatggacacttaatatgtattggcatttggtggaatgattgaacttcgaagccctcacaacacttcgaagccctcaatcttctgttcttctacaagatttatttgatgtgccactctattattgttgatttgtttgatgtgtgtgaaagccaataatcaaatatactactcttattgactgattaattgaaacttcacctgagggaatcggattcaaaaccacactacgaagagtgagattgagaatattctaaccaagatattacacaaagttgaactatccagactgtatccgtgttatcatccctataaatgtttgctactttggggatggtagataatatagttaccatgctgatgcattctgatgacaacatacattgtaattccctatcctaacatgtatctgcttatgagccctcctctatacagattttggatagacctattgtattctgcgccacattaaatttctaaaattgcatcatacctttggacccgtggtggcataattctgtgcttagaattgtggaggttacagtacatccactggtggatttacttcgacagaaaatgggcgtgggaggagaagagggggggaggggggggggggttacaaagttaactcatgtattttacttcattcagtatacgctgtactcaagcaattctccacggaattcacatttattcttatttattaacatgtgaagtgtaaaatcaaagtgtttttgattctttattctgtgatgaacaattggcatctgtgattatcggttttgatatttggagattattggcaaagtggttttggagatgattggatttacaggtgctgctggatagttggtccggtcagaccgggcagtggttgccggtcagaccagccagcccgcggtctgaccggccgactctgtgtcggcttcggtttcaggttgtttgtttggatatccgtgattgtttcttgtttatggcttctagatggatactatgcgtatgtaatactgttgtttgctaacaatgagtcaaattggagatagcttggtattggaatatggtttctttgtttgattcatgtgtaggtgacttgatgcctcaggagagtattgccggtgatggatcgggagtcgacttggagataagatgacgtccggacagtcagatatcatgtggaatacttaggctaaagatcaatacacatggttggtgaagattccatatggcatacaatggagatattgtgtgcgtatgggatacggagttgaattttgaaggagtccaaatttggtatgattggagtttgtaaagtttgtttcttgtacgggaaggttaggtggattaggacttctagtatgagtttgattagtggctttaggctgcctacttcatgtataaatagagagggagcgtgaggcttcccggtatcgcttttaagagcattgagttgagagttgagttagggtttcgaatttagccaagattttcgtgaggagtgctgttgttgcactttgtaaacacagagagaagtaataaagttgtcatctacttcgagaattctttgatttgtgtttgctcaggttcggcggtctaaccggcgagacaccggcggtcagaccggtggcatcgcggcggtcaaactggcgggtatacggcggtcagaccggcgacggcttcaggagacagaggcgatttcagggcggtccaactgggagatctacaccggttagaccggcggatcaacttcggtcagaccgatctacatcgatttgagagtaacttttaattccgcaaaaagtttgggtttttaggtatactaaccatttactcactctctttggttggcttagttctttctattcgatcctacatgaaggtgaaaatgccaacgttaccagcacaacagccagcaggttatctaactatcctaactcctgagagtagagtatgcattcctttttattatttgtcctcgatgtccgctaattctggtcaattttgtcctaattcgtattttggatggatttttcatcaattagttgatgaattcatttgtaagtggacaactacgccacatattctgtaattcagataagtcatcatataatgctttcctttttcagtggtttatagtacgctttcctgcagttaaatagttagtaaaaatattgggctgctgaaattgaaatcagtgatggaatatattttgaaatacattttgttcaatgacttctatcagctagccaagttttcttcaggatgttgccatgattttactgcatcttgttaacagaaatgatttttactttcaggagtgtgacttgaccttgaggatcttgtatatacagtacttttggattagcagtttgtccactctaattttatttaatgtatggtgaaggtgatatggaggaagaccagaagagttcatgaagctgaaagcaatttatttgtcacttttcaaatgaaacagttggtttatcatcatgaagataaaaatgcattgcctttgagaattatcagtcatcaagctagaagaaaaaatggtgttcttatttattattgcacttgttctgtccttgaaaaatgaagtacagaacacatgttaattctcacatcctatatgttttgttcttgttcagttttgtgccaattcagtccctggaagataaattgctaaaacacatgataatcctgacatcctgtgggagtgtgggtggacctgttttaggcctatagttatttgattaggttatttaccaaaattagttgtattggcttgctgttgttatttgggcacactcttatacgggctaacccacggcagctgtggtgcacagctgaattcaggggttgtggtgattgacaatccaatccatatcatgttcttgttactggcatcttgtctatttgcttgatctcacgtatcagcgatccatgattgatctgaatactgctacaaacaaaactggtgcattttgaatgtgtcacattctatgatccaatcacactgcaggaaaaagtggtaacttttgcacaaggcaagaaacggttatattccaatgcatgcacttcttttttttacaaatgtatctaacattacatggttgttatcccaaaggtatctctgaaaaatgcataaaaatatggacgcgctgtggcgtggccatcgtgcgtcgagaggtagaatgaggcttgggctgatctaacaaaccaacaaggcttgttttgcttcgattgggataatcggaacagactaaattgcccctccaccttataacgaagtaaaggactaagatctgcttccaactacactactaccataacaagtaggggtacagtaaaatgtcccctttagattaccccacaactataacataccttcaaccaggcccatgccacttctcgtccttctaagctaattataccacccaggacaaaaaatacatcttgattctgtacctaacaagcaagagagtttagattggcgtaagcatccatggtgtagaaaagaatatcattctaccatttaccgtctgaatcatttgttaagacttaacaataagcaaactagaaaagatttagacgatcgacctcatctataagcatgaattctttgtagtctgtatttgaagaccatagaaccttttagaccttctctccagtaatccaccacatgatacaacccgtcataagtaaatgctgagatttgtttagcccttgaataactgtcatccttgccattttgacctttgaatccatggatcactcggacaggtgtctttgtcttgatgcaattcttcaaggcaagatttcccctctctagcttttgatcctcacttttcttcttaccagtaggctgtcctccagaaccagtgtatattagttcacctgaacttgacaatctatcaggataacctccagaagcaacgatgcttatagcaacaagcactccattatgatcggcggtatcgattcctccctggtatggacggtggagaccaacaagggctagctaaactctgtatagaaattcgtcaccaacttcgacaacacgaacatttcccacaataggtccaggtttgataaagctcggcaatttccgaacgattttatcagcttcaaggtcagctcttagaaccttcaacgagccctgtttgacagcttgtacaagagcctggcgtataaactgaaacctcctgcacagcatcatggttttcctcctatcatcagcattcccacttccatgttgcccgtgatgctgcacagatgaggaagcattgagatacaacttaagtgttccatcatgaacagctagtgccttcaaaatatcatcatcttccaagatcaaagcctctttgtcgacaaggttgtccttgccccctaatccaggtgtagagacaatcttgataggaatatctttagtttgatatgcaccttttaccttcaacttcttcttaggaccacatggagcactatttgttacaacacactcctcttttcccttagagaagggacgtctatgcagaatgttcagtggtgacttgactgcttttctagctatcaatggtatcttacttctcatcatacaatcaccaaatacttctgttgcaacattcatggatgattttcccatcctatcattttcacactccctcgtacccttaaaatgttctttggaaggaccctcagcacaaggttcagcagcggctctgggtaaggtccctttgcatttgttcatcaccttaacatcttcagtagctgcagccatggaatcatccacagcaacattttgtgaatctacatcagagtatgcctcctcagccacctcaccctcctccaattcctggctaaccaaactatcaccgccatccgaagccaccacctcctttgacacaccaccacaagaagcatcaacagccatgaattccaaacctgaaccagtcttaacgtccctcccacatccaggagggaagcagcgcgtcacgggtaccatcctcctctttggaagcacattcgcggcttgagccatcacttgcttcctccccagcaattcaccactatttgctgccccttcttgtacaccgtttttcagtgaaccaagtttgtgagcgacctgattctcatccgaagcatgtgaagatttgatgcacatttgcaattggatcaccaccatccaccacagcttccaacggcaaatcagttttgctgccagcgagaggaggagcagtcgcctgatccaacggacgaacaccaccgtcggcattgcggccgcggccgtggcggcgcccgagtggaacagcggcgtcccttccgcaacctggaggaaactggcgaacggccgacaccgccctccgcttgggcggcggcagcggcggcggcgaacgcgcggcccgctcctccaaccccttcttcgtccccacctcgccgccatttctcttctcctccgtcgccaccgccgcgccaggatcccgctcgccgccgtgcgtgagcgtggccaaaccaccggccacggccacttgagtcatcccctcctcgccgcgcccccgcgctctactggtcccctcgcctgagccgcctcgcccatccgcggcgacgggacgaggtggaagcgcgtccgggcgggcttcgcgctgcgtgcgccggcttctccatgtctccgccgcctggagcagcatctccgagacgtccagcgtcggctcgcccaccgatcgccgccctgatgcaatcaccaccactgaacacaaagaggaccaaattaacagtcacgcatcccaggcattcgacgaaacccaagcagaggaggtgacgaacagaaacagaggcgtcctcctaccatcctccgccgcaccaccgttgacggccaccgcgttcctccccgtccccgtccccgccccccgcgtccgctgtcctcgtaggggccaccaccgggcccgcgcgctccgcacctcgtccgcctccaccatgagccgtcaacgtcccttcctcaccgcctcgcccccgcattctatcacccccctcgcctctcccacccgcagcagccacgggacgaggaggacagcgagacggaatcgccgtcgcgcgagcgtcgccgcccccgcccccgccccactccgcccacccgcttctcggcggctcgctccgccgcgcggcggcggcgatcaacgcctcccagcgatccatcccccgccgccacccgccctgcaaatcaccaccaccaccaccaccaccccaagcccaaaaaacccgcaccaaattagccgttacacacatcatccaacacgccatcacatcacaacacgacgaaccgaagcagcgaacacgaagaacaacacagaggcgaggcgtacggactcacctcctcgtcgtccagacaccggcggcgagagagcgcgcggcgaggccgaggcggcgagccggcgagcacggcgacgcagttggggtttttgcgcgagcagcgagagagagagagagagagagagttggtggggccgagaagagaaggatgggtgatgattggtgaggcgaggacacgtggcgggcggacgccgcaccagaggctgaaggttgactcgggtccgactgtccgagaccaaactggtccggctcggtcgcggtgcacgtggctgacccaacgacgggtgggtcgtgtgtttgcttgcaacccgcctggcgccttctcgttttatatagtaccggtgaggtttgcattggagtaggagtatttactgcggcgtaaattagtagactggtagtgggcattattgtggcaatgatgctgttctacgatggtagctgctgaaacggctgctgctactcccgccgtttcatttcatgatatcattagtgcaagtttaatggtatagtaaactattggctctaaatcattaataattaacttaatagccaatttatacaatagttaatccctccgttttagattataaaacgttttaactttggttaaagtcaaattattttaagtttcattaagtttatagaaaatataataatatttataatattaaattagtttcatcaaatcaataattgaatatattttcataataaatttgtcttgtgttaaaaatgttactacctttttctacaaatttggttaaacttaaagctatttgactttggccaaaatcaaaatatcttataacctgaaacggaggaagtacatataaacatatactacacaatcaatatatggtctcatctatcatacacacatgtgtcttggagtctgtgttgtagctagctataaatctgtagcccgctgctcttatctttcctcttttatctccttaaaatatatttatagctggcttatagtctgttattgtacctgctcttagtcgtttaagtttgatccagtttacgcaagacaaacatattaccaaaatatatttaatattatatttagttaaactaaattagtgttgcagatgttactatatttttctataaagttgatcaaaccaaaagtgtttgactagaaaaaaaataaaaacaacttataatatgaaacggagaccatactatttagggatagtaacactcctcttgttttcctaatagattttgtactcacttggttatgttttagataattttggtccaattctaaaacttcgaccataatttttagtttttttcactgagcggtcgaaggacgccgtctaaattttgttagattttaaaaggattttagaatataaaatctcaggaaactagttttgccaaggtaagaccatctcataccgcttaaagcaagaccgcctcaaggttcttaaaccgctaatagctaccgccacacactagactaggtctgcaacaccatggcgctgaactctgccgaagatacgcacaatgtgctccttccagatccaccaagtgatcaagatcatggctttggtgagccattttcgagcacatcaccatctatcctagaagcagtcgcgcgtgcgtcgaggcatcgatgcaagaccaaagtcgtcaagtgctctgtgctagctagcgcctccgccgcctccacgggaggtcatgatgcacctcgatgcccgaggacgcctcctttgccacggtcttcctccggcagctgagcttccgccacctccctcctttctgttaggacttgggggtagagagagagagatggaagtggacgaaagcgaggagggagactgaccgagcccactatttttttattactttttgttgtttggactaacacatgtatgtcacctaaaatccaaaccgcttcggattgagttaggggttttgttgtctggtttgaaaagtttaggggcgtagatatgtctggttttgtaatttatggggttactcggatggtgtcaatagttcaggggtaaattcagatttttttttctagttcttactacgggcgaaaatgggacgggcattttccgaccacctgcctggcctgaggctcacaagaacatgggagagaaaatggatattcgatactatccaagttcgaatccaaattcgtaaaagatatgttttaataagggaaaagttgtgtccactcgtattcccatattattattatacatatatgaaaatctgttataagttcacctacaaacatgataaaatattgattacactagtttataatatcataggtaatattacataaatgttttcttgctttatctcttttggtactttaattgcccctctatatttaatatgcatgaattgcacatagaaattctttcatgtatccgatttcgagaaattaatatggaatgtgatacggcacaagtgacatgttatccgatccggcactacctatacccgattttaaatttgaaggaaaaatataggttaggatagtacgagatggccgggccggagttctatcggtcgaaccttcttgttataggttgccgaagtgccttccgtgtacttgcgcatgtgttctagtgcttcgactctcaccccttccaggagttcgagcgacacttcacgcccattttcgccaccggaaaacatcacccttgagattcaaaaccatactatgaagagtgagattgagaattttctaatcaatatattacaaaacaattttgctatacatttgtcgataaattttctcctaaaaatttggcagatgtaatacagaacaatcgtaatgtaattataatgtaacttacatgtaattatactgtaacttgcatgtaactacagtctaacttatacataactttcacataattttggaccgttagatttgtttcaagatttgtgcaagtgaggaaggaaaaaaataacacacacatatgtcagaggattcgttcccacgacttccgtttcaccgaaatagtatactacgaagaaacttttaaaagttacatacaagttataatagttacagtgaaattaccaccgtgtttagttccaaaataattcttcaaacttccaacttttctatcacatcaaaactttacacacacaaacttctaactttttcgtcacatcgttccaatttcaaccaaacttccaattttggtgtaaactaaacacagcctacatcacaattgtcctataatttcatttgtcaaatttttagaagagaatttgtcgacaaatgtataggtgatcccatccagtgtacactgtactcaagcaattctccacgaaagtcatatttactcttttttattgacacgtgaaggtgaaaatgccaaggctaccagcacaacagccagcaggttatctaactgtcctgactcctgagaatagagtattagagtatgcattcctaattctggtcacttttgtccttcaattcgtattttgggatggatttttaattgaagcttgagatgtgctcctatctacaatctggaataaccttgagatcaattagttgatgaattcatttgtaagtggacaactacgccacatattctgtaattcagacaagtcatcatataatgctttctttttttcattggtttatagtaagctttcctacagttaaatagttagtacaaaaattgggctcctgaaattgaaatcagtgatggaatatattttgaaatacattttgttctatgacttctatcagctaaccaaattttcttcaggatgttgtcatgattttactgcatcttgttaatagaaatgattttgattttcatgagtgtgattttcatatttgggcacactcttatacgagctaacccacggcagctgtggtgcacagctgaattcaggggttttggtgattgacaatccaatccacatactcatgttcttgttactggcatcttgtctggtgcattttgaaggtgtcaccttctatgatccaagtacacactgaaggagaagtggtagcttttgcacaaggcaagaaacggttatattccaatgcatgcacttttttcttttcacaaatatatctaagattgcatggttgttatcgcaaagatacctctggaaaatgcatacaaatatggacggcgctgtggtttggccgtcgtgcgtcgagatgcagaatgaggcttgggccgatctaacaaaccaacgagtcctgttttgcttcgattgggataatcggaagactaaattgccccttcaccttaacgaagtacatgactaaaatagccatagctttagatgatctgcttcctactacactactaccataaccaataggggtacagtaaaatgtcccctttagataccctgcaactataacataccttcaaccaggcccatgtaacttcttgtccttctaagctaattatatcacccaggacaaaaaaaatacatcttgattctgtacctaacaagcaagagagtttagattggcgtaagtatccatggtgtagaaaagaatctcattgtaccatttactgcctgaatcatttgttaagactaaataataagcttactagaaaagatttagatgatcaacctcatcgaccagcatgaattctttgtagtctgtatttgaagaccatagaaccttttagaccttctctccagtaatccaccacacgatacaacccatcataagtaaatgctgagatttgtttagcccttgaataactgtcatccttgccattttggcctttgaatccatgaatcactcggacaggtgtctttgtcttgatgcaattcttcaaggcaagatttcccctctctagcttttgatcctcacctttcttcttaccagcaggctgtcctccagaaccagtgtatatgagttcacctgaacttgacaatctatcgggataacctccagaagcaacgatgcttattgcaacaagcactccatt

SEQ ID NO: 10454 - DNA, 813 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagcttctacatttaattaacaagagaactattgtatttatctaacacctggattatctccacctttcatttgatccctatttatagattacgctgcgttgctaacgggccgcaccttctatttcctcaagggtgaggaaatgaagtccatgtacaccacctacaatccgcagaatgtggt

SEQ ID NO: 10455 - DNA, 2904 bp, Oryza sativa
  unsure (1)..(2904): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagtgtatgtgagagtgcatgaagtgaggtcctttcataaggcagttatgacggttgtgagaaggggaaatgtccgaactgctccgcaaccgtcattgggagaacatctagagcgtccacgccaaaccctaggatcaaccgcgatcaggggggttcggccgaacctaggctgggccctcctggcctggccttcgttcagtggactccctagaccttcctctatccatttctcggagttttgggttgattcactgatgtttcgatgaagtacacaacccctccttgtatggatgcataattctcctcactttagtttgattttcctcccaacttcagcgtttatcatctgcatacaaatatacaccaatacttgtggaatatgagagattaagaacctatcactatgttggatgttttattatctaaactttatgcagatgttggcggtatgggattggcatttatcagccgccaacagtgacttggatctttgtgtgtggatttggagtttgggagcctggtgtgtgtttcttgatcttgagcactaggatttgtccaagagttgtgtggtgtttattactcttggaggttgaggactcctagatggctaggtgtcattcttggccaccgatctacgtgtggttggacaagagaagtttgtgaaggccggatcgcgcctccgcaaggaaagagatacccttagtggaaggaggagtgcatttgtccaacctcatgaggatagggttgaaaaagacccggctctttgcgagcccctcaacggagactagaatcccctcaaggatttgaactctgggaaatacatcggcgcgtaaacctcggtgatatcttcactctctttaccttcttgttccattgctttgtgctatgctcatattgttgttggtcgagctcacctctttgcctgtgtataatctagagctcttaggttgttctcttgtttgtattgttgttgtgcaggtcagatagtctgatctcagttcagacaatccgatcacataggactatccgatctgatatcggacaatccgaccctgttttgttttagcttccgtatttatttttaaaaaccgcctatttagccccctctaggcgacatcaaggtcctttcaattggtatcagagccaagtctctctattaagggctttaccgcctagagagtaatgatgtcgactagtggtttggtagatatggttctttactccttttggatggttcaaattatgattcttggagtactcgcatacttgacaaatttaggaccatgggtccttaaatagagcgagttgtagatgtgagcatttctcctcctaatgataaagagctatcatttgaagaggaagagaaatgcatgcatatcaatgctcaagctactattgttttatttggtgttttaagtgaagatgtatttaaaaccgtcatgccgtttgaagatgctcatctcatttggaccactgtcacaccctgaaaattcaaaatatataaattgttgtttaattggaatttttagaaatgattttaaaagcctagaagagaagatctaatttttaatcaataaattccaacataaaatggggccagataaaatttcaataaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagccggcccagtccgcagccgcccgcgcgcgcgcgtcctcgctcgctgacaggtggggcccgcctgtcaggtcgtcgtcttcctcgcgtcggccgccgcccgaaaccctagcgccgcgccgccgccgtttccttccaaatccggccgctcctttccttctccggctgaatcaaaagaggggaaatgatcctcgggatctcctctaccttttcccctttggaaacatcggctaaatcggcttggaaagtgtttgattcgaggtcgaatcggatcggcttttctctctccgagcccgatctttccttctcgtcgccggtcgccgtgggccttcgccgtcgcctcctagcccctttaaaaggacccccgagctctcctctacccgccgccaccctcgccttcgcctctcgtcgtccgtagcgccctagcgccgagtagcctcgagccgccatcgccgccgtcgctccagccgtgcgccgccgccgttccggtcatcgccgtcgctcgggaagaccaccgtcgtggtcgccaagtcaccgccgtcctcgtccgcctcttcgtcgccgccggagatcgtcggagcaccgccgtcaccgtcgacccgatctccgccgccgctttgacctcgtcgccgtcgccgtccgttcctcttccgccgtcgctttggtcgccggtgagtttgccgtgccgtccgctacccgttggtgtcctccgttcgtgccgaagcgccgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcatgaaccgtcgncgtgcgcccgggccaccggaaaccctagccggtgatgcaataattccctttttcttttcaaaaata

SEQ ID NO: 10456 - DNA, 57344 bp, Oryza sativa
ttatttatattggttcaactagatattagatataattgcttagccctgcttagaaacattagcacactattgggataacttaagattcactattatttaatgatagcttaatgatagttcacgatggtcaatcgtgattgattaattaattacttgccaactaaaacttgataatggtgggttatgagcacatggttttgagagtcgtgctcatgacaattaaggaccggttcacgagttttggttgtgaaacattaaccgtaccagccacaagccagcgtgggcaacggctttatcatttgtatagcatggttcattgcggagcaccagactgagaagtggcggagataagcccacgggggtcgctggggagtccatgccttgtttataagggggtgattatgatccaggaatggtgcgctgtagtggattgtgttgtacaagggatattgtcacaactcctttccgaggtaccgtggtggtattgaggcacatggtgacaataacaaattgataatagagtacaattattactctaattaataagcgaataaaatatcattatagaggtagatagttcctctcaatcaataaagatctaagcagcggaaaaaaataaaataaacggcgcagacggctccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtctcatttgcataaaccgcatttaacaaatatttgagaatttaataaaacagttaagtaataattaatcaatattaatccaacgctatacaacataccctgttgtataggcccaaccattctgaacaaccatcccggctgcacagttctatctccaaaccaggaatgtaccattccaaaccaggagctaatcaaattatttccaattatagcatcatttactatggtgagaagggtgagactaatcacgaaagacattgttagacccgcccataaccgcgggcacggctattcgaatagttttactctgatcagaggtgtaccactgtaataccaccacgtgcctcaataccaccacggtacctcggaaaggagttgtgacaataccccttgcataacacaatccactgcagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaaaagtgagctaatgtttctaagcagggctaagcaattatatctaatatctagttgaaccaatataaataaagctcagctagtctaattataataacccaaggtatcaaggaataaagtaatcaagaacaaaagggctataacaaagaataggttaattccacccaatgacattcgaaaataaatgcaatagttgaatagaaacagtagctttaaacaggatcaacatgctcaaagggttgtttgggatctgtgtgacttgccttgctggccttggaactcttcaaattcttctccggcgaaaacagactctccggaaacaacagaatctaaacaaaaagaagcaaaatcaccaaaacagcacataaacaagcatgaacagtacatatggatatttttaacatgtagatctcaattttagaaaaatttagagacttgaaccaactaaatccgagctaagatgaattagttatgaatttttgaagattaaatcggattaaaacacttaaattgattttaattgaattatgacgtaataatgaattatttttgaaaaggaaaagagggtttattgcgtcagcggctagggtttcggtggaccgggcgcacggcggcggttcacgcgaacggacggccgagatcgatccatccaaaacggacggccgagatcgatcgggtccacggcggctcacggaagaggacgactatgacgtcggcggtgacgtcaccaccggcggcggcggctcggcggctcgggcgcgcatgctcgccggcgaacggcggcacttcggcacgaacggagagcaccaacgggtagagcgcgacgcggcgaactcaccggtaaccaaaggagcggcggaagaccaacggacggcgacggcgacgacgaagaaacggcggcggtcttcgggtcgacggcggcgatggcgctccggtgatcttcggcgacggcgaaagggcgaacgaggacggcgacgcgacggcgaccacgacggcggtcttcccgagcgacggcgacgtctagaacggcggcggcgcacgactggagcgacggcggcgacggcggcgctagggcacacggcgctatggcgctacggacgacgagaggcgaaggcgaaggtggcggcgggtagagaagagcttgggggtccttttaaaggggctaggaggcgacgaagaaggcccacggcggccggcgacgagaaggaaagatcggggtttgaaggaaagagaccgatccgattcgaactcgaatcaaacacattccaaaccgatttagccgatatttccaaaggagaaaaggtagaggagatcccaaagattgtttcccctcaatcaatttcaccggaaacaaaaaggaacggccggatttggaaaggaacggcggcggcgcgaaactagggtttcgggcggcgcggccggaggttgacgatgaccctgacaggtgggccccacctgtcagcgggcggacgcgcgcgcgcgcggcggcggactgggccggactgggccgaggagagagagaaaggttttgggccgactttcggtccaaagccaaaagaaactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaaattccaattaaacaacaatttatatattttgaattttcagggtgtgacagttattgtgtgcctcggctgattcctggacgagggttcacacacatgtaagcgtttggaattttggatagaaattccgggcgtgacaaccacactcaaggagagatacgacaagtccaaatgtgatgattccaaatgtgatgatgtactctttttggaagaagcacttgaggagtgttcaacttcatcaccaaattgcgactaccttcgatgatcaagataatcatcccacaaccaccttatcatcaacacatgactacattgaaggtaatgaattggtgtgtaaggttgatgatcgtccaattctcccattggattccaacaacaccgataatgaatttgtcatattctattgtgttgttgactcatgcatctcacctagccccaagtatatgtgtgaggatgatatggataaatgctctacttcatatagtacttgtggaactaacctttagaagggagaagtaaatgagcgccagcggacaagtgaagaatccacctcaccaagatgctcatcttctatttccaaagatcatgcttgctttatgggagaagatggtgacttcgagtttgatcacttgagcaagaaggatattacaattgtgataaagctcatggagaccattaagaagcaacaagcatgcctcattaagaagaatgaagatatcatgagtctaaccgaagaacacaagaaacttaaggattttcattcttcattgattatgaggtatgaaaaattggaaaatgaatttgcttgtgccactaattctattgcttgtgtagcatctttggagaagcaaaatcaagagcttaaatctcaacttgacgagatcactaacaagtatgtggatttacaagaaaaacatgatgaacttttgtgttctcatgagaatcttgtggattctcatgccatgctagaggtatctcatgaggtgatagttccaatggtaaaatcctatgagcctcatgttcaagttgatctcacttgtactaaccctagttgctcccaagcaaatatttccccgagcactatatgtgacttggattgtgtaggcaaaagggagaagcaaatagattatggacttgtgtgcattgctcaaccttctcaagataaccatgagggcatggtgaagaagcttgtggaggaatcaaccgtggcttgcaccaagatccatcaaagggatagcaagtccatcaatgcttatatcaagggacgaaatcaaaagatgatcaagagttccattacttgcttcaagtgcaagaaagtgagacatcatgttagagattgcccttggaagaaaggaaataagttaaacaagaagaaggacattcctcacatcaagtgcttcaagtgcaccgaagtgggacactttgcctcaaggtattcttgcacattggatgaacaatgcaaaacatcaagtgagaggcaaaccggcaacaagcaaaccgaaaagcaatatagaagcaaaagtcgactttgctataattgccgggcaaagggacatattggtaaaaattgtcccatgggtaacattcctaagccaagtctctcatttgatcataatttgcttaggaatgccaaaaatgacatttgtgctactagggtgatttgttcgccacacactagcacaaaggccatttgggtgcctaagtctcttgtgactaacctttatggatctaatgttttggggaccaaaatgtgctaaagtgagaaataggtacttggagatgcattggaggtttgactcatttgtggaaaatcaagttcacacaatatgcaaaattggagtcaaatatgaggatagttgttctacatcaagaaccaatgtcatctcggtaacaagtatttacatttaaatatttatgtcctaacattgtgtaggttatacttgtgcataatgcttttcttgaacatttcatagttgatgcaataagttgaatttaagtaattggttatcacgtttagggggaaatctataacctcttgtcatttgcatcctctaaatgtgtttggctcaaatcgatgttgtggtagtctttaaaatgctatttggtcatattgtagtatcgagtgagttttgccactagaaccatgtatcttgatatatattggttcatggaggtatgtcaagctcatacatatgcattccaatccaatatcttctcatttgctatttcttgacttttggaggactgtttttgaaaagtgagcttttatgtatctttttgctcaatcttgtgatttatccctaaatgttaatttttttttcatgtaagagatacattatggtgaacttaagcaaaccacattcatgtatccctttgctctcaaagcataaaagttttcaaaagttgcatctattgtttttttaaaagagcatatttggtcaaaagtcaaaaatcctatgtaaaaggccaaaatttgtggaaatattttcaaaagtgtaacatgtgtttgaaatgttttacaatgcttttggagccaaaatttcttatttccgaaagaatctattgcgatcttgtttttgctaaaagtgagattttaccccaaatcaaaatctattgagtttttgaaaaagtttcctatttaaaacttttagggttagtcaattcaaacatatctttagttcaaagcttttagaaaagaccaaccattcaaatgttgcagccttgcgaagttcatcaaaaatcttgatttaaccatatttggcaaaagcatatggtgacatgaattagtatctttaacccatctaaggctttccaaatgtcaaacttcataaaaatcttatttggatgtgatttgacactttagttgagatttattgacgtgaatggcctacaaaactcttttttacatttctcttgatagaaaaatctttttgagaaattatttttggaaaagtttctattaagtgaaatgatcatttctgcatggtttggcatcattccgatttaatttggaaagaatttgactttttctcactttgctcaaattgctgaaattttcagaaaattcatgatttttggctgatttgtgatttttatatctctcaatgtattgcaaattggaaggagtttacataattacttttgatcctctatggttggacttcacttctaaatttacttggatttttctaaagtcatttggatattgttatgatgccctttccaagctcattttgagttccaaaatctaaaaatcctgaaactttcagttttctaaatctttgtgatttttgtggcttctatttgtttgagaattgggtaaaactcccaaaatgaaagatatgtaatgttctatgacctatctacaagatttattgcagattttattgtggaaccaaaggctttggtaagactgctcgatttgcaatcaagctcatctatcaccatgccatcgagcccggagtctctgggtggataccccggagactccgtgaagattccttggtcacccgaagaatctaggccggaggctccaagctcacaagaacatgcatacttaaaggttatccttccatgcaagaatcacgggtaacccaaatagtttttcatatggtagattgtcatgctttaatccaatatcttccgataatttacatgctcattttataatgtgtgttatattttggcacaagtgttttcttgagaatcctttatgtgcctttctctaaaatataggctacactccccatttgttttcattaaacaagtgcgtttctacaagtaatttaagaacttggatgcacacttttagggggggtatatcctatgttttgtgttttttgagactaacttgttatcaagtgtatttttatgattagtctcataggatattaaaaatatcttcgaagacagtttggaaggtgagaccacaagaactccatgatgatcaaggtggactacttgatcaacctcaaacaactgaagtcaacctaccgcaattaaccatgaagaacatgaagacatgcttccggcacaagtggatgggattgatgcctagggcaactcaagagcaaagttacaccatgcaagcttaagtcccatcggtgtaccatccaagaattcaccacatcgttcaacgagatcatccctacaacatcctcgatgacatacaaaaagggagtaactattcattctcaatttgcaaaatttgtgaatgttactctctattgttgtctttgaactattagaaggaagatggtgcacatgctaaaacgaatcgggtcatggccttacaagaagagcacaagcactatcaggacgcagactgtgatcaaggagttaaacatgttcgtgatgggaaagcttaagttctttctcgggattggaatcaagcaaatcaaggaagagatttcatcaagcccatcaaggtgccaaattcaaattggcttcaagatatcaattttatcgtatgggcatctcaaaaattcacaaggaaggtaactcgatgatccatagcttgttatctaaattggtatgattggatcacttgccttgtctgtgcatctaggacaagtttcattccttgctaattagcctaatttgcaaaatgttgtgacgaaatgcttgtttagtcaataagcaagtattagtcacaaagttgttcttagtgaatcaatgtgctcggagacctcattctatgtgaatttttggtcttagcacaaactattagattcatacatgcgcaactcatttgtgaaaatcttgggtgagattttttttttaacaaaactcttgaatctcacttgaatttgtgaagaagtggtttggcaaattcaaatctcgatgatcctcttcattgtatatcatgttctcttcttaccatgcttaaatgccaaagtaggagagaaggactaaagggaagactttttcttctatgctttaaaacctctgcatgtgagctttctatgcgcaaaatttgtatctcaatgcttattgatttacttgtgatctttatgtgaaattgatcttcattttctaatcacaagtgatgaaatataaaattgagaggtaaatactcgatgatccctcatcaaggatccctttgcttttctttccctacttatgccctttttggtgttagatgtcaaagggggagaaagaaaagattgatcaaaggatgagatatttgagagaaattatcgaaatgcatgctttaaagatgcaaagagtaaatgagaaagggggagagaatatttgaaagtgtttatcaattggtgtgaatgcttattatttgatcaccatgccacatgcaattgagattatcttttgatacttgaaattgtttacaaaacttgattactcatgctttctcaatcggtaacggaatcaattggcatagaatcaagtttttgcaattggcatcaagaatttcatttgatacattttgaatctgccaagaattttagttgtgtgtgttgttttaattttggtatctccttcacacacaatacaccccatggatgcaaagagttagcgggagctctcacaatttcaaaattatgtgcatatgtgttcacttcataaacttgtatgcgcacatttaggggagctcaaactaacctttggattcaaaatcatttattatcaatcttttgtaagctttaatcgtgttgtcatcaatcaccaaaaagggggagattcaaagagcatctatgcccctagtgggttttggtttattgatgacaaacgattaagggactaatgcacttattgagtgtataggcaagtgattagtccgatgaagaagctaggaaatggacttatcgatagatgaaaattaaagagaagatattgaagatgcgggtataaagtgactacctatggcaagacggtgaagcgcaagagccgctcagctgcgatggaccatgcggtggtgaagggcaagcaaggggcttggcgccgacgaaccgaatccggtggtgaagggcgagtgaagactgtgtcgtgatgaaccgtgcgaggccatttgaagctatgaattatccgcatcaatcatttgagaaatgaaagatgaaatgtcaaagatcaagaagatgagatcttcccgatgatcaaatgaccttgtcattggtaatcctccaagtgaagaaagaaattggtgtgaaggtattcctattggtataactttccttttacatttgagtttaggatgccgtactattaagggggataccacatgcatatagttggttgaatactagtgctcaaaatgcttcatctttgtgtgagttgaaaaacctatgccaaaatttaaatcctgagttgtttcacttgtcacaacacttacaccgggtttctttgcaagttttttaacatctcttgaaggttttaggccatgttttatgttgggtttgatagcacacaaaactagctttctatagagtccaagatcttcgaaatcggagttcggagtaaaaagttattgcatttttacttgagcaacatcagattatccgatttgaaatcagactatccgatgtatcagactatccgatttttcacagaacttcactctctatcttgatttgaaaaaatcctatcgagtgagtttttctaagtatcggagtatccgatgccggatcagatagtccgatgacacagagactccaaaatttcatggaacttgagtctctgtttgaggacgaagtttttcttctaaaatatcggatactccgatttaacattagatagtctgatgtctcggaaagtccaaaatttcatggaactccgttctctgtttctcattgccttggaggtttaaaatatcggactatccgatcttgtatcggactatccgacgtgggttgaaagattcccctccaacggtcacattttgggggggatctatataaaccccccaccaacccttttctagggttgcccaaatacatttcattcaaaacttgttttgggttgagctttgttttttgacgagaacagaacagggaaggcccccgctgtttgaataattttattaaagaaaccaagaacaaagttataacatattaatccaacttatgattacaccgtgatatctcgcagtagttctaaacaacaaaaggaagaggtcacccattaagagttgcctccaagtgatgaaagaggggatcttttgcttgaagatgaacccattcctttgtttctagatatgccaagcagcataaaggaatttctccatgaaacaactcccctgataatccaatttgccccttataaacattccttccaaaggaagagtagtatcccaggtaatgcctaaaagactccaacaattttgggcaaacgggcatagaaagaacagatgcattaagtcttcaacagctaccgattgacaaagaacacaagaaagatcacaatccggaggagcacaattcttataatctagcatgaacttggtgttcaatctattcatcatgagtagccacccaaaaacctttacttttgaaactgctttgcacttccataaccatagaaaatggactggaggcttaatagctctgaaattcagtgtatataatttttgtgaagaatatttcatattcccccaaatataagaccaagcatcattttcattaaccaactcgatatccacaagggaagaagtgagctcttgaaactcctgaaaagcttgaacagataaaggtagtgtaaaatttccttcggcctcaatggacggaaaatcagagacagatgcattctggttttgagcaaaagaacaaagctttgacatagtgtgaaaaagaggaggttgatcagcccatacatcataccaaaaggagcatgtatttccacttttcagatgacaccttgcaatacctctaaagacatccattaatttgcaaatgtctctccaccagaatgagcccttcaagtttgtcagatgagggacagagttaccataacaggaggaccaaacaagattgacccagggcaaatccttcttattgtaaaacttttccaaaaacttgatgagcaaagcttgattttggatagaaaggtttagcactcccaggccaccttttctcttaggcttacaaaccttatcccaggctgccaaagattttttattggagttgacctcagaacctctccaaagacaatgtcttcttgctctgtcaatgctatcaatcactgtctttggcaacattagagtacacatgtaataagtaggtagtgaagagaaaactgaattaaccagcgtaaatctatctccattggacaggaaggaatcgtttgatgtaagccttctttcaattctatccactaaaggtgcaaaatctattacctttggcttagtggtaccaaggggtaaacccaaatatgtaaatggcaaagatcccaattgacaaccaaagactgcagctaagttttgagctttcccttcatcaacatttattggaatgagacaagatttattaaaatttaccttcagaccagttcccagctagaaggtttgcaataaagcctttagagtaaagagctctttaccactagcttttaaatagagcaggatgtcatcagcatattggacaatagggaaatttgggtcaaagtctgatggaaaaggctttgatagaagacccattgtataagctctgttgacaatgacctagagaagttcagctcctaatacaaagagtaaaggtgacagaggatcaccttgccttactcccctcttgcaatggaaattttttccaggtacctcattgatcagaactgaagaagaagaagcagaagaaaagatcttccttatccatccaagccatgtagcactaaaacccatggctttcattactagcaaaatagcttcatgttcaatagtgtcaaaagccttctcaaagtccaattttagaagaactatttcccttctggagtgatggcactaatgaaggaattcaaagttccatgctagacagtcttgtatagttctcccttttatgaaaccatattgattctgactgattaactccaatatcaccttttgcagtctatcagccaggatttttgttagaatcttaagagagattcccatgagtgatattggcctatagtcatttataccttcgggcacagatttctttggaaccaagatgataaaagaatggtttaaaggatccaggtccagagtactagagtagaatttagctgcaagtctgtagtaatcctgacaaatgattggccaacatttcttcacaaacatcccattaaatccatcaggcccaggagccctgtctataggcaaattctttataattttgtccaacttagagataccaaagggctgatccaaactagcaagagattgatttgcatggaaaaaatcttgcagctgaaaaggcataaactcaaactgggaacaacccattcttgaagaaaaagtactccaagctatgtgagccttctcctcatgtcttgtacagactaaactagaagagtctactaaagaaggtattgcatttcttctataagactcagtagccatagcatggaaaaattttgtgttctcacccccaaacttggctcatctgatggtacacatcttttgccaataaatttgtttatactttaggtataacaacagcttgtttctgataggaattctaaaattccattcaagaaagtgagatctctcaaattttcaatggagtccaaaaaagctatgacagcattacaatttttaatcaacaattgaagtttagagacagatttactccacttcttcaaaccctttctcaatgtcttcaatttaatagaaatattcttggctgcattaccttcatacccatgattttgccaaatggaactaaatcaaagaaaccatcatgctctatccaaaaagtttcaaatctgaagatgtcagctttagggatgtcaattccaatttgcacaacacaaggtatgtgatctgaagtagaacgagcaagtggttttactatggtatgggggaaggttaaggtctaagtagtagaggtaaagaaccaatccaattgctctattaaatgactatgctgcatgttactccaagtgaaagcccttcccttgaggggcagctcaaccagacccagatcactgatcattgcattaaacaggaaaatgtcattcatgtctgcacctggtctatttctatttgcaaccgatctataaaaattaaagtctccaataatgagccaaaggtcatcatctggaatgttcaactggtggagccaggacaggaaattatttctttcaggaccagtgcaaggaccataaactgaaactatagtacataccaaaccagaatggtttgaggtgaaagtaacaaaaattgaactattccatccaacgaaaataccaccagaagctccaacagatggagagaaagcaaacttgtcaaaacgtttgggagcaaacttctttatataagaatgatcaaaagaggatctttttgttcctgaaggcaaaaaacaacacagccactttcctcaattttatttctaatggctaaccatttgtcatcagaatttagacctctaacattccagcggaggacattccaatttctcataaccgaattcatttgataactagtcttaaagagagaaagataacaagcaggaataatccatgcagatcccaagcacaccaacgcatagtaccagcatagagtttacataacttaaacacaaaataaaagggctgatatagggataaacacatgcccctaaagagtgccactagcagccctaaaagtttgacagaactaggcttcatcagtggatggtccaatagcttttggcttgatgacctgaacatctcccaagtccaccaagcttgaaacccggaagtctcacacatctcagatcctatcttttgaagcaaagatatatcacaatcagcaggtataacagaggtaagatcactttcagattcacaagatatatcaggatttaaatcagtagaagatagagaatcagatgggaaaacaattccacttgcctcagccaactgcttcagctttttaactgccttccctcttggctttccaacacccatatttggatcctcttgcagagtattcttaaaaccccccatatttgagctttgtgttaagtgctttggatctttaagctctctccctctctatctcaaatcctccttgttctttgtgacttggatctttgtgtgtggatttggagtttgggagcctagtgtgtgtttctcttgatcttgagcattaggatttgtccaagagttctgtggtgcttattactcttagaggttgaggactcctagacggctaggtgttattcttgggccaccgatctacgtgtggttggccaaaagaagtttatgaaggccggatctcgcctccacaaggaaagagatacccttagtggaaggaggagtgcatttgtgcaacctcatgaggatagggttgaaaaaggcccggctctttgcgagcccctcaacggagactagaatcccctcaaggatttgaactccgggaaatacatcggcgtgtaaacctcggtgatatcttcactctctttaccttcttgttccattgctttgtgctatgctaatattgttgttggctgagctcacctctttgcctgtgtataatctagaactcttaggttgttctcttgtttgtatagttgttgtgtaggtcagatagtctgatctcagttcagacaatccgatcacataggactatccgacctgatatcatatcagacaatccgaccctgttttgttttagcttccgtattcatttttaaaaaccgccaattcacccccctctaggcgacatcaaggtcctttcagtaacatattttaaaaacataattggatttaaccaaataattttagttttgtgacatttactataaatacaatcattctataatgtatatacaactattatctttttctattaattaatgtaacaatttcaatgtggtcaaagcaaatatcgtgtcatttttaagctatctttatagtttaatagatagattattttcacccgttgcaacgcacgggcatttttctagtaattatatactttcatatttgtattaaatttttaaatgaaactcaacggagggagtatataagacagaaaaggtagtgccttggtcacgcttatgtttaagcccgctacgtccgtgttcggtagtttgctcgtgagttttttcataagtgtgcgtctattaggaaaacttgattttagattttttctttctgatttagtttttgctactcatcttcctcctgtgctgggacatgtaacaagaagtaactgcaatcattccatgatctacacatctatgccatgcacgaaaagattattcacatcgcttgtgatttcaattaaggatgcattccattcttcaatatgactgttctactgtgctatgacaaatttacaaatgattttattttagtgacgaatgttgcgatcagacattggagtacaatgcatgttcttttccacaaattttacatgacgaagtttgtcaagactttctgaaccaagtgttctccgtacacaaccttttcatacttggcaacaccacctgttctctcccggcagaactcaacaggctctacggcagcatcgaagtttgactgtagcattcaaaattcagaaagaaaagaaagaacatgagaaatcaacttcacataaactatgtgtaggattgagactagagattaagcaagacatacctcatagaagaatgcaacagatacacggtagcgaggggagttgttaacaactcgatgaagtgttggctgatatattccgtttgaccaaacctaaccaaagaagacaattgataagcgtctcatgtttgatgaccataaagatatcagtgaaactgcaaaggaagaaaagaaccttcagcatgtcaccgatgttgcagacgaaggttcctgggattggtttggcatatatccattcacctgattggtttctgacctgaaacatattcaccagatattacaaacggatcaaaattgtttgcttcaccctgtttcaggctaaatatggacagtgggaagaaactgtaagatgctaattgcatactcctaattactaatgcatcttagaagatgcgtagaatgttagaaaagtagagaagtatctcttgttaggttatatgagtcaaattctgtacaaagatgcccagctcagatgcactgcactctaatgaaaaataaaacaatctgaaatcaagttcttatcttctatccattctacgtcccctcttctttattactagacagagataacatggaaataactttggcgataagaaattgcaaggagaaaaggccaccaagcaaacaaacagtgtggccataaaatatctcaattaaaacaatctctgaatagggtaaccaatgatatttgtccagatttctggtgataaacaaccagttttttaaatccacattgaaaattggaatctgagtagagttcgagggcaaagacatgacttattcctataagatatgtattagatggtgaagaaataagtacctcaagggcgcatatgtcatcatcctgattaaccaatgtcagaagacctacaaatttaacaaatgataaatatgatccccatggttttgatataacctctactgattttttaggattaaaacacaaataaagaaaaaacaaactttccacaatacatcaatcaaagaaacatatatgcgtatttccacatatgagttcaattccaacagaacttttgaaagatatgtactaaccatagtctgtgtgagctccactgaattgatcgtagaatggatgccatgtaaaagaaaagcagtgtcagatgactctacactcaatacacacgatttgcaggatatattaccaaataaaaacgtagatacaatttgctcaccacccagtatcagtgcgctgctcttctggaatatcagttgatacaggataaccgatcagcctgcaaacccaaaaaggatctcctgcggttgtaccttcaaaagcatcaactggcgcacccaacgccaaggctatacctcgcatgatctttcttgaaagatctacaagtaaattttcataacaaatgctgtcactcataagtaacaaataataaatggatcaatagcatacatgcacaaataaagatttaaactaagtatagaagttaacctcttagaaggctgatatagttttccagcagtacatcaaaatttgatggatatttgggcctgcataaaaataaatgaaccggttatttgaattttgatagatctctgacctaaaatactcaaaggcagtctaccaaagttcagaacttcttcagtaatagctgaagtaattcaacaagcaataattctgtggtacctagtaccaactatttaatatgcttctagtaacaaaaatacattgaagtatgcaagtacaattgtagccataacttctattttctttactataattcataattctacccatattgtaacataatacatgttggtactagataaaatattgtaaatataaattttattccctcacattcttccaaatagaggtgtgctataagctaaattatttatattgtgagtattattaaaatatgcaatagatcaaaactggggtattgttttatatcaaagtcaagtacataatatctgtctcgcatatgtcaaataatacagtgctgtaggaaaaaaacagagatggagagttggatacataccacaaattagatcctaccattggtttagcaaggtctccatatttaccaggttcaataggcgtgtagcactgtgatgttttttcttccagggattaactcaggaacaaattaatggatgataaaaaaataataaagagaaaattaaacttacatcaattgcttcatgcatgtcaggtttacccttggtaatattttcaccaactctttggtaccctctgacagtaaagacaacaaagttatgttatacaggaaggaggattagaaggatccaatgtggaacaaggaaaaatgttggaaacttaaaaacaggttgaagctgtcattttatatcacacctgtatccactctgaggtgtcattttaatcttgagtttttcctcataaggaagctgaaagaacttctgtgtcacatccctaacttgcttcattagcgagtcagcaatcccatggcctttctgttagtaacatacagacaccatttgattaggattgatattgtgtagctagtctgctgtacccattgtagtaaactgatgctaaaaagtctgaagtaggctagtaagtaaataagtaaattttaccacataaaagaatccagcctccctgcaggcatcgtccaacatttgcacaacttgcagcaaatcctcgtcattgaccatgctcggatcatcaatctttccgacaaggggactaatgtctgacaaatgaacaaagatagaggaattcttcaaatggagatttcaaagtacaagcatatatcatctcatcccaccaagtatctttacacaaaattctacaaaagctgtatctagtatcctttgcagacaagcagtcgtaatctgtggttaattgaactaactgcaactggtggtggcaaagcaggtaaaagaaaaaaaagaatcccacgcaggattccagaatctgaatctgaatcttaccgatcaaggggattgccttgaagtcagaacccatggtgatgcagggagagaagccgcctgtggggacacgaacgcggcggcggtcgggcgatggcgattccggcggcgggcgggcgggcgaagagtggcgtgatagtgcggttgggttgggttgggttgggttggggattttggattgctgcgatagcggggtgactttcgacgtcatgtgcggcgttttatagaaccaaagtgtaagaaaaaaatgggaaagtatgtagtggaaacctatacgattggattgcccgaaaaaaatgatgcgatatgcggtgcgctctgacccccgacccgagtaagaataggattggattgccatggtcaatttggagacgaccaagcaaagcaaaaccacttttcatgtactctgtctgccgtaccataccatacggcgagaaatccgagattttgccattgccatcgccacaatgccactatgtttacgtcaaaaaagaaaacaatgacatctcacacaaaaatacccttggttcttcttcccttccggctgctcgccggcaacgaagccatggcgtgggatggagggagcaagtgtcacaccccgaagttcttctcccaagtctaaattaattaataaatagtctcgagaaattatttgtgaagtggcaagagagaaaccttaatttaataaatgcaaataataatcggaaatgacatgtgaaatttttcttgagttctacgtgtcaaaatacgctaacaggatttttagtggaattttcagagctttagaaataattttaaccaaataaaaatgagcacgagcaattatttaatccctgaaaattcatttctcctttttctttttctttttctttttcccctcctttttcctaatgggccgctggcccattctctttccccctccccctaccagttgggccggccgaagtccaaggcccatcagccggccgcccgagcccctcctcccctcgggtcaccgacaggtgggcccgtccccaacctctggctggcgccgcccgtgcccgaaatcgctgctcctgcctctcccgcacctcccgggccacgccgccggcgtcgccgtcttccccgcgccccgctccctctctccacctccccactactccggtgaaatcagcccactcccagcctccccgagccccctcttcccctatttaagcaccaccgcccctccctctctctttttccccatttcgccgagctcccccgtgccctccttcgccctagcacagtcgccctcctctccgccgccgccgccgtagcttcggtcgccactagccgctgcgctgagccgcgccatcgccgccatcggattcgcgagcccgagggccacgccgtcagcccctccaccgctggagccccgttcgcaccgcacgccggtgagcttcgccatggccgccgccttcggccggcgtccccgtcctctatgatctctctctccctctctaatctttcccattgtgttccttaggtgatcccgaagctcggccactcatcgccatcatcatcccgccgctcaccatcattgatcgtcaccggtgaggaactcctcaccttcctctctctctctctcccgcgccacttagccgccgcgccgctgcctagccgctcattttccgccgctagcgttgcccgcactgccgtgtcgccgccgctctccgccgccggtcgccgccttgtgccgccgctgcgtcaaaccgcgccgccgcgcgccatggccgccgagccggcttgagccgggcccgtgccaccctctctctctccagggtttaattattgcgcaataaatcaattaaggattttttttgtttatagtaaaaacgcagtgaatcttctaaaattcatagaaaattcatccgagctccgtttaagcccattcaagtctcagtaaatcaagaaaaatgcaaagaatccattaaaaatggttttgttctctgtttcagtagtcttatagcctgtttgtattattttatcacgcccagaaattcacgaaccagaatttctaagctgaatgtgcattaaatccctgtccaggaccagccagggtacacaaacgacaactgttgacatacaaatccacgtcttacaaaaatagaaaagattacaaatgcagcggaaaagataaaagcgagctaaaccgagaagcttgacttcagtagcggggtgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagaggtggtatgatgcaggatataaccaaagcaggctaggggttcttttgcataaagctagcatttaaaagcagtagttgaaagcagtaaaacagctgtagtaattaatcaatattaaccaatcactgtccaacgctacaccacgttgcaacaggcccaaccaaccacctgaactacaccagttcattaagctaaactagggtgagactaatcacggtgaatctggttgatcgcccataactgtgggcacggctattcgaatagttttactctggccagaggtgtacaactgtacccagaagacacgattccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagttggacaaccggacaccccggccgacccaactccatcacgcccaccctcgccactggtgcctaggaaagggtcgagctatacttcagatcaagcagttacccactcctgcttgtggtaagcacggtaagtctcccagggtttcccgtgaaccggtccttaattgccatgggtgcgaccagcaaaaccatgcacccacaacccaccattcggtgtattttaattaactaacaccattgcggtggcaccaaaccaaaactatgctcatagtcagagtctatgtaataatgtgatccccttttgtgtactagttgaactaagcatggctaagcatttcctaaaccaacatctaatcattttgataccccagttatcaatggcatatggtaaacaatatatggctgagtaataggacccatcccacataacattgaaaaagaatgcaacatttaatagaaatgcgggatatttgtaaatagggtacaatatgatcaaatataatgcatgacatgccttgctctcgcactaatgagacctcagcaacgtcttcgagaaactgcggatcgacgaaacggccgaaatctacacgacaaacaaagcacacaagcaaaacatactataagactactgaaacagggaacaaaaccatttttaatggattctttgcatttttatgaatttactgagacttgaatggacttaaacggagctcggatgaattacttatgaattttagaaggtaaactatgtttttactaacaaagaaaaaatccttaattaatttattgcgcaataatacccagagctgacgtcatcaaagggggggggcggcgccgacatgcgggccccgcttgtcagcggcacaaggggagagggagggggcgccggctggtggctcaaggggaggggtggtccaccagtctgtgaggcccaccgggcagcggcacaaggcgggagggggagtggatggtggctcggcacggctcaagccgaccgaccatggcagggcggcggcggcggcacacggcctccgaagacgaccggcggacggcgaggcggcggcggccggcgcgaaggcgacggcgcacggccggaacggcggcgtggctcggcgcttgctggaagggaaaggaaaggagggggagggaaggggtcctcaccggcgatgcgagggaatcgggttccggcggcggcggatggcaaccgagtggtgaccgaggtgcgggcgacactggcgagcgcgacggcaacggtttcacggcgcggcggcggctttagcggtggtggcgcgcggccggaggcggtagtaggcagcggcgtgtagggagagcggtacggcggtggcgaacggaaagcgagcggcggccgaggtagctctcacggcggcgaagctagcggcagtgattgcgcggcgaggcgacggctcttgcgacggcggcgtgcggccggaggcggcggcaagcggcggcgctagcggcgagcggcgcgggctcggtaggaggcacgggagggggcggcgagagcgggaaggggaagaggaggctcgggggagcaatttataggtggagggggaagccgtcgtggccgggaaagcctccgatttcgccggcgacgtggggtggagagagagaatggggggattcaaattcgaatcccgccccttgcgagcgcgcgtgcgggccgggagacgcgggaaagagggcggcgatgtggggaggacgcgggagcggcgcggtgtgggcgcggaaggagcggagaaggtgggctcggtggtttcgacggctggaggaaggggacgaccccgacaggtggggcccacctgtcggcgtcccggagaaagagggcgtgagggaggacttcggggaggggaagggaggagcgggccggcccagcaaggggcacgcgggaggagaaaggtgggtcgacggcccaagaagaggaaaaaggaggaaaaagaaaaagaaaaagaagaaaggatttttcctgggatttaaaattgcccttgctcatttttaattggttaaaattatttccaaggctctgaaaattccactaaaaatcctgttaatgtattggagcatggggaacccaagaaaaattccacaatgccatttccaattattaattgcattcattagataggaaatcagctctaggttaattaagataatttcttcgggcaatttatttaaccaatttttaaagcaagaaaaaggggggaaagcttcagggcgtgacatgtttgctttgtatgtcgcatagattcctgctctcccgacgctccggtgtacttcgagatagtcgccgaggtccctccagccgcagagcaaggcaagtcatgcttgtcacttaaacatattggtcccatattgcaaatgctctattattttccttaaatactgcattgttttataatgttactatgggataattacctattgtctcagccatactattggttatcttgttcctttgttagcttggggatataacaagattagatgttcggttagggattgcttagcaatgcttagctcaactagcacacaatgggagaactacattaatgcatagatttcaaattctaatattggtgttggactagagccaccgctctagtgttggttaactaaaatatactaaatggtgggctgtgggtgcatggttttgagtcgcacccatggcaattaaggaccagttcgcgggatgtccttgaagaacttactgtacttaccacaagctagcgtgggcaacggctgggcatgtagtatggctttcctctagctgacgcatccaggcaagggtgagcgtgatggagttcggatgggccctgcgatggcctatgtggctttcggattcacctaggcatgagaggggactgcccgctgtcttgcgaggagtgggggtgaaacctgaggtgtggtgtgtttggttagagggggtaatgcgaagggtcctgtcacggtctctttctggtatgtcgtggtggcatgccggcgcacagaaacgtgttgtggggctgtgtcttgtgggtacagttgtacatctctgatcagagtaaaactattcgaatagccgtgcccgcggttatgggcggtcaatcagattcaccgtgattagtctcacccctagttagctaatggaactggttagtttaggtggtggtttgggcctgtctcaacgtggtgtagcgttgagcagtgattggttaatattaattaattactacaactgttttactgctttcaactactgcttttaaatgcatgttttatgcaaaagaacctttagcctcctttggatatatcttgcatcatacctccccttctggtatgacttgctaattgcagtgggtagtactcagtcttgctctctgttccccacatcagagttgaagttcttctcagttggagctgtttcgaggaagttggtttcgtcgctgccatcaagggtgcctgtggaatggagtcgcccgctgcaggagtcaagtcgtcaggcttagctcgcttttatcttttccgctgcatttgtaatcttttatattttttttgtaagtcgtggatatatatgtcaacaattatcgtttgtgtaccctggctggtcctggatagaggtttaatgcacattcagcttagaaattctggttcgtgaatttctgggcgtgacagcaagtagcatcaccatcgcactgtgacccctactcgccagtccctcgctccttgcgcgactcccggtgctcgcactccgcctccatcaggccacaaggcgctctcaattgttcccttttttttaatgaaccagcacaagacagtgccaatttaattgaatagagcaggagaaaaacggggcttttaactatttgccactcttacggatgttgcttaacgatttgccactagacccacatgtcatagacacataagggcccacatgtcattgacaggatgtggcaaatcgttaattgccatgtcacaagagtggtaaatagttaaatttcccgagaaaaactaatagaacgacaacatcagctaacaacgtgtccgcaatctacggaaggtgactaggaggcgatcttggaagctcatctctaatctgaagcgctgacaagtcctagccaagatcaacgtggtttctcgtttgatctttggttgtgattcgtaggtgttaagttctcttaatctgttttggattgcaactactgctacgtatcttgacgggagcgactcgggttgttttaatctgctactgccaagattgattcttggaagattctggttgacgacaaatttctgtgcaagtgacgtggtaaccctaactctacgtattgttgcttctttgtttcttgtaacctgttctgcgttggtgtcgccgtctaacatcggtgtgggcgatcaaggggattccggtgaggattctacccgcccgaagccgtttgttagtgggacgtctagggtaggacgatgtttactcaggaacatctgtgtttcttgatcatcgtcgacaggcaggacgtgggcttccatgtcaaaccatgaagacgccggcaagggcgaagtgcatatggtggacaaggatcaagtggagaaggaggatgcttgacttgtttctttcggtcatgcatctaaaccggaagataatcataacggtgcgatagttttgtgtcacagcctaattttccatttcagaatttataaattatttaataaattattaatagaatttatattaaatgtttattaatttacaagtgaagttaaatgtgggaaataaaatttcctaaatataaagcatggctggatttaatttttattaaattctccatgaataattatattctctgaaattttctcatatttttcggagctcaattcctaattttaattatacaaagaacatttcagtaattatttaaataataaattaatcattaaattatctggatattattatattaaatactttgagtgtccaagtatgttcaagagttttcttggaattatttgagcattggaagtatttttaacaattgaaagatcatttcattggttaatttatttggaaaagcaataaaatcatccttcctagtcttgggccgaattcagcccattccctcccttcctctcagcccggccgaaagtttgttttgcccccccccctcgctacagtactccatcttcctcctccagccgactgtctcccgtgccgtgcacagtgtcgccgatccccttccaaaatccggccacctcgttgctcctttttccaaattagttgcgggaatggaatcctctcaatctcctctttcttttccccaaaaaatccccaaaagtttctatggagatcctttccaatttcgcggttcaatctttcctttttccggcgagaaccctagactttcccgagtttttcccgtcgttgtgggctcgatcccggcctcccatggctatatatagagccccctccctctcctctttcggccgccacctcctccttcttctgccgccgcccgaaaccttctccccgcgctctccttctctctccaagcgccggcgccgctccagccgcatatcgccatcgccccggccgtcgccgatcagcgccgccacctccatcggctccgcaacgtcgagctctaccccggccgctgttgttttgcgccaaatccaatcggaggtagcccgtcgtcgtgaaccggagcgccgccgtcgccgccgtgtctccagccgccccgcgccgtcgctgtggtcgccgctgctgctcgccgttgcctccgtcaggttcgcaagaaggagctgcaccccgtccgccccttcgtcgccaccaaaatccaccggagctccatcgtcgccgtcaacccgaagttcgccgtcgcgttttgatctccggcgaagccctgctgctcctcccgtcatcgccaagcttcgccgtcgcctccattggattcgcagctgcgaagtgaagcctgtccacccctcggttgtcgtctctcatcgccggaaagtcgtcaccgccgtgtacagtacctcgccgcccttccaagctggtcaccggctatcttctgtcgccgtccgtcgtcgcgtaagtgttggtaaggaccgtcgcctcgcgctctttctcctggtgccctccgtttgcatatttgtgccgtggttcaccggcaaccgccgctcccataccgttcaccggtgtaggtttttccctagggccttaatttaatctaatcttgtttggccctagcgtcgtcgtcgtctccgtgtgttgtcgctggcgtcgccgttgcctcttcctcttcggtcttccccggtgaggcctcttttctgttccctaggtttaatctttgtgtagctgcaatcgtgtcttcgtgtagtcgctgttgtgcagccttagcccgtgcgtagccgtgtgtgcctagccaccgcagccgacccatgcgccgtcgctgccctagttgcatcgccgctgctgtccaagccgccgccttgcgccgccgcttgctgccatcgtgccgctgcttgctgcgctggctctgccaagctgctgctataccgcgtgccgtgtcgctgctgcatgctgccacgtcggccgtgtcgcttgctgttgccgctgctgctgcgtcgcctttgctgcgtcaccgctgctgcgcctgcacgccgtgcagcgttgccgtcgctttgccgcagccgcttgctaccaccgcgtcgccgccctagcgtcgagcccgtcattgccgtgcaccgcacccgctgttgtccgctgctagccaccgcgtagccactgccttagtgcacgtactgcagtcgccgcgccgctgtcgtgcatcgctatcggctgtgccgtcaccctaaccctagctttgcgtttccgccgagccgccgcctagccgagccaagtcaccttagtgccgctatgtcgcagctgtgtgtcacttaaacctagccaccgctttagctcgttgctcagtagtcgagttgtctagccgtaggtgcaaccctaggttcctaccagcctatcgtttgccgtacctgggctttaccgtgaatcgtgtttaccccaccagtttagccacagccgttgttgagtcgttcgctcgttcgttcgaacgaggtgttccccgtgcttcgttcgtttgtccgtgttgagtcgtcctttaatttagagccgttcagagccgccgattccgttcgccggtttcggttgatcattagagtgatcccgtgtcacgtagaattgactcgttgagttggtatctcgtgaggcccgcttgccagatcaatccaagccatccaatcttggtcaactctatgtcaagattaatcttagccatccaaaatcaatataaatcatttcctctcttttcagtggcatattatttctttttaatatatgtcatctaccaaatataatctaatcttttccggaggttgttttaatcttttatctcagttataaatcatttgtaaattatttaattaatttggaatagtcttttctttaatagatttaattggaatttaatcttgtaaaatttgtaattaattcatatgaaatcggaatgaggtcgttcaagtctctaaattcatctaaaatcatgatctacatgtttgtttactttatatgtactatttatttggagtttcttagtcttttttctcgttttgcgtgttagcttgtcgtttccgtcgtttcgaaggttcgtgagtgcgttggaagtattcaagaagattaattgaagaccctttattgcaaggcaagtcacacagatcccaaacacagttcctttgagcatgttgatcctatatttaaattctctatttatttcaactgtgtatttattttcgaatgtcaccgggtggtgtgaacttattcctttgttatggcctgtttgcattgattactctatattccttgataccttgggttattataatttgattagttgagctttatatattggttcagctagatgttagacatcattgcttagccatgcttagaaacattagcacataattgggataactaatgtttcactattacttaatgatggatatttaatgatagctcacgatggtcaatcgtgattggttaattaattaatgtgcttactaaaacttgataatggtgggttgtgagcacatggttttgatggtcgtgctcatgacaattaaggaccggttcacgagtttcggttgtgaaacattaaccgtgccaaccacaagccagcatgggcaacgactttaccttttgtataagaaggctcattgcggaacaccagactgagaagtggtggagataagcccacgggggtcgctggggagtccatgccttgtttataagggggtgattatgatccaagaacggtgcactgctttaggttgagttatgcgaggggtcttgtcacaatcactcatcatggtgacgtgtctgcgcggacacggtgccatgacggtgggttgtgtcttgtgggtacagtggtacacctctggccagagtaaaactattcgaatagccatgcccgcggttatgggcaggtcgaacaatgtctttcgtgattagtcccacactattcattaataataatgtggtaattgatgctaattaatttagctcctggtttggaatggtatattcctggtttggagatagatctgtgcagccgggtatggttgttcaggatggttgggcctgtgtagcatgggtgtgctgttcagtgttgattaatattgatgattaattactctactgttttacaattcttactgtttgctaaatgcttcttttgcaaatgagccctatattatgccattctttggtatccttgtgcacttgtatatttgctgtgtggcttgctgagtatgtcatatgctcaccttgcaataatcaatcaaacctcagttgaagacaagttgcgaaggagaagacgtttggcttataccccagttgagctgcctatgggagtggagccggagcttcgctagaccgtaattccgctgcagttttcttttcttttgtaagtatgtaacgttattatattgatgaatttgtatattaaattgtcagtttgtgtacctcggctgattcctggacgaggatttaatgcacaaattagttcggaaattactagtgaatttccgggcgtgacattttgttcgaggagaaccatgatgaggatatcgttgaggaagaagataatgttttttatgtggatctggcaaagttgaggaggagatgaaatgtaaattcctggctcttgcaagattttattcagcgcagcgttataatgtcaagggtctgtttgatgagatgagcacagcttggggtttgcaaaaccttagaactgcaagggatctaggtgaaaatagattcctaattgattttgatcatgaggttgatttttatcgtgtcatgaatggaggcccctggaaacacaagggtgatgctctcattattgtctcttatgatggcctatgtcgcccttctgaagttgtcattgaatctttagcgatttaggtccgaatttatgatcttctagaggcaatgatgataacgggttttgctcaccatctgggtgaaaagctaggtaaagttttggaggtgggtggtgctgtgagagattacctacgggtaagagtggactatccattagctgaggctctcaaagtttagctcaaagcacgtgggaagggaagaggattaatgatattccctttaaagtatgagaatgttccgtttttctgcttttcttgtggccgttttggacatgtggagagagaatgcctggaggattaatccaacctgaatagggtgcgttttgggaaagaactcagagcttcaccaactaaatggtctgcgcttcgactgctttcaattcctgcagctccccaaaaggttgctagagttttaaacttctgtggtgctcagaaagacaaggttttatcggctgggagcgcctctaaccttgcaagcccaagacgacaatctttagacccagaagttactaaagttgggcatgcaaatgaagagaagatggcccaggaaactcttgcaccaatggtttctttggcccttgaaaaaggggcgcagcatatgcaggtagacggggtgccttctaatctgaacttgtaggccagaggaccttgtagtagagaatatgtgtctttaagctctaattatgagcttagtgaagaaaactcaatcaagatcagtactgctgagactaatctcaatgtagccagcaaaaagtctccagattggcttcagaagaagaagaaaggattagccattaaagaaggagggaagatatcaaggccaaaggtggccaattgggggcgtgatattgggaaatcaaagaagggctccatcaaactttcaccaagagccatgatagcgctcaagtctaccgttgtggattttaatcatcaacaggaacacccaagtttgaacacctcctactatgaggctagttgccgtgataaggtagagaattcttgcaaggcgaaggaagatctggtgggagctcatggcgagccccaccaggagcaatgaatgctttggcttggaattgccggggacttgggcagcctcaaacagttcacgaacttatctgccttatgcagaagtataggcctaagcttgtgttcttatctgaaactagacaagatgaaccaaggattagtaagttgaggtggagactaggtttaaggaactgtttggctatgatgagtgatgggtcaggaggtggtattgctcttctctgggaagaaggcttgctggtagatctcctgtccatgagccacgcacatgttgatgtcttaatcaaggaatcaggagatgcagttcagtggaggggaaccttcatctatggtgaaccaaaagcacaagaccgacatttaatgtgggaactgattctgcaaatccaaccatcctcgaatgcaccatggttgatgatgggtgatttcaatgagataatgtagtcttttgaacatttttctttaagaagaaggtcggaaaagatgatggcaaatttttgggaagtgctagctcattgtgacttgcatgatgttggtttttccggcacaccatggacttataataacaagcaaaaaggtgatcaaaatgtatgagtacggctagatcgtgcagtagcgtcgctcagttggatgaaccatttctcggatgcaaaattgacacatttgttctccccaagatcaaatcattgcccgatcctccttagggtagagaaagagcaaactccttcaagcaatcgttgtttgaggtacgagatcatgtgggaaagggaggaaactctgcctgaggtgatacaacttgcatgggagcagagaatcaaagcgcatgatctgggagaggttgcaaaaaagcttaactcagttttggaacacttagagaatggagccgcaaatcgtttggctctgccactaaggaactggatggaattaggaagaaagtggaaggactttcagtcggtgatccattgggcaatgcagaggaaatcaatggtctattcagacatatggatgaactactgtacatggaggaaatgatgtggttgcagcgatcacgagtttcctggttaaaggatggggatcgcaataccaaatatttccaccggcaagcagcttggcgtccgaggaagaacaagatcaagaaattaaaagattgggatgatagatatgtggagaataagggggaaatggaaaagatggctacctctttttgccaaaagttacataccaaagatgattcagtggtatcggatgaactaattgatctcataaatccagcagtagatgacgccatgaatgaggtcctctgcaaagagttttcagatgacgaaatttcagatgtgctttttcagattggaccgttgaaggcacctggaccagatgggttcctggcccggttttttcagcgaacttggggtgtgctgaaggaggagattgctgctggtgttaggacgtttttctcatatggacttctgcctggaggggtgaataatacatacattgttctgattccaaagataaatcagccggttgagttgaaaaatttcagtccaatcagtttatgtagtgtcatttataaagtggtatctaagtgtctggtcaataggcttcgacccattctaaatgatatcatttccccaactgaaagtgctttcattcgagacgtatgattacagataatgcactaattgcttttgagtgtattcactctatgcaaagagcttcagggaatggtagtcagttttgtgcctataaactggatctagcaaaagcatatgacatagttgattgggactttctgaagctacgccctgatgaaacttggtttttgcgagcagcgggtgaattggattatggaatgtgtaacaacggtgaaatactaggtttgttttaatggttccttactggattctctctccttcacaggtactaaggtaaggggatcccttgttcccttatctgttcttatttgtggcggatggcccttctcgtattttatgtcaggtggtagaggagggacaactaaatgagttgaaagtctgtcgtcgtgcgctgggagtgtcacacttgttgtttgctgatgatagtttgctgttctttaaagcttatttgcagtaatcggtgactatttgttagtatatcgttaagtatcagagatgcacttgatagttgttgagcccaacaaaattgaaagtgcatctaggcccctaatgattttgatgattgattacaatgcgattagagaggtctaacttttttattcaagcaaatgtgaaggtcgttatgtcctcgacgtcttgtaatgtgatgtataccccattgaatgcgatgccacgatgcaatacagcaatgatcaaatgatatattgtatcttttaccttgcattgagtcataggaaagccgtactattaagggggatgatgcatagacatataaggggtgatgcatgtgctcaaaatctatttttcttcgaagcatttctctcttgggttttggaaatttttggaagttccgaaagctatttttggaatttccgaaaatacacagaactaattttaagcttctggaaattttcagaagttctttcagaagttccgaaaatacacagaaccgattttaagcttctggaaatttttggaagttatttcggaagtatttttggaagttccaaaaatacacataaccgattttaagcttctggaaattttcggaagttctttcataagttccgaaaatgtctgcgaaccaaatatgcttctagaaattttcagatgtactttcggatgtattttcagaagttccgaaaagtgcgttgacttcgaatttttcagatctggaattttttgaaagtttcgataatcagaattattgcgctccaatgggcagatttggagctgtgggtataaatagcccactcccctcacttgtgagggctgctgctctcattgcaaacatgtgtgcccttggcttgctcctctctctagtcatttgagccattactttctcgatttctctttcaacccgggtttgattcggatttggtgttcaagtgcaaccccccttcctcctcatgggtatgatccatgtgctttctttcatccacaatatgcctactttggaacgcaacccaatgaatacttcaatccggtacttaaggctattaataccctaagtgaaagcatccaacgcttgtctaccgggcatgaagcttttcatgaggatgttcgtggcttgcgtaccgatgttggcaacttgaatacttcagtgggaaggttgcaaactagggtgggtgcattgcattctcgagtccaaatgttggagagcacccatgcttttgtatatcactgccaccgtgatgctcctcatccttcctcttcggtgcatcctccttctcctcctcaagaatgaagacatttttggtacttgatgccaaaagggggagaaaaatgtccttaggtgtgctttatgtcttgtgggttaggactagtggtagtgaggttagtcacctcatatctaataggttaaggtgtgttgggctatattttgtatgggtatgggctattactctatattgtgtgttctttatcgttttgttaaactctatgtcatttggacccttcatggtcttgtaatagcctatgtttatttgtgagcccttttaggatgatgtgtgacttatgtgagttgaatggttaagtgatgtgaacttgtgcgatgatggatggtgtatgtgatattgatatatatgtgaccatcttatgctcatggatgaatatttcttgaagttcacattgagatattgctcttgtctttgtgatatgttgaaatgtgaaattgaaattggctccatatttgctattgttgttatgcatatgtttagggggagcttttgcttgtcattacaatatatgtccatgtgctctatgtttgattatatatatttgtggtgtttgtcatcatttaccaaaaaggaggagattgaagcatctaggccccggtgttaattttggtaattaatgacaagcactaattgtggactaaccgttgtgtttgagctatttgtttgagttaggttcagttatttgtgtgcacatggatgatcattgatggattaaaattgatggcgcaaagcaaaaggaagagaagacggtaaacaagtgttttcattttaaattgctcgaggcgttgggcgatcaaaattgtgctagtttatttatagctttgccgtactattaagaggggtaatgacctagcaaagagatgattttaattgccacattaggtcattatgcatttagacttgtcctctcatttcatcacacacacaatcatttatctcactgttttcggcctgaccagggccggtctgaccacggcccaagtgccggtttgaccggcaagggcactagtctgaccgcagggtctaggccggtctgatcgccgcctcaatgccggtctaaccggccggccatatggccaggatggtgccatcccggtgtgccgatcccgagccgccggagccgtattcggtcagaccgagctgatggcggtctgaccgagccgaggccggtttgaccggccaccccatgtcggtctgaccggctacggctgtggggcccaatgacatccctacaacggctagaaaactagccattgtagagtagcacggtctgaccgaccacatacctccggtcagaccggcagagcacagagttgggggatttcgcccccaacggctagttttggttggtgggagtataaataccccccctccagcagcaagggaactctcttggcactcaattcaattgcatacaacactcaatttaattgcatacaccccttgcacctctctcacacccacttgaactttatgttcatccatctagtgtgttagagggttaattagccaagagtcaagtgcattgcttccatttgtagagctagtgtggcacttgattgatcatctccatgccgggtcattgcttgttactcttggaggttgccgcctcctaaacggcttgtggaggagttgcccagtgatctctccgagaagattgtggaggaggcccggcgccgattgtgagtggtttggagttcaccaccttcggagtgaaggaagaactaccctagtgatcgaggcttggggtagtcctctccgtgggccggctcgcgccttgcccaccccttgacgaaggaggcgtgcggtgacttcgtggttgagcggcggagttgggctcgcctcaacggggagtaggaaaccggcgagtttccgaacctcggtgaaaaatctcttgtctcgttgtctcattagattgtcgcatttacatttatgcaatttacatttctagagacattcttgagatcatatcaccctaggattgctaaacattgacataggagtgtgatttactttcctagagatataattgagccactatcaccctaggtttgcaaaacataacttagttgcttagttagagttgaccctcaccaagcctagcaacttaggttagttttgattaggtgtcatttagttttaaatcgtctattcaccccccctctagtcgacatctcgatcctacaagtggtatcagagcttggtctctcttgattgggcttcagcgcctagaaagaagatgtcgaacgaggtgaaccatgtaaggaaggctcccaagtttaatggcacaaactactccacttggaaaattaaaatgtctactcacctcaaagctatgagcttccatatttggagtattgtggatataggctttgctatcaccgacacgcccttgacgttgattgatcaccggaacctccaactcaatgcccaagccatgaatgctttgttcaactctttgagccaaaagtagttcgatagagtgagcaaccttgagatcgcatatgagatttggaacaagttggcggagatccatgaggccagaagcgagtacaaggatgccaagcttcatttcctcaagatccaatatgagacattctccatgttgcctcatgagagtgtgaatgacatgtatgggaggctatgccacagcaacctcaaggaacacctcaacaacgaccatgggcagatttgattgcagatgtcatgaaggagcagtttgggcttaggccgaaagatgctggaaatttgtatcgacaaccctatcctgaatggtttgagagggttccactacccaatcggtttaaggcaccagaattttcaaaattttcaggacaagatagtacatcgacttacgagcacattagccgatttttagcccagtgtggtgaagcatcggctgtggatgccctgagggttaggttgttccggttatctttgtctggatcggcctttatttggttttcttctttaccatatggatcaattaacagttgggccgatctagaaaaatagtttcacaactatttttatagtggggttcacgagatgaaattgtccgatctgacatcgatcaagtagagacatgatgagcctgtgcatgagtatattcagagattcagggagatgaggaataagtgctacagcttaagtttgactgatgcccagttagccgatttagcttttcagggtatgattgctccaattagggagaaattctcatctgaggattttgaaagcttgtcccatctcacacagaaggtaaccttgcatgaacaaagatttgcagaggctaggaagaattctaggaaggttaatcatgtatgtccttacatgtatgggtcggacgatgaggatgatgattctgagatagctgcagccgaatgggtaaggagcaaaaagattataccatgccaatgggtaaagaactctagaaaagaggagaggtatgactttgatatcactaaggctgacaagatttttgacttgttactccggaagaagcagattcaacttcctactggtcacacaattccatcggctgaggaattgggcaagaaaagatattgcaagtggcataattctgggtctcatacgactaatgattgcaaggtcttcaggcagcagatccaagcggctattgaagggggcaaaatcaaatttgatgactctaagaggccgatgaaggttgatggcaatcctttcctgttaatatggtgcatacagctggccgaacaaccgataggggtcgtgcaagaggttttcaggtaaattcggctaagattatcaacaaatatcagaggaggtatgaaaagtagcaggagaagcattatgaagaagatgacgatggctttgatcctcattggggttgcgagttctttagattttgctggaatgaacgtatgaggctgccgtctattgaggactgtcctgggtgcagttatgttgcgaagagctcaagccgatcatatagtaggggcaatcggctaaagcagacaagacttcctgttcatcaaaggttgggtctagtgaaccaagatcatggctaggaggacgatgaaaataggaaaactcaatggtgtccttccggtatctttacggagaatcaaaagagaagggttcaaagattgaggagcagggagcactttcaggaagtcgagcaggaaatcaaccatcggttgaagaagacaaagccgaagcaggagtggcgtgttaagaatcaagttcctgtagctgaggaagccacagccgatgaagcaaaaaggttggccaaaggaaaaagtgttgtagctgcttcggtcatcatggttttcacattgcctgccgaatctgggattaagcaagaagatattgacgaagttgaagaagaatcggctaagttgattttttcaccagagcaggcagttttcgagaagccagaggggacggagaatcggcatcttaagccattgtatataaatggttatgtcaatgggaagccgatgtccaaggtgatggtcgatggtggggctgcagtaaatttgatgccttacactacgtttaggaagttgggcagaaatgctgaagatctcatcaagacaaacatggtgctcaaagactttggcggcaatccatcagaaaccaagggagttttgaatgtggagctgacagtcggcaacaaaaccatccctacaatgttctttgtcatcgatgggaagggttcttatagcttgttgcttggaagggattggattcatgctaattgttgcattcattcaaccatgcatcaaggcttgattcagtggcaaggtgacaagattgaaattgtgctagccgacaggtcagtcaatgttgccagtgccgatttagctctttgggagatggatggtcttgattgtttatctggaaaagtttgggatggagattttttaaaagtgtctgattctgatatatagccaattgaagatggagaacccaagctattattttgagggcattgtggagggttcagatgtctacaacaaggacacagtagatgatctcgatgacaaacaaggacagggttttatgtcggccgatgattgggaagaaattgatataggtccaggtgatcgacctaggccgacatttattagtaagaatttatctgcagaatttagaaccaagttgatagagctgttgagagaattcatagattgcttcgcttgggagtattatgaaatgcctggactcagccgatcgattgttgaacatcggctacctatcaaaccaggggttaggccacaccaacaacctccgaggagatgcaaagctgatatgcttgaacctgtcaaggctgagattaaacaattatatgatgctggttttattcgtccttgccgatatgctgagtgggtttctagtatagttcctcatataagaaaaacggtaaggtcagggtgtgcattgatttccgaaacttgaataaagctaccccgaaggatgaataaccaatgccagtagccgatcagctggttgatgctgtgtcagggcacaagattttgagttttatggatggaaacgcaggatataatcagatttttatggccgaagaagacattcataagacagcttttagatgtcctggtgcaatcggcttatttgaatgggttgtgatgactttcggcttgaagagtgcaggagctacatatcaacgagccatgaattatatataccatgatctaatcggctggttggttgaggtccacattgatgatgtggttgttaaatctaaggaaatagaagaccatatagctgatttaaggaaagtctttgagagaaccagaaaatatggcctgaagatgaacccgacaaaatgtgcttttggtgtatcggctggccagtttttgagatttcttgttcatgagagggggatcgaggtgactcagaggagtgttaatgcgatcaagaagattcagcctccagagaacaagacagaactacaagagatgatcggcaagataaattttgttagaaggtttatttctaatttgtctggaaggttagagcctattacaccattgttgagattgaaagccaatcagcagtttacttggggggcagagcaacaaaaggctttggataatattaaggaatatcttaactctcctcttgttttaattcctccacagaagggaataccttttagattatatctatcggccggtgagaagtcaatcggcttagttttgattcaggagcttgaagcaaaagaaagagttatattctatatcagtcgtcggctcttggatgcagaaattagatattcccctgtggagaagttatgcttgtgcttatatttttcatgtacaaggttgaggcattatctgctatccaatgagtgcactgtcatatgtaaggccgatgttgtcaagtatatgttattggctccgattttgaaaggaagggttggaaagtggatattttccttaactgagtttgatcttcgatatgagtcgccgaaggcaattaaagggcaagctatagccgattttattgtggaacatcgtgatgattcaatcggctcagttgaaattgtgccatggactttattctttgatggatcagtgtgtactcatggttgtggtatcggattagttataatttcccctaggaggacatgtttcgagtttgcttatactatcaaaccttatgcaactaataatcaagctgagtatgaggcagtgctcaaagggttgcaattactcaaggaagttgaagccgatgctattgaaataatgggggattctttgctagtaatcattcaattggcaagagaatatgaatgcaaaaatgatacattaatggtttgtaatgagaagtgccaagaattgatgaaagaatttaggctggttactttaaagcatgtgtcccgagaacagaatattgaagctaatgatttggcgcaaggggcgtcggggtataagccgatgatcaaagatgttaaggtcgaagtcgcagcaataacagctgatgattggaggtatgatgtgcatcaatatttactgaatccatctcaatcggcttctaggaaattaagatatatggcattgaagtacactttattggatgatgagctttattatcggacaattgatggggtgttgcttaagtgtttgagtgccgatcaggctaaagttgcaatcggtgaagttcatgaaggaatttgtggtactcatcaatcggctcataagatgaagtggttacttcagcgtgcaagatatttttggccgacaatgctggaggattgttttagatattacaaaggatgtcaagattgtcagaaatttggagcaattcagcgagcaccggcgtcagctatgaatcctatgtcacgcccagaatttctatccaaaattccaaacgcttacatgcgtgttaaatccacctccaggaatcagccgaggcacacaataacaaattgataatagagtactatcaaacagttaattaatattcgcaaaataataaatttttacagtggtggatagttcctctcaaaagaatagaattctacgcagcggaaataaaaacaaaagactgaacagctatggcgactccactccacaatggcgactccactccacaagcaacttgacccgaacaaagcctaatcctccggaccatcaccttcactgaagtactcctcctctgatgaatgaatattgcaagaatgagcatatgacatactcaacatgccacacagcagatatgcaagtgcacaggataacaaaggatggcataataaagcttatttgcataaacagcaattaataaacatttgagagaatagtaaaacagttaagtaattaagcaatattaaataaacactatacaacacacctatgttgcataggcccaacctcatctgaacagccaaccccagttgtacaaatcaaacctccataccaggaatataccattccaaaccaggagtcaatttaattatcacaagttatcaccagtaatgagtagggtgagactaatcacgaaaaacattgttagacccgcccataaccgcgggcacggctattcgaatagttttactctggccagagatgtaccactgtacccacaagacatagctccacaacatgttaccatgcgcctcaataccaccacgatacctcggaaaggaactgtgacaatacccctcgcacaacacaactcaccacagtgcaccacacctcgatcataatcaatccctctacaaccagaggcatggactccccagcgacccccacggacttctcgctgcttctcagtctggcaccccataatgaaccatgctatacaaaaggtaaagccgttgcccacgctggcttgtggttggcacggtaaatgtttcacaacagtagctcgtgaaccggtccttaattgtcatgagcgcgaccatcaaaaccatgtgctcacaacccacctttaatcaggttttaattattaattaattatcataacacgattaaccatcgtgagttaccattaaatataaccataattaataatgtagtatgattcatcccattaatgagctaatgtttctaagcatgactaagcaattatatatatagcatttagctgaaccaaaccaatatataaggttctagctaatcaaattataacccataggaaaataaagtcatcttcggccataattaattgggaaaggctcaccacctgatgacattcgaaaataatgcataagttgaaataaaacattagctttaaactggttcaacatgctcaaagggttgtttgggatctatgtgacttgcattgagcttcctcaaatgcttctgaaccttcctcaacgtaaacgctctcctccagaacgtcggaaactagcaaatgaacaaaatcaacaaaacagtacaaaaacaagcataaacagtacatgtggatatttttaacatgtagatctcgattttttatgaatttagcaacttgaaccacttgaatccgagttatgatgatttagttatgaattttctaagtttaatcgattttaatctactaaagaaaaaataataagaagagttatgacatcatcgatggcatcatcgccggccatagctcggctccacgcaaccaccggcgatagagtgcttggccgggctatccgaggacacctctgcgaagaggacgacgacgcgaactcaccggtacaaagcacaatgacggacgacgacgaacgacggccggcgacgaggtccgacggcggcggtcttcggcggctgcgaaggggcggacggggtgctcctccaccgtgtgaacccgatggcagcgacggaaggcggcggcgacggccacagcagcggcgaggcgcggctgaaacggcgtcggcggcggcggtgctacgggcgacggctgcggctaaaacttgaggcaaatggaagaggacgactaggggatgctttatataggcttggattagagagatcggactccaaacgagaggatttgagccggaaaatctgagggttagtttggagagataaactcgaaaacgaatttgattcggataaaaaagaaagcaattagctccgattcttggggggaaaagatagaggacaacaaagggacaaaaaaacccctcaaccaatcggactcggagatggccggaggcggcggatttggtagggaacggtggcggctcggtctcggcttggccggccggaggttgaagacaaccctgacatgtgggccccatatgtcgacggctgagggaagaagtggggcgcggctcggctttggccgacttggactgcatggcgcgcgcgaggagagaggagttgggccggaaacggcccaacggcctacgggagggttttaaagactttttcaattaaaataattagtggaatgatgtttcatttattaaaaatactttccttgctcaaataattcccagaaaaatctagaaaatagataaacaagcaaagtatttactgaaattttatctagctcaattttatgttgaaatttttcctagattattagagttcaacttgtaagcttttaaaataatttctaaaaatgaattaaagaatgaattattaaaataggcgattttcagggcgtgacatcctatcattaagccatggccattcagaggttggggaattgatatgatcggcatgataaatccaccatcgagtaaaggacataagtttatattggtggcgaccgattatttcaccaaatgggtagaggtgattcctttgaagaaggttgattatggggatgcgatacagtttgtttaggagcatgtaatctaccgatttggtattcctaaaacaattacaaccgatcaaggttcgatctttgtgtccgatgagtttgttcagtttgccgatagcatgggtatcaaattattgaattcttcaccatattatgcacaagctaacgggtaagccgaggcatctaacaaaagcttgattaagttgattaaaaggaagatttctgattatcctcggcaatggcatactcggttggccaaagcattgtggtcttatcggatggtttgtcatggatcgatccaagtccctccttataaacttgtttatgggcatgaggctgttttgccatgggaagttagaattggctccaggagaacggaattacaaaatgatttaacagccgatgagtattataaccttatggccgatgagagggaagatctggttcagtcacgtttgcgagcccttgcaaaggttactaaagataaagtacgagttgctcggcattacaacaagaaggtagtacccaaagatttttcggaaggtgaacttgtatgaaagttgattttgccgattggaactcgagatagcaaattcggcaagtggtcgctgaattgggaaggaccgttccaaattcataaagttgtatccaaaggagcttacatactgcaaggacttgatggagaagtttatggcagagcactaaatggcaaatacttgaagaaatattacccaagtttttgggttaacgcatgatcggctaaggttgccgcagaaaagctagccggcgtgtacgcgccggcgaggtgcacgccgcgcagattttttttttccagattttttttcaacgtgttaacgtaactaattcgtttagttaaggataattatagaattaacagaagatttttttaattgaaatttttaagttagatttgaaaactttcgagttaaaatttaaattttaaggtcaaaatttgaaaacttttaacttaaaactttgaaaaaaattttaactcaaaattcaaatttgtaagttaaattttaaaaactttcaactcagatttaaaaattttcaacttgatatttgaaaactttcaactcgagattgaaatctttcaactcaagatttcaaaactttcaacttagatttgaaaactttcgactcaatattcgaaaactttcaatgcaagatttgaaaattttcaacttatatttgaaaactttcaagccaagatttgagaactcttaacttaaatttaaaaactttctaactcaagatttgaaaatatttttaactcaattttgaaactttcaactctaaatctgaaattttctctcttatttttcaaacattaaacttaattttcaaaccttccaattcatatttaaaattttcaactcaactatttatttatcattctataaaaaaatctaattagtgctaaacaaaagggattagtgctaatctctatagattagcggcattcaacgcaaggctgagccgtattccagggagcaggtgcgcgcgactttacgttgcggcgcgtacgcgccaattagcatcccccatgttgccgatacatgatagccaatgtgtttacatcgccttgagatggccgatatggttatatcgcccttagatgttttcatattgtaatcggttgtgatttgccgatgtacagtggccaatatggttatatcgtccttagttgttttcatattgtaatcggttgtggtttgccgatgtacaaatggctgatattgttatatcgcccttagtcattttttataattttatcaatgcttttgacattgtaaaattaggggggcacatatatggaaaattgcaaatttttgagcgaatttagaagttatattaattggcacgaaggattatcaggatagtaaagtactagagtatcttgaccgattacaaaaatttatgaggtctattacaaataaagtcatcgagacaagaattgttggatagccgaaatggccctttgcctaatttgttctacttcttcaatggcttgggcgtcttgagcatcggttccacggatgattttcaaagacttggtcagatcggcaacattcttgatagccgatttgagtctcactttctgctcttcgatagactttgggagatcggccaactttctatgttccatatccagctcggcattgcattcttcaagttgtgccaagagctcaatcttgcgagcttcgagccgatcaatattggacttaatcggacccttagatagctgatcaagtttggtcttctcttcatgaacaagctgtcgattggcttggattgtggcttcaatgtccttgcgctcccgacgttcggctagtcttagcttggccttctccagcttgaattgatgttgttcaagatagactgctggagtaagaacatcggctagctcatctgggattagagctcggatttcatgtagcgagtcctaattggcccacagtttaccaccaagttgtctagtgacgatgcttccagccgatgagatatgtcttcgagtgttttcttcacgtcatcgggcaagagaaccaaagatttgctggtggtgtcttcttctgtttcttcgttaagataatctctaatgtcaaaagagaagagatcggctaaaacctgcagaaacaatttcaggaagattgagagctaagtagatatagtcgatctaattttttgcatcaggaggaaaagtactgggatagcaggagcagttggttgtacttctgcctcaatatgatgactccccacagccgatggagttcggtcactcgacgattgttgtacaggggaagaaggaggaggatgaagcagtaaaagaaacaagtgttatacaaaatccgctgaaatcaactagtaaatttaagaataacttactggtggagctggtttgaaaattggtgctgccgatttcttctttacaacaattttcttcttctgcagctacaaagtctatgagtaatcggccaaaaagtgaaataattacaaaagatattgaagggagctgcttactcttaagagatgagtgggggcagaaggagtcggcgttgtctgcttgggtgaagccgatggtgttctttctgtgtcactcacttcggctgcagcctgatcaacattatcctcaatgtcttcttcatccagagcttgctcaatagatggatccaggacaggcagatcatcggttggtttaggtttcttgagtttggccttcttctttggggctagagttaatgtatctgcggccgataacctcgttcttctcttcttacctgtatcggctggttctctgatgaatccttgaagaagagttgaggtcttgggggcattatagccaatgacaggaggggatggtccacctccattaggaattaaacctggggcatattgaatatttataccactattgctttgatgtggaggggaagattctgttgtctgcaaaacaggaacaaaagattagtcaagtaatgaatcggctgacatttatgtagtttagtaatgacaaagtttacctggggtatgacatcaaggaatagatctgtcatgtatatcgaggccgtttgatgaaatagatgcagcttccattcacccccaccatctgtcaaagtttctgctcttgaatcctgccaattcgatattttcaatactacccagaggaggtccttggaggttaagcagccgatccatcatcagagttgatgagatttctcctcggcactggatcttgtcggcaaagaataagccgattgggagttggcccaatccaagttgcctagctgaactcattgggtggtacaattcatagaagacttgtatgtttctcccttggtgaatgccgacgggtaagatgcatgggctgattgcagctgtgaaaacttctcggactttttggtatctttcatggttgatgtcttcaaatctgaagtctgatggtagtttgaggtctgctgaatattcataaggaaaccagactcgggcatctttttgaaagccttcataaaagctgcagaaccaatccttgagtagttcagccgatagttttgcaccagcatcagctggtgtggatgcatattcttcatatgtcatgcatctacgatgagtacgttactctccatcatcgtctacaatcagctctaaccttagaaattcagcttctgtcacagatggtcgattgataactttcataaccatcagatttagccaagtctgcaatagccaccatggtccacctgctccaactactgagccaacagctatcttggctgatgcatcattcagcatttggtatagatagccgagaaggattctgcccaaaggaaattgtctctttgattctagggcttcggctacaaattgccagttgttcgtagggctgcaactggatccacagaaaagaaacttttctagccacatgagtaaaaaggccacatgttctcgaggagtaacagatccttggcccatatatgctgccacatagccagaccaaccacctatgctttttgtcctgaaatcgaattgattcttggtgttcatactcataggattagccgatgaagttacatctaaaccgatgatcatggtaatgttgatcaaagttggagtcattggcccttggttgaacaagaaggcgttgatggtgttggaccagaaataggtggcggcagccatcagaggttcatccttagcagaattggctatggtgagggcaagcgcttggccgatcccaatctcatcccagtgaactttcttactaggcgatacgtgctggtaccatttggtccaactcttctcaggggtggttttctcaagagatggccaagacttgaaagtattcttctagttacccagattagggttggctaatctaaaggggattatgctggtttcaccgatgataaaatcagtggggtcaagattgccgattggaccaagaaagtagtggttttcatgtgacaggctgggaatagcaactaggttggaaaggtgctgcaaatccaaaggaatcaagaagaagaaaacaagatgagaaaaggggaaatcgatttcatgcgaggaaaagggatctagccggtgagaacttatctcagcatactatgccgatggcgcgggcggaggtctaaccggagacgaaatcacttggggatcgcctcgagcgtcggagaaatggccggagagagaaaggagaaggttggcttcggcggtgaaaacggaagtaacggggtgaagattttttagggcgacggttagtatttaaagcgctgaggataacggttgggaaacgacagattgcgaatcttgctcggagtggtatatggcaaatccgaaacattaccaaatattccggacttggggggcatgtgttaacaaccaaatttggttatatcagtatcggagatgaggataagatcgaagtggaaccaaagatgaagatcgttgcagaaacagagtaggaatcggctggagtccggatcggctatgattggatcggctaagtccgagtcagactgggttaagtgatacagccgattccggcaaaatgacttgtgtacgacatcgagttgagttgataagcttcaagatgattaccacgcatggatagagtcctgagaaggcaattgtatctattgattaggatattttatgtaaattccttagagatatgtttgggcaaaagtctgccgcaaagacttatggtatcttagagtttgttagagataagagtcgtgtccgatatggacatagtttgttgttttcgggaataaatagaccccgaaccccatgtaatcagttaacacacacgttcaatacaatttcggcgcatcgccacccttttgcttttgttttatttcgacgagttcttgctttcaagttgagctgcatcggtttcgatcttcaacaagaggtaaaacttgttatgatggcttgcattctcgggattagtgcttccatctttatgatactctaatcttgtttatgtaattcgtcgagttatcatatatcttacataatctctagcaataccgccatctaacccacaatcggctaacatctgttggcagagggcaaccgattaggttagatgtcgacgttgatttagattatataagatatctaccactctatgaaatttccagcggcttgattgtgtagatattgttcttcttttcatacttaatgctgcatcagttgagtttgatctattaagtcgtgcttagaatatcaatctctagcctgccttctggttgccgattagggtagtatcggggtttcaactgatcttatctggtttaattatatttgctctatatgtttcgttgacatgttaaacctgccctttatattaagatcttattgcatctaagtatattaagcttttgtttggtatattctgcttgttttaatatcttaacatggagttgtatcggagtattagccgatacatgctagatctatctgatcggctatgctatgaacatatatagctttgttgttaatatatatttcggtctaagtgatttatactgtctcggcacgacgaccgatctatcccaatcacttgatttaaatatatatcgacatcaggattatatattgttaatatctacagccgatcgagtagatttagttctttattatctatttataactgccgatcgatttacatatgacatcggcccgaagataaatgatatgtcatcggcacctagccgatcggctatcgtttatggatttaaccatgatttctttgtctttatttcttgttgattgcaggatcaaatcaactagcacacttgcatacccgaaggcgagttttggacctgcactggagttaagcagatctcccaggcctcgtgttttatgtcaacaaagccataaacaccgcttgccatgcaaccaataggctttatttgcatcgtctcttgaaaaagacttcctatgagctaattgttgggaggaagccaaatgttgcctattttcgagtttttggttgcaagtgttatatttatcgaaagggtgttagactaaccaaatttgaaagtcggtgttgatgaagggtttcttctaggttatgcctcaaatagcaaggcataccgggtctacaataagaacaaaggtattgtggaagaaaccgccgatgttcaatttgatgagactaatggctcccaagaggggcacgagaatttggatgatgtaggtgatgaaggcttgatgagagctatgaagaacatgtctattggagatgtcaagcctattgaagtggaagacaagccatccacctccactcaagatgagccatctacttccgctacgccaagtcaagctcaagttgaggtggaggaggagaaggcacaaaatccacctatgccaccaaggatacacaccgctctttccaaggatcacccaattgaccaagtgttgggtgacattagtaagggtgttcaaactcgatctcgtgtcgcttcgatttgtgaacattactcgtttgtttcttgtcttgagcaaaaacaagtagatgaagctctttgtgatccggattggatgaatgctatgcatgaagagctcaacaactttgcaagaaacaaggtgtggactttggttgaaagacctagagaccacaatgtcatagggacaaagtgggtctttaggaacaaacaagatgagaacgggttggtggtgagaaacaaggcaaggttggtggcacaaggtttcacacaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacttcccggttttgaagatcctaaaaatcctaaccacgtttacaaactctcaaaagctctttatggtttaaaacaagctcctagggcttggtatgaaagattgagagattttcttttgtcaaaggttttcaaaattggaaaagttgacaccaccctttttacaaagatcattggtgatgatttctttgtgtgtcaaatttatgttgatgacatcatattcggttttactaatgaggtattttgcaagaaatttggtgatatgatgtctaggaaatttgagatgtccatgattggagagttgagcttcttccttggacttcaaatcaagcaactcaaggatgggacgttcgtgagccaaaccaagtacatcaaggatctacttaaaaggtttagcttggaggatgcgaagcccatcaagacacctatgacaaccaatgggcatctcgaccttcatgagggaggtaaaccggtagatttaaagctttatcgttctatgattggtagcttgctttaccttaccgcatctaggccggatatcatgtttagtgtttgcatgtgtgcacggtttcaagccgctcctaaggagtgtcacttagtggccgtgaaaaggattttaagatatttaaaacattcctctactattggcttgtggtacccaaaaggtgctaagtttaaatttgttggctattccaattcggactatgccggttgcaaagtggatagaaagagcacatccggtagttgccaaatgcttggtagatcccttgtgtcatggtcatccaagaaacaaaactccgtagccctctctaccgccgaggcggaatatgtttcggcaggtagttgttgtgctcaattgctttggatgaaacaaatattgttggactatggtatatccttcaccaaaactccacttctatgtggcaatgatagtgccataaagatagccaataacccagtccaatattctagaactaagcatattgatattcgccatcacttcctaagagaccatgttgccaagtgtgacatagtcattagccgcataagaaccgaggatcaactagccgacatatttaccaagcctcttgatgaaacccgcttttgcaggttgaggaatgagttaaatgtcatagatttctctaatgtggcttgagatggtgcaccatggttgcttcttttgcattgtgtatatttgctctcattcacgcttatgctttggatttactgccatttggttcttcattacgaaaatgaagcatgtcacattaagggggagttttgcactcttgcatgtgctctacttccttttatatgtgagcaaatcaactagtggtgctagtagtattttcaaaatgcccaagtcaacataagtcaaaacttttacaaaatcaatgtaatttgaaaactatctcttagaaaatgtttcaaaaggtttcctatatgttttccaagcctcatattgcaagaaaaatgtttttttgaatgaaaatgccatttttgcccgcttttgaagaaactagattcttagttttggccaaaatgagattgagaaggaatttgagaaaagtttcaaaacaaagttggtagagaagaggatttgaaatgtttttggtattcaaacctatctcaaaaatcaaacatttcgaaagttgtttgaacatcaaattcgcccaaaaacccctatagaccataaaaggtcacctcctagcactcaagtgagttttgttgcaaatcttcataattttcaaatgttataaatagttggaaatatttcaactcacacatttcaaatttgctccaaaaatcaaatttttgttgttttttattgtgtgggggtagccgaactgtgcaagggttgtgcacagtcggctggagcgggcggtctgaccggccatataggcccggtctgaccggcctggagctgaccagccacatagggccggtctgaccggcctagcaggtgggcccagggtttttaccctttcttctccaacccgactccctctctctccttctcatcccctcacttctccatctcgaattttcttctcctctctcctctcccaaaccctagccacctccctccatcaaaatccattcggtttgaccatagatttctctccggttacaccgtaagtgaatctcctcctctttctctctctattccatggactgatttgagtttttattgagtttgtgatccatggcatggaaccctaggtgaaggaagaggtgttcttcgatttgcaccaatagagggtagtttcttggtgtgattcaactccttcaaccagtaaatcactctccctcttgtgcattgctctcaatcggtctattttaatctctagggttaagggtacttttccccctttgttccaatcttgatgaaatagacctacaccttgatatccatgctcaaatcatgtgcaaattttgtcctagtatgtttagaatcatttgtgtggtgtggaaattttgtggcatgagacttgtcagtggcggtctgaccgggaacaaggaggcggtctgaccggcttgttcccggcagtctaactgggctcgagccgccggtctgaccagcgtgcatcttgcggtctaaccagcaggtacaccccggtctgaccggcttatgtcatccggtctgaccgcccctgacaggcagtgcacaccttacttccatcttgccaagtgccttctaaaattgttgcttatccatcctttgctcctgtttttcagctatgcctccccgcactcgtcgtgatcgtcgtgagcccacgcccgatcccgtcagtgagaatgaggaatcaagcggagatgagtatgttcaaagtgaggatgaaaatatggaaaatgttgagggggatgaggtggaagtaagtagtgatgacaatggtagtgatggtggtgatgacaattgtcacgtcctgataaattcatcccgaaataaaattcattttctaaaaggaataatagaattaattaaaattcggaaagaaattggcaaacactaaaatacgtacaagaaaaattcgaatgtggcctggagaatttttgttaaattctccttggtctaaaatgagccctcaaattttacttgaattttcagagcaccggaaatatttattaaacaacaacaacaattatcaaagttcaataaaaagaaaacctaaaaataatcctcttcctcctttgggccaagcccagctcaaagtctcccctctctctctttcggcccgcggccgaagtctccctctcctccctctctttccctcctctcccgggcctcccctccccctcccgggccactccctccttctacctcttttacccaggccggctccccttctatcctactgggccggccgcctggcccaagccgc

SEQ ID NO: 10457 - DNA, 24503 bp, Oryza sativa
  unsure (1)..(24503): unsure at all n locations
ggcttccctctctcccgtgaaccctactccttccctccctcaaatccgtgtgattcgctcatgggattccaaaattaaataggggaaattaatccccattgaatcctcttcaatcccccccaatttcccccttgaatggcgcccccaatcgccgggaacgcccgcgtcttcctcggccgccctccattgccgccggccgtggttcccgccgccgttcccgctcctcccgtggccggctctctcccccatcctataaaatgggatcctcatcccccgttatctcgttttagccccatcccgagcctccccgtggtccctagctctattcccgccgccctcctctctctcccacgctgccggccgcctccagccgcctgtgccgcctcgaccgtgcgccggccggccgcgccgtcgcctcctccagcgtcgccgctaccccctccaccccggcctgccctccgtttcccgcggagacccccggagctacgtttccgccgtcgccctttcctttncttcgcaccggccgccttcagccgnctctatcttcctgcctgagcgccggtcaacgtcgccaccacctgcctcgggtccgcgacgccgccctcatccccggcatcacctcctcctcgcccgaagctcgccggagtggcctcctcgccggcgtccagtggcgtcgccaccacttctccgtctccggccggctgctgttcgtcgccggtacgccgaccgacgtcgccgtctcctccgttgacgtcgcagcgtcgccctccaccccggcctgccctcggtttcaccggaacgtcgccgcgaacatctccgtccgcctcgccggagttgtttggccgcccgtccctcctcgcccgtgcaccggtcggccacacctccaccacctccggcatcgcagcggcaaggtcgtcctcggcatcgtttcccctccatccaaacccctccgcggtccatcatcgtcgtctccgatcgttctcgtcgtcgacgtcccatcggtcgcccggctcgtcgtctcgcggcgccgcctccgtcgtcggcaccgcagcggcgtggtcctcgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgccgcagccccatcatcgtcttcgtcctcggctccgcgtcgtcaagtctcgtgccggccgtgtctcgccttcgttcaaggatcgccgccgaagtcgttccctcgccgtccgtctccgccgcgccgttcgtcgttgtcgttcccacgcctcgtcgcgtggtggtaaggttctctctccctcgctgccccgtccctgtcctttcggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtcctcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggtttgcggtcgtcgccgaaggttcggaaggccgttctctctgagcaaggcaagtcccatcatccttgaacatattgaatcccagtttataaaattatgttgctttaaattattgcattatcgctttatttaaattcccgcgtgatcactgttttatttagccatgcctatttacctttgttatgaccttaatattattgttattgatattattaccttgttcaccctaggaaaataaaaccccaactagtgggtactctatttatggttccactagtatgaatttaggtagatgcttcgctgattaattaggtaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggccgcaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttgtaaatgctgtttactgcaaaacttaacccctatattattaccccttgtacccccttgcattaattattcatctccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgtttatttttgattgccaggcctgaagcgcctttgtaataatgtaaatattatcgatataataaagatgtgcctgttatatcatgtttgtgtggtgtaccccggcttttcctgggacggggattaatacactagcgttcgggaaaaggcaattttcccggtcgtgacaacaatggcggtggtgatggtgaggatgatgaggcaagtgatgatgggagtcctctcgatcccaccatccaatttatgctaactttgaggaatgctcagcaatacactatcctccgacatcatgatcaattccggaggcctaatgattgtaatgatccaaggttccatacacggttccaaaagtccgtgtatgagcaagtgtatgccaacaaagccttcgccgaacacaagtggatttcttggaggcacattggtgagacaccggagtttgtggatttgcaagagatgttctgacccgttgggattgatacgattgtcaccatgaagcaacattttgatgaagatctcatatctaataggttaaggtgtgttgggccatattttgtatgggtatgggctattactctatattgtgtgttctttatcgttttgttgaactctatgtcatttggacccttcatggtcttgtaatagcctatgtttatttgtgagcccttttaggatgatgtgtgacttatgtgagttgaatggttaagtgatgtgaacttgtgcgatgatggatggtatatgtgatattgatatatatgtgaccatcttatgctcatgaatgaatatttcttgaagttcatattgagatattgctcttgtgtttgtgatatgttgaaatgtgaaattgaaattggctccatatttgctattgttgttatgcatatgtttagggggagcttttgcttgtcattgcaatatatctccatgtgctctgtgtttaattatatatatttgtggtgtttgtcatcaattaccaaaaagggggagattgaagcatctaggcccacggtattaattttggtaattaatgacaagcactaattgtggactaaccattgtgtttgagctatttgtttgagttaggttcacttaattgtgtgcacatggatgatcattgatggattaaaattgacggcgcaaagcaaaaggaagagaagatggtagactagtgttttcattttaaatttatcgaggcgttgggcgatcaaaattgtgctagtttattaatagctttgtcgtactattaagaggggtaatgacctagcaaagagatgattttaattgccacattaggtcattatgcatttagacttgtgctttcatttcatcacacacacacaatcatttatctcactgttttcggcctgaccagggccggtctgaccgcggcccaagtgccggtctgaccggccagggcagccggtctgaccgcagggtctaggccggtctgaccggcgggtgcgggccggtctgaccgaccagccatatggccgggatggtgccgtctcggtgtgctgatcccgagccgccggagccatattcggtcagaccgagctgatggcggtctgaccaagccgaggccggtctgaccggccaccccatgtcggtctgaccggctacggctgtggggcccaatgacagccgttgtagagtagcacagtttgaccggccacatacctccggtcaaaccggcagagcacagagttgggggatttcgcccccaacggctagttttggttggtgggagtataaataccccccctccagcagcaaggggactctcttggcacccaattcaattgcatacaccccttgcacctctctcacacccacttgagttttgtgttcatacatctagtgtgttagagggttaattagccaagagtcaagtgcattgcttccatttgtagagctagtgtggcacttgattgatcatctccacgcagggtcattgcttgttattcttggaggttgccgcctcctagacggcttgtggaggagttgcccggtgatctctccgagaagattgtggaggaggtccggtgccggttgtgagtggtttggagttcaccaccttcggagtgaaggaagaactaccctagtgatcgaggcttgggtagtcctctccatgggccggctcccgccttgcccaccccttgacaaagggggcgtgcggtggcttcgtggttgagcggcggagttgggctcgcttcaacggggagtaggaaaccggcaagtttccgaacctcggtgaaaaatctctgtctccttgtctcatttgattgtcacatttacatttgtacaatttatatttttagagacattcttgagatcatatcaccctaggattgctaaacattgacataggagtgtgatttactttcctagagatataattgagccactgtcaccctaggtttgcaaaacataacttagttacttagttagagttgaccctcaccaagcctagcaacttatgttagttttgattaggtgtcatttagttttaaatcgcctattcacccccccccctccccctctagtcgacatctcgatcctacaggtgtgtgtgtgagagtgtggattcgagtttgtgtgggtgcttcttgtggtcttcgtaaagatttgtgagcacttgcatcatctccaggagttccttgcatcatcttttactcttggaggttgaggactcctagacggctaggtgttgctcccgagccactgatctacgtgtggttggccgggagaagtttgtgaatgccagatctcgcctccgcaaggaaagagatacctcttagtggaaggaggggtgcttagtgcaacctcttgaggaaagggttagctaagacccggctcttagtgagctcttcaatagagagtagaatccccttaaggatttgaactccgggaacaactttgtgagcttcatcttggtgatatttcttcatccctctcctctagctttgcttgcttgtgccgctattgatctagagttatcctcttttgttcgactgctctgagtattttcggaagttccaaaaattcttgcttagttccgaaaattcttgcttccgctttacttaagtttttaaattagcctattcactccccttctagggctaattgaccctttcaaaaatgttctctgttgtttagtgcagatgtcccggatgagctacgggagaatataagacaggctttgcaggttgaatcaactgtttttgagacgaaatatctgggattacctactctggagggtaggatgaaggctggaaagttcaaaactttgaagcaacgttttgctaagaggctcactgactggtctgaaaaatatatgtcgtctggggctaaagagattctaatcaaatcagtcgcacaggctatcccgacatatgttatgggagtatttaaattgcctgctactgtgtgtgatgaatatacaaaatgataagagacttttggtggggagatgacgaaaacaaaaggaagattcactggacagcctgggagaacctgatcttaccaaaatatatggggggattaggttttcgggacttacaactgttcaatcaggctttactaagaaggcaagcttggcgtcttattcagtatcctgacagtctttgagcgagaattctaaaggccaaatattatccgaactgtgatctcattgatgctgttttcccatcggatacctcacctacatggaaagctgttgaacatggccttgagttacttaagaaaggcttaatttggagaatcggagatggaatttggaaggaccagtggattcctagagaatccagctttggactatcacgccagagtgggagatgccgcctcaggtgggtttatcaactgatcaatcaggagacaaacacctggaatacaaatctcatccatcatgtttgctcccagtatgatgccaatgaaaattttgaagattaaattgccgcaagtcagaacagaggatttgctagcttggcactatgagaagacaggatttttctcagtccacagtgcttaccgactagccttgacaaatcatatgaatatatctgagttgggttcttctagctccgagacaagcggagaacgaaaaatttgggcaagcatatggactacactagtgccgcaaaagattaaaatctttgctaggagattagccagggaaggtcttactacaatggttaatcggaagaagcgcaagttggaggtgaatgcaacttgccgtatatgtggatatgaagatgaagactgctttcatgctgccatctcctgtacccgagctgttgccctgagatcactgttacgggaggtatgggagatgccaaaggagagttgtctgatcaggagtggaccggattggctcttaatcattcttgattccatcaatccggagggccgggcaaagttcctcctgcttctctggagatcatggtttctccggaatgattgtgtgcatggctatgggaaagcatcagtgcagggaagctcaattttccttcagagctaatgggagtccttaacaatgaccaggattggtgggaagttagatgagaaaggaaaaggtcccttattctgcaacagagtgttctgaaggagaactgtaaccaaacccctgccattaatgatagatggactccaccaccgacgggctagacaaaggctaatgtggacggttcgttcgtccagagttcaggctgcgcgacctgcggggattgtcatccgtgatagcactggttcggttctgcttaccccatggagggtcattaatcactgtagctcggctgaggaagcggaaacgattgcgtcttgggagggtgtaaacctgtcagctgaatgggtgaaacaacctttgatccttgaaacagactgtgcaaatttggtatgtttgctgaagaaccagggaactgatagatcgaagctgtgccatacacttcatagcataaagtctttgttggctgttttaccggattttagaatccagaagactaggagagaatgcaatagcgtagctcataatctggccaagttagctatgcgaacaaatcactcagcagtttggcgcttgcaggccccttcatgtattcttgaggcactcgctaatgactgtaattatatcaatgagtgatcaataaagcattctttcccccaaaagaaagcatgagaaaaactgtacagtgtttatggaatatttacaaaaaggggaaaagcgtgagtcctaaggtactatgctacaaagaccctttgctcctgccaaggtccaagtttttgcctcctctttgatcttggcgactagatttgttgccgatagctttttgagttcgaacaccgattgatttcaccatttccatagtttctaagaagtcagaaggataaggctacgcaagccttttttttggtacctacggggtgaaagccaggttcgaccatcactcgtggatcgtcacagggttcctccaatttgttggttcgatttgatcgtaagaaatcaaactccaaaccttctggtgtatccacattccgccatgaggtgtaggcctgtctccatggtatgccggcaaagaggccagcgggcagtaggcattattttgccatccacgtgttgcgagtcggtctgatgtccatactctatttttgtacgattagctatgcaaagaacttattttctcagtgcctagggcttccatatgatcgtggtgtagtttgtactagtagatccaaggaattgccttaggctagaccatgtatcatacacgtgtacccaaaaagaccaaacctatataattagagatttgctaggaaggtaactgaccagacctatatataattagagattcgctagaaagataactgacgataaaattcgatccggtcacatgtggagcgtacagacgcgcggtgaaataaaaggacatctccgcttagttacttttctgtttttatacatatatttttagatatacgtttcgtaggtttttatcggagaatacatttaggagttaagacaatcaaaatatttttaaacagtccttagacttaccaccaaatgctaactaagtcttcgggttgatgccatgcattttagttacgataccccaaaatttatatatatataataattaattatcacgaaattaaatatttagtaaatattgtacaaattatgaaaatagtaaaaaaaatatcactgctgatttactggttatttaatttccggataattaattattataaataaaataatgggtacaattatttcacaaccaaactcaagaaaactttgatggactggtggggtatataagaaatcggaaatcatagcaaacacaaaccattgaaaacatattggaatcattctaatttaacaaaaatgagatgcgccaaaatgaacactcactcggttatacaacacatttgagacgttggacagaattgtgaaagcatgatatcttcaaggtcagcaagcccgaaacatacacgtctgaaatgatgaggaagccaacctatatcactttattatttaagatgttaccttacaaccgcaatgataactagtataaattagtgttttgccggtatttagtcatcagattcaccccctctataaattgcacaaaagaaaaaaagaaaaaaacttaagagggcaaaaaattacataattacatttacatggaccagaacatcttccaagatgtatccgtgctaaacgtgagcctgatattaaaaaaaaaagaatagcaagaaagtcactaatatataaactacagtaagcctaaacgcaacaaaacctactcccagagcttttcttgatcggttcccacttatttgactgttgcttgaagacatcccctcaactatctccttggccagctctgtttaaaatgcttttttctaggtataccttcagctttcacgcaagacatccacgaatttttcagtcagctagcaaaagaattagtttcgtcatctgagactgctgggccgctcatatacttcaatagaactccaggccacaggtgggcagcaaagcaaggtagaataacatgctttccaccacagcttgacttagttgaagaaatatggggatcccaggacatccgtgagatcaaaatctcccctctctggcaatggaggaaattttaattcagggaaagatttctcaaagctctccaacaactgcaccaaaaaaatactgtcagttatgcaacctgtcacttcaacactcactatcacacaaagaataacacagaaaaaccagcaaatgccaacacggtaaacatgcaaatcatgcactgcaaagaaaaactgtattaatactgatatttctaggatattatgaaagagaacacttatctcagactatctttcagctaccctacatagcaaataaatggaaatgcttaacactcaacaactttagaagcatgggaagacaagggaaacacacatttattattctcaattgcaccattagacaaatatttcacactgaaaaaatgctttctgaggagagatacaagcagaaacaaattaatttacccaatactctcacctggtaacatgcttagcaacaaactaacgcaattgttattagaggcattctcttcctctcttttattagttatttaaactatagtaactatctattgggaatgccctaattatgctaggaggtgcacataactcacatatttcgatggtctcattctcatattaatccatatatttgttggggaacttgaaaaataatccaagcaaaattacttaaggagcaagaaaagtatgccagaaaaaaaaatctgatttttcttaagtgatattctgaacaagatagaatggttgttaaatatctgtgataataaccgggataagaaaatacacacattttcgaggataggcgtatcatagagttccacaaacttctctcgtagtattttgttcattgtatcaacatcacaagcatgtgtccaatacgaatcatgcactcctgcattgattttaaaaaaatgttgcgactaatgtacttctccttaagcgcttaatgcaagggataatataaacacttcccagaacacagtaaaactggtacctgcaaaatttagtccttgccttttgcaagcaacagcggtcatcatcatatgagaaccgtcaagggagtgcacgaaatttggaggaaaagcagtcctctgccgcttcaccataacctggttgagtgaattttagtgtaaagtatcaagtattctaaagatctattagattccaagatacaacagcaagtgatgaggaaaataatccatttgcgtccacagttcaataacccattttctgcacaattaccacagggattgcacaggcagtgaactgatcagtaagcaaatgagcaaaacatggcatcagtctttgcagattgtacatagtgctgatgttgaatgatgattggagtaccacagttgatgcgatgagctaataaattgcagttgccggcctcagcttgtttaagcagatgtgcaaaatataaaaatataatggctgttcaccttgatttggtaatgtcaaaagttcaaaccagacacttaacaagagcatacttgtggactcaaaagcttgttttctcataacacatgtgctaaacaaaactaagttctaagcgggaaatctgaaaaaaggcactagcacccggtagtcagtgactggtggaatgtttttataaaaaataaaatagaaaccaagtgaggtgtttactttgaggaaaggatatgggttaatcctagttcatccgatcttaacatatgtccacgatgaatgaaatatcaggaataaagccgtgacacaattcattagatgacccattgatgggaaatctggtccattccttaatcaaaaagtgcactacactactacatgtcatcatcacacacacttcgaccagcaaccagctgatagcgatattgtcagaatgtggaatatagtccaaattgataataccttatctgtttcacgttgaagagtcaggacttgtaatgatgttttaatctgcaaagagaacatcaagaatgccactttaatatcagaacaacagaaggcacatgttgccttattacatcatgtctgaggcatattgcaagttggcaacaataaaataaatacttataacacttacaagatgcctcccaagcttgcgatatggttgaacaactgggagtccaagaggggttgtccatctcacaggttcattttcacaagcaattacctgtcataaagaacaggtgaggtaattcacaacttgcgtctttcctaaattgcaataccaattaaagaggtaggatgccactgtagaaaagtgacatagacatggattttgttgatgcaaaaattgatatagacatgaattttattgctgcaaaatgtatttacagcatcaaattggtataatgcagctgtcttaggataactatcgtaccttggcacagtcaccaagccagttcataatgctgcgggcagcttggaacatctcaccaagtgctgtcagagtaacctatcaagcatcaaaaataaataaataaataaatattatatggtcaatttaattacacttatgtaggataatgaaataaaacagttccactgaataagacattcgaccttagcagcatagcatgatgcactaaaaagttctgaatcatcacaaatcatgtctctctcctttaatcttctttttatttgctcacgtgctccaacataagtgacaccatacacagatgtcatcacagtttgctttaccaatttcctgtcaacctgcaattgataatcaagcaggtaaaagattaaagggtaaactctaatccatggacctctcaacagcaaggttatgtatcaaccgaacagcatcaagcaccaaaacacccttctatcactatttcataggcagcaaacttttacataaacagatcaattaagtgaaagaaaagaatcccgaagtaatttcttctttcattccctgagcactgatttaacaaatttccaaaatggctaataagacaactcactgtgaaccattttgggcaaaattggatgatgaatcggtacttatcattcaaaaatatgaaataaagtgttgtttaggaacctaattagccatttttaacatatagttatcgtaaatagcattagagaatttaatagattgtagcaaaacatcagatggcgattttcttgaggactaatgttttcaggcctatattcatctgaaaaccaaatctcttcgattttgagaacatccatcctgctagtcatgtgagcaaatacaacaggaactaaaaaatatatgaagaactacctgatcaagtagcagacgtgcgcgtgctgcatcaggatctgtagcaggatcttttagcgcatcgttcttcataatttccaccaccctagcacaagtacagaaactatgaaccactcgccatcttaattctaagatatggcatcagttgcatcaagattgataaactagacctgatgatcctcaaatctagatttaatcaatttttaggcactagtttaaaatgactaagaaggacctcaactaaatatcaattttgattgtgtatgatactgtacattagaatattggcctattccagtgaccttgttacagataaataatagtgagcatgaattgtatcagtgagtacattttctaatcaaggattaaaacttatatccaatattgtacatcatgataacaaaccaaattctcatgcatctctatgatctggtaggacccaatttggttatatagttctaaaaattagaataatactggaatacttgcttactcaatgggaagtgttgtaacctgcagaaacaaaattctttctgctaagccatggattaaaataacacactacatctttgaactaatctagaattagcttgtaatattgcattcacgcaataatttggaattcaccaaaaatgaggaattcagtgtgcatgatgcacagaatgcaaataggtacgggtacagcatatgctatgggtctgtttggttgcctggtcaggattggcttgcatgagcggatgtaaaactggactgtttggttgcctgatctatgctcccagccaggcccatctcatgtaaacggctcaccaagccaaggcctgatggaaacattctctctcctctaggctccactcacctccccttcctcatttgcgttcatctttctctttccccctctcctcggtcatcctgattgagcttgccaatcgactgccgaaaaccagggaatctcagcaccagtcaccacagaagcgattcccggttcttccactccagatccatgttgtcactaccgcacatgtgctcccgtcaacagtatcatctgtgcatgtgctcttgtacttgaggcaaacctagtaatctggggataggaagagaggcagagcttgatgtctacgtcagaagtgtgctatttggatctgctcatggtggaaactggtatcaaggaggcagtgcatgcctccttgcgttcctttctggttttcccctcttgtgatttttttcgctctagcgtttgatttatcatgtacctagtctgggcggagtaaagttgctaatggtcaattctcctagctttttgggtttatttgagatcaatcttggctagatctgttaattatgcataatggttggaatttgacattaaaaactactccctccgtttcataatgtaagactttctagcattgctcatattcatatagatgttaatgaatctagacacatatatatgtctagattcattaacatctatatgaatgtgggcaatactagaaagacttacattatgaaacggaggaagtaagtgattgaaatttttgcaccgaagctaagaactgcatggatctagcaattggtggcatatttgtttgattcctcttggatttatctcatgtaccaatttgatttgttacttcaattaaccatactatgtcttgtagttactactgcttgctgtgtatctgatattttttttcttttttgaatccaagcaagctggtggtgatatgcagctggagaaggttgccacaatcatgttttttcctacaagaactactgctacaaaggctatccaacactagatggctaataaaatgtgtgtgtactatgtagttagtgctaatgagccagtcaaaactcaaaagtattctcaagacatgtaaatgtgggaccaagaaccagtggcaggtatatcatcattgtctttcttctgtgtattcagacccataacaattaattagtacaggtaactacaggtgttaatatattgttaacgaatatacaatagctaattcccatgagcaaagtgggtaatctcaccacccaagtgacaaggcaaccaaattcaatgttcatgcaaccaaccaaccaatcaaaattttatgcatgcaaaaatctgaccaccctcctttcctagccaaccaaacatctcaaatcttaatcaaggcccaaaggatacaggcaaccaaacaagccattttttatctgcgaagccaggccaaggctagccaggatgagacatgtgaaccaggctgggaaaatgcagacaaccaaacatgcccagtatgttgcaatggagcattgcatcctaccataaacaaggtgcaatgctaaacacaatgccatccaaacatacctggtagctattccagtataaacatctgcaggcttctccccggcaactaagttcacagcaatggctcccaactacatgaaattgataagaaaatcattaactctactagccaaaaaaaaaatgatgatgatgatccatgcctgactaaataatccttatgaaaacaccaaaactattcaaacacaaactgaccttatcccttccaagagcagcatagtgctgcaggccattacaagaaccatcctgaaaaaggaaaatgttattgtagttatgattaaacatggaagtgaatcttagcgaaaatcaaaactgtgttgcgagtagactgcatttagaaggattaaaacataaacaaatttaacaacacactagattttgctattctgtctaggaaattagtggtggaaaacagaatccagtgtgaggctggcaagtgagccatgtgcgagttttcactatcacatgaatgttattctccctctccaactggaaaaaaatatataatttactcaacaaactaaaaaagaaggaagcaatgttagacatcatttttaagtctgtttatcacgttgagtcaagtcagtataagaccaattcagcgaagtgagcaactagtcaaccaactacttgtggttcgaaagcagatatggaatgcctacaatatgcatgagatatgttagactgcatcagttacctacctagtcgaccaaccaattatgattaggaaataacttgcaacaatgattcaagtattggaaagttataactcacaacaaactctattaatacaaatagatgataacaactgagatgaaccataggaaatgggcgtgcagtgccatatgaaaaatgtatcagtagcaaaaaaaccatatttatgagaacaagagccccatcaaatgatcactacatagctatattgcataaataaggaatttaccaattgatcattgctctctaaagcaaatgagagaaagttaaggtacctgatgcacaggaatatgtgagatcatcgtttctggtgaggggcttcttaaagcttcagtgagatttatgcacacttgcaggcattggaatggatcctcagctccaagccaccatcgtttgccttcaagaggtctatcagctgagtcaaatatgtcctccaagtgattctccgtgaatgcaattcggccatcatacgataacttgtcaacaccaccagcatataaatttgctagatgtatctttagccagcgcaagcctgatttaccaagcggacgaccttctgcaaactccaaaactccacggcaaagatctgaacccaagtggttcaggtaaggatgcattggataagcacggcctctaaaatcaaggttgtgtggatagtagaaaccatcttcatccttcattttgcgagctacctgttaccaacatgagtattcattagatgaagcaatgaagtgagtaaatgatggttacccgttatagtctcttacggcaagttttagttctacatcacatctctgggagtgcctttcactattttccttcttggctgctctcaaggtccatctccatttcttcaacttgtcttcatcttctgtgtcaggcttctctggtaaagcaacctagagtacatgaaactttttagttgatatctaaaactaaagtatcttgataaaaccaccaccattgaatctgagtcacatgctcacagcattattatgagaataaatgacaactcacatcagtgcgatcgaccaagtcagcaagccggccaccacttgaccatattctgtcgacaatactaagaactcttttgttaaccctccacttggtgctcccaagagtatttaaggcctgtgaccaataatgcattaaatggttgaaccacaaaagctcctcttggcatttaggtggattatgatagatctcatttggtgcagctgttttagaggttttggtgtttaaaaattgcttttcttttaatcaaagctgcaaatgataatattattgtgttccgaaaaacagaactagggttcctgggaggagctggaggtgcgtccctgggggtggagaacgttgccgacagggtgcagaggccgagctggggaggaggctggcattgggtgcggtcaggggtggaacagtgggtggaggcgagcattgccagggtgagaaggtgggtggtgtcaatggcagttgcaaacagaggcgaacagccaatcatagtcatgagatgcagaggcaagcagaagcgagcagcatgtggaatgtatcgtggggatggggatttgggtgggggggagggggggttgtatttagggttatgacccagacacccagtacacttatggcaattcatgttaacagagtggatatgtagagtatagagaattttctcttcataaaaaggcatcaacatgtcaatgtccaagagcatatgaacaatagaagcaactgtaacataacaacaggtgtgctcaaatatcttatgattgtatcttaaaaattattaatataatttgcataaaaattatgagcaagttaaatgaatacctcaaacacagattgcatttgttcccttggagctcttctgacagcatctctctgttgtctagctccatgggtgcgcatcacataggatggtaaaaataaatgtgcacccttgtcatacctatagaatatttgcatgatgtcaatagagagcagtctgcttcatattcagagtgtcaatgcaacaatggcctcaccaaacagcaccaacttgcactgaactaatcagataggactagaaaaaaatatctcgactattaggtgcaataacatattatttaaaatataccacatatctaatttgttaaaatggatagtatagcagccaaagaactccaagaaacatagataagcaaaaggtaccaacccagtccaactgataggcggaattaacataggcatataaggtatgaccatatgctttgcctgtcaaaggaaaaacattattcatgaggaaatcaaggaatgcaagatcagaagagtcttttgacagaatcaagacgatagcagaaggatccactcactgttctatcaagcccttgccggaccagcggatcacacttgatcacaccatatcgccgactactcttcctgtttgattacaatgatgagttaggacgaaacaccaaactgcttttgtaaaagaagatataaaattagagttgccattattactgttgctctcttgccacagttctcatttcatgtgtgaaagcaggacggatatcaggtggaccatctgctgattggctagcaggtggttgtatgtaggctgtctcaatcataagctcaattaaacgactaccaacctaagcagcaagacatagaaactatcatcagtcaaaatagtgttgtaatgaaacattatattaaccagattcagcaagagacacgtacttttgcatgagcatcttgaccccatggcttggagttatcttgcttctttactatatttcttacttgccgtattttttgctttttcatcagatcagtgactttctttcttagacgctcttgttctttggcaatgtctgaatcacctccttcttcttcattatccatttctttattgctttttttctttgtcttctctagaaatttgtggattcgaacctatacaggaacaaagggcaaagacatatacatttattcattagcagcagcaatgttattgcataaattactgtcgccataattggtgcactggcaacaataatagtttagtcgaaacaaaatattgaaaattgaaaattaacatattctcaaaatatttaagaaaataatagacgaatgagagccaataaaggtataatttcatggcataactttgtttggacaatagttggaatttttttaactaaattggtgggttcagagggaaacatgaactagctagataatcaaagctctgcaagaatactaccaaattatatctgaaaaacacgaacactattctcagttatggtagaaaaaattctgcatatttgacaaatatttttacctgaggttatttgaaggagccccactgctagcaaagcacaattctaaggaactaaccaaatcatataggcttctgatgaggcctatattaggaggctcttgatctttatttcaaccatggttcaataatagttgaactcatacacacatacttctccaataatttcatacaaccatacgtctccaaaagaaaaataaattggtaatgcaatcatgataagctctaatgatgttaagcgctgaaaactgcaggaagaaatatatttaacttaatagtattgaaatatagaacattttgaattctgccagcgttcatcctaaaggtccaatggcctatggtcatatcatatctccgcacctaccgtggcatgtcgtgatgcgtgtaaaatattttgtgacccaaggactgatacccctgaattatgttttgttctcattcctaaaagctatcattaaccaataactattcttgaatggagcgcagagttgaaaagtaaaacaaacaagaagatacagaactcagccacagccgacaaacctcatgttctattgcctcgccgatctggcacgcagcctggatgactcggacacttccatcgccgctaccggtcatgagtagacccatgagcttgtgcatggtgatgacggccatcatatcagccgggagcatgttgaaatagcgggcatgggaggcccgcgcgccgcgctcacccacgagctcctgctcggcaatgatctggtctcgcagtggctcgaaccagccaagaaagagcgacttgacatagggcaggttgggcgccagcttctgctggcacatgtcagcaagcagctcgcggtactcctcggcggcctgctcccacgcctccgtctcaatctggatctgccgccggcgcagcatcgcatacttgtggtacccgaccccgtgcaccgccatagcctcggccgagtgctttccctctcccggacctcctcctatgcccctcctgccccgccgccggaaccgccatagcctcggccgagtgcttccctctcccggacctcctcctatgcccctcctgccccgccgccggagccggggcggagacgctcgggtccccgcgggcgatctccccgatcgcgtggtgcaactcgtcgacctcctcggaggagacggactcggcggcgacggcggcggaggaggacgcgaacccgggcagcgtctgcgacggcgcgagacgctgtgagccggcagggaggagaaggaggaggctccggtggagagggtggggcagcggggcggaggaggagaggagggcgaaggcgaggcggcgggcgggaaggcggcgccacatggggggcgctagggtttggcggcgggcggtaaggtggaggtggagaggaggagatggcgaacacgagattggtgcggtggccggagttggggaggagggcatcaacaggagggtggcggaggaaggggaatggcgccgcgccgccgccgccgccgccaacggaaggaggggggtgcggttgggggagccggtgtttggttcgatgcgggggctttcgcttaaaccctcgtggcacctgggtggttgatcttgaggggtttaggggctcagatttttttggccttctcatcttcgttaaacaacatgtaatattgtaattatacccttcttgcttcggatttgttacattctaacccctcaggcaagccaaacctcatctctggctctctgctgacaagtgacaaatgtggcttagttcaagatttcttaataatattattcatgaggtgattattttttttacgaaatttaaaatccaaacaacatcaaaagttttagaattttttttttgtccttttagatgagatcatgtagtgagcaagtagatcatgcgccaagcagtgattatattaggagatcaatcagtatacgatataatcgagtatatcgattgttggtagtggatgacaatcaaaacaattaggaatgtcaacgagctgatcagctcgaccgagccaggctacataggctcgagcttgagaaaagctcgagccaaatctataccaccttgagcttttaagtaggctcgctcaagttcagttcgagtatacaatacttcctccgtttcacaatataagtcattctagcattttccacattcatattgatactaatgaatctagataggtatatatgtctagattcattagcatcaatatgaatgtgggaaatgctagaatgacttacattgtgaaacggagggagtaatatttattttttataatatttttttataataaacaatagttttaggttaatcatattaaaaagtaaggacttgtcgacgtttgatgtcgcgattccggtatttgcacagtatggggatcgtttggtaccaggatatatgcgagattaaggtaaaagagacggagatgaggatttttatataggttcgggcccctgaattgtcaggtaatagccctacatcctgttggccgaagccgatcgttgctcttattcaccataatcacaccagtataatatttggagtagcctatctaactgttgtcgacaacagggtagtcttcctcctcgagttcgtgcccggcgagatcagagacagcgctagatccctatacccggcctctgtaggtaccggatagggtcagtccaggcatttctctgatgtcgatatccggcggtgtgtcttggcgtatattggcttgtatgttgatcttgtgtcttgatctattgttctgtgtcccctctcctcctagggggccttgtattttatacccataagtgtccccttgtccaagagtagtccttgtcgtttccatgtagaactctggttgtcttcccttctccggaactccctccatatccgaagtcagttttcgtataagacatggtatgtggtgggtcctgccgagatttagtcaactactattaggtatgtggtatccatatagttgtttatcacatgaatagataagtatttcagaaaaaaatacatgcaaaaggccaaaaatattgaaatgtatagactaacttttatgttattccaggatagagaaaaaaataactatataaaacttctagtatggccaatcattataactctttgagtccacaatggcattttcagtatttttgaaaaagtattcggccaaatggcatattgtaaaaagtatagaaatatcctgatggtaaattattgaactagagcaaacttaatgtgatagaatagattatctcttaattaaacatagaaaggttaaaaaaaataagtcaaaactaattaccttacacaatttatacagttcatgtcattcgaggaattaataagtaagtaatacacgattgatgaggctagatctgtctctaacactaacactaaatgttgaaattaaaactaagcaattagggacatggccatattctagtcttgaaaacggaaggagtaattatgaactgtgtgacctaagttcgacgacaacgctacggtgagaaagatgaagttgtggagatcgtggatcctcccggaatcaacttgacatcattataaggaaaaaaatccatcttgcctccctcaacctcaactgtagcctgagttcgctttacatcccttaactataaaaccaagagactacctcaactattaaaaccaatgcatagtagatagtttgcataatgatttcatccgacatggcactttgacttgttcatggtgatgagtcagtttataggacccacctttcactgaaccctattcatatctctccatccctctcattgccctctctgtgcatgtccaccaccacaacctgcacatcgggcatgttcgttaccgacttaccgtgatcccttacatcaccggcaaagcagcctccaccccaaaagccacacaagaccatatcgcctagagaggaagactatgataacgaggatgacatgccaccgccgccagtgcgcatgagcctagagtcctcgttgtgtcagtcatcgccatcccctcctccaacgtcgccactacctccgcccactgaaccaatcactacatgtcgcgttgggtctagggaaattcactggcggagcagacactgtggtcgtgcatgtcttcctaatctacttcttttcgattttgctatatatttgtcgataaattttcccccaaaaatttgacagatgtaattacagtacaatcgtagtgtaattacactgtaacttgcatgtaattacactgtaactatagtgtaacttgtatgtaactttcaaaaatctctccgtaacatgttatttcggtaaaatggaggtcgtgagaacaaattctttcatatatgtgtgtgctatgatttgttttt

SEQ ID NO: 10458 - DNA, 6096 bp, Oryza sativa
atttatcgacaaatatataggcagtcccacttcttttatatccggtacatgcaacatgctaattccaatttgcttgtgtacattttgatacccgtgcttgctaacatatctaattggagctttctggtttgtccccagccagctcagattgttgcctgatggaagcccatcctattgcatgaacactagctccatctcgcgcctctgagaactaccgcatggaacgctgcattgacatgggtgtgaggtggtagcgaggccaaccaacttcagatgaggaccgagactgacacctcttaagccactagatcgacgctgtggaggagcccactgctaggagccaaagtcgcctgctcggactgtgtcacgccctaaagttccccttgctagttttaaatttttgtttaataaatcgcttgaagaaattggttcaaattaacctagagctaattctttatttaataaatgcaatcaataatgggaaatggcattgtgggatttttcttgggttccacatgtcataatacattaacaggatttttagtggaattttcagagcctcgaaaataattttaacccatttaaaatcaattctaagcaatatttaagtccctggtaattcattttccattttctctttttcctcttattgggccgtcggcccactcctcccgcgccgccctcctccttgctgggccggcccacgtcccctccctcctccctccgggtcaccgacaggtggggcccacctgtcggccccttattcctcctctagccggcaaccgccgccgcctgccccaaccgccgctgccgcccacctcctccgccttccgcaccccactacacgccctccacgtcgccgcccaccttccccacacctcccgcaagtgcgcgcgcccgcaaatgccgcaaatggcgcgcgcgcccaccttccccaactctctctctctctctccacctctccatgtcgccggcaaattgggcccctccccggctacgtccgcctcccccttcgcctataaaacattcccccaagccccctctctctttttccgctctcgccgcatcctcccgtgctctctaccgccattgcgccgctctccccgagctccatcgccgccgcccatctccagccgcacgccgtcgccactagcgccctcgctgcgccgcaccaccaccgctgatagcttcgccgccgcggaagctacctcggccgccacctcccgtcgctgaaatcccaccggaaatcgtcttccccgccgccggtgagcccctccattttactcgccttcggccggtgttgccagttgccgcgaaccacctctctccctctgaatcctcttttttgctttcctaggtcactccggacgtcgtccacccgcttgcctcgccatccaccgcttgccggcgtcgttcgccgtcatctcttctcgcgccggccaacctcggtgagaaaccccccctctcctcctctccttcacccgtgcgcgtcgccgcctcctgtgcgcaccgccgccctcgcgccggtcgccgccgccaccttgccatggccggccggtcggctttgtgccaggccgcgccatgcctggccgccgccgcgccatctgatcggctcccggtcgatccggaccgttggtcccgtggaccggcgatggaccacccgtgtggtcccggtccacggtgaaccggcgctctatgagccgctgacatgcagggcccgcttgtcggtgccggcccccttggatgacgtcagccctgggtattattgcgcaataaatcaattaaggccttttctttattagttaaaacacagattatcttctaaaaatcataactaattcatccgagttccgattaagtccattcaagtctcaataaattcataaaaatgcatagaatccattaaaaatggttgtttcctgtttcagtagacttatagcatgttttgcttgtgtgcgttgtttgtcgcgtagattttggccgtttcgtcaatctgcggtttcttgaagacgttgctgtggtctcatcagtgcgagagcaaggcaagtcatacattacaattgatcatattgtacccaatttacaaatatcctgtattttctgctaaacgttgcattcttatacgatatcatgtgggatgggtcctattactcagctatatgttgtttcccttacgccattgataacgtgggtattaaaatgactagatgttggtttaggagatgcttagccgtgcttagttcaactagcacacaaatggggaatcacattaatgcatagactttgtttattggcatagttttggattagtgccaccgcaatggtgttagttaattaaaatacaccacatggtgggctgtgggtgcatggttttgctagtcgtgcccatggcgattaaggaccggttcgcgggaaaccctggaagaatttatcgtgcttaccacaagccagcgtgggcaacggctgggcttgtagtgtagctttcctctagctgacgtacccaggctagggtgggcgtgatggagttgggtcggcctgggtgtccggttgatcggcttccggattcaccgtggcacgagaggggattgcccactaccttacgaggagtgggggtgaaacctgaggtgtggtgcgattggttagagggggttatgcgaaggatcctgtcacggcctctttccggtatgacgtggtggcatgtcggcacacggaaacgtgtcatggggctatgtcttgtggatacggttgtacacctctgatcagagcaaaattattcgaatagtcgtgcccgccgttatgggcggtcaaccggatttaccgtgattagtctcacccctaattagctaatgaactggtgtagttcaggtggttggttgggcctgttgcaatgtggtgtagcgttggacagtggttggttaatattgattaattactacaactgttttactgctttcaactactgcttttaaatgcctgctttattgcaaatgaacctctagcctcctttggttatatcttgcatcataccttctcttccggtatgacttgctgagtacagtgggtagtactcagtcttgctctctctccccccccccccacaccagagttgaaattcttctcagttggagctgtctcgaagaagttggtttcgtcgcttccgataaggatgcctgtggaatggagtcgcccgctacaggagtcaagttttcaggcttaactcgcttttatcttttccgctgcatttgtaatcttttatatttttgtaagacgtggatctgtatgtcaacaattgtcgtttgtgtaccctggctggtcttggacagaggtttaatgcacattcaccttagaaattctggttcgtgaatttctgggtgtgacagaccgccactgcctacccctcattctgcacctccgtggcttgtcccaagcttgatgccacgacggagcatgaggggaggtgaggagttgttggagatcaaaagagatttggtgtattatttacatggtgtcctattgttattctttttctaatgattgtattgaaacatcagataaaaccactttgcaatgctaagggagttactttacactggttttgatagttgagagagtttctattttggctttttggttgagggacgtaaatcggactcaggctatagttgagggatgaaaaaaatggacttcctcctcattttaatgctttaggcccacctgtccagacaacaagatggctgaaatgggccttggaaggtgaaacccacatcaatttcaagctagtactagtcatatgcccgcactgctagtcccaatgggattgttcatagaatgtgtttgcttttgttgttttgtgctttggtgaagttcatcaaggctgtttaaactaatataaaagaagttatttttttaaaaaagagagataatacaaaagaaatagacgtgtggaacttttttattcatgaaaagaatgcggtactttactcttcttttatacttgataaatatcaaatctaccatggggaccatgttagcttcaattgttcattttgggggattagctcaagcagcgatgtaagtttttagttttgctgcatctaactatacttcccgaccatgacatgttgttctcagatagtgtcatctcgaccatgacatgttgtttgtccatgcaactgatctatttgtagtgtttacttctacttgattgtgattgatataatgtattgcattgttgggcaaagctttcataattttattggtgggtatctatcttttacttgaagtttgatatattaagaaaatatgatatattttagtcattgtattaccttgacaatacacatatgttcttgtttgtcccaaatgtgaagtgaaacgatttgctgatctaagttctgatgagacggtgaattatgggttattgtgaagaatgttgacgtacagctcttgcaataccataaaacatcttcactcacattttctattgaagtttggtgtatgctactaaattaagagtttgtttgttttttcatgattaatgttttactcgtatcactaagaggagtaccatattggttttgattgtagggggtctaaaatatgattatcttattgtgtgtgaaacaaagatatatttgtttcttttgatcaattgctctatctataccttttatatacctgttgtagaattttgtttcttattgtattctttggataaaaatatttagctatttgctcaccagtacaatgcttatcaggatggcccacaagctagtcaaacggttccacatgtccacatccatatcatcccagaaagaaaggagattttgagaaaaatggtgaaatatatgatgcggtttgtggcatagctctccaatcaatcttctcttatccaatatttcatcacacaatgcttaaccattgtctttccaatagatcgatgtcaaagaaagagaattaaatgagaagcttgatctagacatagagcgaaaagattggaccatggaagaagatggctcatgaggccaattacctatgttacctagatacggggatatagatacagatacgtgatacggggatacgaggatatggcactttttagaaaacaaggatacggagatacatctatatatatagaaatttaataaaatatagaaatttgatgaatttggaaatttaataaaaatacaaaaaaatgttgaacttctttaagaaaattagtccatgcatatttgtagctaaatcatgcttgcaaatgtataccagatcggtgagtactaagctagcacatgacctccaatatcccttctagtttgtagtcttgtatactatcaccgacgtccacacagcaaagaacaaagatagtataaattagtgtaagacaacaagaagtcctcaaaatcacaaaatataatgttctttcccttgcttgttttaccttgaacctccagccgcagtagcattaggaatagatgcagctagttaccaactctaaaatccatcaaatctatgaaatttggcattgtttgtcccaagaaaataagtgaggagaacatagatgaaacaagatgaattgttcgacggaagaaactcaacagccaatatcttactacctcattaggcatgaaagaagcaatcggccactggcgatagctttgcgccgagggaccacggcggcgcggcgcgcaacagtggaggcgtggagctggtacacctccagccgtccggcgccgaggccgttcactcgctttatggcagtggtggttcttttttttttttgctgtactcagctacgatggcgcgcggcatgctaggatcgatcgctgctctcgcgggatggagcgaaggatacgtacgggatacgtatcggagcgtattcgatacatattcgtatcccctcacgtatctgagacgaatacgtcgttttagggacatatcagggtatcctagccaatgagtactgtgcacttttcccttacatgcatttcttgtaacctgtctctaaattgcattggctctttcctagaaattctttgtaattgttgtcatctagcatgggaatccagtggtccttcaactgacattctgaattga

SEQ ID NO: 10459 - DNA, 839 bp, Oryza sativa
tgggacgacgatgatgttgagattgttcaagcggatacatcggccgaggttgcaatggccgatgcaacatttgagtggcgtcacggtaatattcaatgcttatcggggatggatctttctagctatgatttcattagtgtttctgatggcaaatttgtacctatttctgtaaagccggctaacatagcacgacaaggccatatcactttatgtaatgagtaaagaagctaatttagagtggttgcaaaaaagggtgcaagaatatcgatctacaaagaacgatattggtgaaactattgaagattttgacgaagtagaaaaggttggtcaagggtttacatcggccgatccattggaggaaatagacataggtgatggaactaagccaaggccgacttttgtaaacaaaaacatgacagccgattataaggttaaaataatcgagctacttaaggagtatgttgattgcttcgaatgagagtatcatgagatgccaggtcttagccgtggtcttgtcgaacatcagcttccaattaaaccgggttttaggccttataaacaagcaccttatcgtttcaatcctttgttatatgaccgggtcaaggaggagatttatcggttattgaaagcggggtttattaggccatgtcgttatgcggagtgggtatctagtatagtcccggtggagaagaaagggagtggtaagattagagtttgcatagactttagagatttaaataaagctactccaaaagatgaatatcctatgcctatagctgacataatgattaatgatacctcgggtcatcaggtgattagctttttggatggtaatgccg

SEQ ID NO: 10460 - DNA, 1104 bp, Oryza sativa
aaaaagaagccaattttacttgggggcaaaacaacaagaggcgtttgaggaattgacaaggtatttgtctactccacccgtggcgcgggcgcctaaagccggaataccgtttcggttatatattgcctccgaagacaaagtcattggtgctgttttgacacaagaggaagatggtaaggaatatatcattacatatccgtcttttgggactcggattcggtgacatcgctatggcatggcacagtgtgacattggagcaatctggagcgttgaaatctgatcgaacggtccgctgcgccggcccacctgcagcctccattttcacccccaagcgctccgtttcctgccgcccaatgcccaatcccgcggctcgcccaaatcccacacgcgcgctccagtcctgccgtcccgcacgcgcccggtcctgcggaggtcccaatcccgcaccggagcagggctgccggcagagttccaatcccgcgaaggtcccaatcccgcttggagcagggttgccggcgccggggaagtgcagcacgccaaccagccgaggccggggccagagcgcctgccccgccgtcgccaccggataggtgggaggcaggcgtgcccctcgccgtgattggggaggtaggccggccgccgtgaggccgggggccgaggcccctgccctgccgccaagatttcggggaggagggctgccagagtgagccaagcatctgcagaggaggattgcaagtgagtgttgtcacatttgacacaacttttggcacaaacaaagaatataggccattcggtgtttttcttgggctcaatcagtttagagaaaccactatttttggtgctgcacttctatttgatgaaacagaagcatcatttacatggttgtttgagacttttctacctgcacataatggaaagcaacctaaattaatgcattaccggtttatttaaattcccgcgtatcactgttttgttagccatggcctatttacctttgttatgacattattattgctattggtattattaccttgttcaccctagaataaacaaaaccccaactagggggtactctattcatggttcccctagtatgaatttagg

SEQ ID NO: 10461 - DNA, 5414 bp, Oryza sativa
aggtaggccggccgccgtgaggccgggggccgaggcccctgccctgccgccaagatttcggggaggagggctgccagagtgagccaagcatctgcagaggaggattgcaagtgagtgttgtcacatttgacacaacttttggcacaaacaaagaatataggccattcggtgtttttcttgggctcaatcagtttagagaaaccactatttttggtgctgcacttctatttgatgaaacagaagcatcatttacatggttgtttgagacttttctacctgcacataatggaaagcaacctaaaacaatttacacggatcaagatgcagcaataggaaaagccataaagatagtattcacagaatcatatcatggtctctgcacctttcacataatgcagaatgctgtgaagcatttatctccagtgaagggtaaagaggaagatgaaggtgaagaggaagacgaaggtgaagaggaatcgcatgttctctctgattttagtgcttgtatgtttggccatgaagatgaggcatcatttgaagaggcatttcagattatgagatccaaagttcataagcaaacatggttagatagcatttacaaggtgaaagagaaatgggctgaatgttatatgagagatgtcttaatgctatctgtgatgtctgaatgctccaagtttctatatggctgtttatcaacttctatatggctgtttatctctttctgtgttgtctcaatccatccaccaattatggggacatgctgtcaaatttttcagaaaataacatcacacaagttactgatttattcatccattgattcattcaaattacagcataggtcatacaaccaaaccaatctctcaattttcccaggtgttgctgctcacaaaaaaattacagaatcattctcccagcagcaatgacaacttccttatcaaccacaatggttaacacagtgcaacctcaacaaattattgtttcaggacaatgcacagcctaaggtaatcaggttcaggtacaccatgaagcagaaggacaaacagctaaactactgctgctgcaatcttggagatagagaacaaacacctaaacaacaattttggaaaacaaatagctaaacagcatgaaatcccatcgcctccatcggcaccccgacggccggctgcctccatcgccaaggatgacggtggcagggcagggccccggccctggcctcgcacggctgccgcctggtcccctccccacttgcggcggagcggcgccttgccggctcccatctagttcgcggcggcggccaaacgcgggcgagggaggcgaagcgacgacacggtcacccggtcccctccccactcgcggcggcacgacagcctggcgtctctccggcctggcgcggtggcgggctgacgtgggcacgggagacgaagtgacaaggcggctgccttgctctccgctggtcgccgtctgggacctttacgccggcagccctgctcccagctcgcgcggcggtggccgcctccctattcgcggcgacggcccggcgtccggtgcgggcgcgtgcgggccggcgggagtggagcgtgtggattaaggcgagccgcgggattggggcgtcgggcggcaggaacggagatcttgggttgaaaacggaggctgcaggtgggctggcgcagcggaccgttcgatcagatttcaacgctccagatttctccaatgtcacaccgtgccatgccatagcgatgttactgaatccgagtcccgtcttttggatgctgaaatgtggtatgtctttatagagagactttgtttatgtctatactatgcttgtaccaaattgcggcactatttgttatctagtatatgcatagttgcttgtcaagccgatgttattagacatatgttgcaaaggccaattctaagtgggtgaattggcaagtgggcatatgttttgattgaatatgatttggcttatgaaccgttgaaatctatgaaaggccaaattgtagtacattttatagtagaccatcatgtcgatattgcttatgatgaagagatttgcttagttgaagttataccttggaagatttattttgatggttcttcttgcaaatagggtcaagttataggtgtagttttattttcacctaatggcatgtgttatgaggcatcggttcgtttgaaatattattatacaaataatcaagctgagtatgatgctttattattcggcttacaagtgatggagatgattggagccaaacacatagaagcatttggtgattcggaattggtggtgcaacaagttgccggggcttacaaatgcttgtacggatcattaaataggtatcttgatcaatgcttggatattattgccaatttatataattttgctattagacatgttgctaggcgtgataattctagagcaaatgatttagtgatgaactctgagctccactcgagacactcaaggctgttgttggcccgatctttcggtgagttgtagataactacgatttgagagaaacgttgacgacctgactacaaccgtacacaacgttgttgtgttgtgccttagcgatcgatacacctctccgtgggttgttgatcttgccggtgcagatcaaccttattcctgcaaggaaatcgaataaacaagcaagaacaagataaaagcaatctgaattgcagataggaattgaatacaaatgataagttgggattccgtaacaggcaaaccagcgatctaaccgatcacgggattacacggcaaagtatcaaagctaaactttaatctaaacaaaacccaagaaatcttgaaggggtacctagctatttatggaggtgggaggatgaccaaggggaccctagggtcgtgctccaactgattggggcgcaccccacatgggccccacttaggccgggtcccaaacgaagttacaagcaatttggcccattataggtgacgtagcaccttatttctgcaatagcagcccactgagaaggaatttggcaatgaggttggatccgttggaaagatgactacgtgagctttccatcaagtactcatggacccaaaacggagctcgtatgcacatttggcggccatttgaattcaatacagtagcaggtggctgaattggattccaataattggaggacttgatcttgttatcatcttgttcatccatgatgtgagcaatggttgtatcaatggtagccatggtcacatcatcctccccttctccttcaaatcatcgagctcacaaaaatcatcaaactgaacatagcccgaattatttaaagaagatgtcaattctcgttcctctatttcattagcaatgtgaacgacatgcttaaaatcggcacacaaagaaacactagaaacaacatgtaagtgaagcattatcacacgactcttctttatcacaaggaacaacaagtaaatcaacttgtgacaaaggcatctcagcaattggttccactaatggctgctctactatagcatgaaaaatagacatgtgtagcttagcttgagaatactcacatttatttatctcagtaccatttaatttaccttgcaaactttcttcagacaccacaggtgcttcatcctctttcttctcaagtacaccattctccctcttttgttgaatgtgatgaattacctgcaaaatgttagtaacaggagagacaaaagattgctcctccaatgtttgcacatcatcattgcatcaggatataggagattcagaaataggagataaatcacattgttcatactttctcgcatttgatatgatctgactctcaatgctacgagcaaacatgaataggtgtccaatatgattatatttcacattagcaagcataacctgaacttcagaactaagccctttgaaaaatctacgcattgtgttttcattgcattcttttagaccactgtagataatgcaaactttgaattcatgaatgtactctcaccttgtgtttcagatgttctaatttctcatgaagaagacatttgtaataagaacttacaaaatgttttcttatcaaggttttgcattcatcccaagtttcaggtttgttactcacataactccaccaaaagagagcaggagaggtaaacttattactagcagccttaatcatttgagcatcagaaaaatcatatttatcaaattcattgtctactgctagctcccaatcaatataagcaacataatcgtatttaccattgtagaatggtaacttagattcaactcatgcaaaattatagtcaggtacctcatatgcatcttgtcgagaagttggcatctctcgtcgatggtgaagaagccgatgttgagcatgaccatctcgtatccccttgcgcaatcctggcatggttaatagcaaacaagaaacatacacaagaatatgcacgctcctatcaactactaggtagtggaagctccgatatcacacacactcaagctttttaccaagttcttaccaaagcaagcggaatggtgacgtacaccaactcggccaagcatcccaatggagtttggatgtatcgataccttggcaaacacttgctatacggctgcaatcaaatatgtggagctctgggtaggcttaaaatgtagcaaaggaatagcaaatgctcaaatcagataatacaaaattgaataatcattcaaagtcagtaccgtactggtcctaggctagaacgtactagagacgcgatcctagacacagacgataccacaagatagctccagaaacaactcaagcacactctgatatactaaagcaaactcaaatataagagctcatttttctcttttccatctttcttctttcttttttttcttttatttttcttttcttttatggtgcggcttttcatttctttttttatgcaccttcctgccttttttttctttctttttttgattttttttaccaaaaacagactcaaggacctcaatgtgatgttacagggactcaaacgtaaatataaaaatttacaaggactcaaatgcaaaagtccgaacccaaaattaaaattatacaaaaatggaatgctgaatttatactggttccatttttttcaaacggatctccaatccgacaatcgaaaacttgtcaccaagctctctagcaactcacggtgtagattgaaatcgagaggagagtggggagtcactcggcttgtagaggtggtgtgaagccgcacgcgagggggtgggaatcggctataaatttggaaatcacgcatggaaggaaacaaagtccagaaaccgatctgctatcctttctttctccttaaccgcacgcaacagcgatatgctatccttcctttctccttaaccgcgcgcaacagatcctcttccttgtgtgaacagaacaagcacaggcgaatgcag

SEQ ID NO: 10462 - DNA, 14871 bp, Oryza sativa
  unsure (1)..(14871): unsure at all n locations
cgctaagaccagcaacatgactcgacaatgcaacgcaaaactcaacaaagcaaaaactgaatgaacaatgcaatggcacaaatatggctaggtataggatgcaatttttttgtatggctattttctggtagtagtgttaacgaccaaatttgagaacactgagcaaaaaaaagctctgataccacctgatgaaccctgagctccactcgagagactcaaggctgttgttggcccgatctttcggtgagttgtagataactacgatttgagagaaacgttgacgacccaactacaaccgtactagacgttgttgtgttgcgccttagcgatcgatacacctatctgtgggttgttgatcttgccagtgcagatcaaccttattcctacaagcaaatcaaagaaacaagcaagaataagataaaagcaatctgaattgcatataggaattgaatacaaatgataagttgggattccgtaacgggcaaactggcgatctaaccgatcacgggattacacggcaaagtagcgaagctaaactttaatctaaacaaaacctaagaaacccagaatgggtacctagctatttatggaggtaggaggacaaccaaggggaccctagggtcatgctccacctggttggggcacaccccacatgggccccacttggcccattataggtgacgcaacaccttgtttctgcaattgcagcccactaagaaggaatttggcaatgagggtagatccgttggaaagacgactccgtgagctttctatcaagtactcatggacccaaaacggagctcgtatgcacatttggcggccatttgaattcagcacagtagcaggtggccgaattggattccaataattggaggacttgatcttgttatcatcttgtttatccatgatgtgagcaatggttttatcaatgatagccatggtcacatcatttagcatggcaagcatatggttataatgtgaagaagggagtattttttatattagaagaaccggtgcttgatttcaaacctttgggtgaaattggcaaaaatgcagaccgggggcggtctaacctgcgttgcacggctggtctgaccggtgactaggggtggtctgaccggccgtatgccgccggtctgaccggccaacccgggcggtctgaccggccgtatgccgccggtctgaccgattctagacagaaggttggggggcacgtcccgattgattcaaaggccgaaaaaataaaaattggggacatttgtgcccaggatacagaagaggattggagaattcctttaattaaatatttgaaagaccctacacttaaggttgatcggaagatttggcggcaaatgtttaaatatacattgcttgatgaggatttatatcgccgaaatatagatggggtgcagttgaagtgcttagataatgatcaatctaaagtggctatgggagaggtgcatgaaggaatttatggaactcatcaatcggcccataagatgaattggttgcttagaagagcggggttctattggccgaggatgattgaagattgtttcaaatattataggggatgtgaggcttgtcaacggttcggcaatgttcaattggtgcctgccgccgtgtgaatcctactatcaaaccatggccgttccgaggttgggctatggatttcattggtcaaatttatccttcgtcatcaaaggggcataggttcgttgtagttgcaacggattacttcaccaagtgggcccaagccgtgccgctcaagaatatgattcatacggaggtaattgtctttattttgaagcttattatccatagattcggtatcccgcaaacattgactacgaatcaaggagcttcttttatgtctaaggaagtgaagagttttgccgaattttatggtataacattgttgagttcttctccttactacgctcaggctaatggacaagccgagtcgagtaacaagacgttgtcgaagatagtcaaaaagaagattgaggaacacccaaagaagtggcatgaagtgctttctgaagcattgtgggcgcataggatatctaaacatggtgccactaaagtcactccttttgaattggtttatagtcaagaagctgttttgccggttaaggtaaatcttggctctcttcggtatatcaagcaagatgatttatcaagtgaagattacaagaatttgatgggagacaatcttgatgaagtcatcgacaagcgtttgaaggctttggaagagatagagaaagagaagaagaggatggccaaggcatacaacaaaagggtgaaagcaaagttgtttcaagttggagaattggtttggaagacaattttgcctttgggtactcgatccagggagtttggtaagtggtctcctagttgggagggtccttttcgagtatgcgacattgttcgagggaacacatatttttagagacacttcaagcagagcgttttcagcgagcaatcaacagaaaatacttgaagaaatacttcccgagtgtttggcaagacacttaggaggttctatggccagtaattggattatcaccctaagaccaaaacatgttctatggttttagattcacgccattcaccaaaacatgttctatggttttagattcacacccaaattcggcacccagggataaaatatggaaaattgccaaagtttggatgtctgacggttttcctctagttggaccggtctgactgcggtgtataggccggtctgaccgccgaaagtgggccggtcagaccggcggtgtgtggccagtctgacctgtagagtccgagtccgggactgtttcatcgggtctcaaggtttgtgggcccccggctttacacaccagaaaccccatgtgtcttacaataccatttcctagatcagtagatggtacacatatggcacagttgtatatcacaagctgacatcgttatatagtttgaactatacattaatagtacaagggtagcccaaatgggatccaaatagaccgagcatggtcatgtactttgcaaaataccaaaagaagtagatgagatagcggaagcgaagcagcggcggtccaacgtactccacaagcatcgactggtgaacctaggtcccgactccaccggcttcgatatctcttcatcaacattgttcccgtatggtcgactccaactcctttctaaaagatttagttaagcaagggtgagtaccaaccgtactcagcaagccaccactacagaatgcatttagtgcacacagaggttcaaggatggcttggtttatttgcataaagcaagatttcataaatcatttcacaaacctatgactgagcagttttaactgaaaacaacgataagttgaagttatcattaatccgcaagggttcatccaccttccccaagcctcgtttggtccggtttaccctcgcatctagttttccatattcccaacatcatcatcatgaccttcctgcccatcgggcaagatcacaccacttaatctaagcaagattaaaatctatgagactagtcaagtgtagtacaagtcccggcgctcaataaccgcgagcacggctattcgaatatatttgatttactcacactgcagtggatgtacgcttttaatcccacactccgcgacttgcccaacacatgagcctagtcccaacacatgagactttccacgatccggtatttcagtcaccctcgcgtttcggcacccgctccaaggactatgtacctccattgcacccttggcacaacacaccacctcaagccggcggtgaggagagtcctggcgcccctgggatcacaatgggttatattacatataggttaggtccattttagatttctgatgtcataaaccaatccacatcccttcaccttatctcacatcacacttcagaaccaccatgacaggggtgccgtgctatagctgccttcatagctaagtcttcaccagttattatgtttgtgggctctacaccttccatagcctctagaaatgcttgaaacaaccatacaaaggtttctgtcttttcattccttagaaatccacaacccagctaaatatccaaaaaaaaaatacacataaggaagtcatcatagtttggaagtaagttactacaatttgcatagtctgtacagtttgtttttgctggaagtaaatcagtacaattttgaactatagaacagacactaaaagatgtaacttgtaaacttagttacttttttttcttttttttagaaaaaaatgtaacttcacatgctactggaagtaacttttatcaggacttgatgtaactcaatgaatccaacaactaacttaaggtgtactataatgtacaaagttattacagattttttagatttactttttttgcaaaacaaggagtacctgaattgattgcccatgtctgtttatcccaatgaatggtgcacaaggcatgttatacatgttcgtcatgtatgtgcagtcaaacgagatgcaatctttgtagtctttgtaggcatttcttgctgctccatcaacccaaaatatgttctgcaccctgtcttccttattaagttgaatcttgtagaagaaatttgggtcatcctttttgatttcctcgaagtgagcaattgtttgaggcatatctctacacctatacttgctccccatctttgacttgaaattgcttatgtcttttctagtgtagggtacattcctagcccctccatacaattctgacatcaattgcataattctaccagttgagagattaactccgtgcaacattgtgatgaaatctttttcctttttcggtattgctctatgtgaccttagaaatttcttaagtgaaaactttctaaccagaggatgtgtgtgttcttcaacaaactgaattacttcccacctagttcctttcctcttcactgtcatccttactttgcaggcagcctgtcttgttttacttcttttccttttctttggagggcacgcttgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggattctttttctttaactgaggttgattgattagtgcaagaatgagcatatgacatactcaacaagccacacagcaaatatgcaagtgcacgaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaagtaccaccacggcactgcaaagggggaaatcgtgacaataccctttgcacaacacaactcaaaacagtgcaccgttcctggatcataatcaccccctcaaaaaccagaggcatggactccccagcgacccccgtgggcttatctccgccacttctcagtctggtgctccgcaatgaatcatgctatacaaaagataaagccgttgcccacgctggcttgtggttggcacggttaaagtttcacaacagtagctcgcgaaccggtccttaattttcatgagcacgactctcaaaaccatgtgctcacaacccaccattatcaagttttagttggcaagtaattaattaaccaatcacgattaaccatcgtgaactatcattaagccatcattaaataataatgcgtcataagttatcccaatagtgtgctaatgtttctaagcatggctaagcaatcacatctaatatctagctgaaccaatatgtaaagctcaactagtcaagttataaaaacccaaggtatcaaggaataaagtaatcaatgcaaacagcccataacaaaggaatagattcactccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcataattttagatgaattatgagtcttgaacggcctcattctgacttcaaatgaatttattatgaattttacaagattaaatctatttaaagcccatttaaaaagaattaaataaatttaattcaatttatggacaattttaaaatgtagatctttattttatataacttttgcaacttgaaccacattaaactgagttacaatgaattagttatgtatttttaaagattaaaccggattaaagcatttatatggattttaattgaattatgacgcaataatgaattatttttgaaaagaaaaagaggattattgcgtcagcggctagggtttgcggtggaccgggtgcacggcggcggttcacgagaacggacggccgagatcgatccatccaaaacggacggccgagatcgatcggtccacgaccgggccaccgggaacggcaacgatgacgtcagcaccggcggcggctcggcaacgcatgctcgccggcgaacgacggcgcggcgacgcgaacggagggcaccaggacgatgcgggcattgcggcaaactcaccggtgaccaatgaagcggcggaggagcaacggacggcgccggcgacgaggaagaaacggcggcggtcttcgggtcgacggtgacggcggtgctccggcggtcttcggcggcggcgaagcggcggacgaggacggcgacgacttggcgaccacgatggcgacctccccgagcgacgacgacgaccggaacggcggcggcgcacggctggagcgacggcgacgacggcggcacaagatctcacggcgctagggcgcttccgacggcgagagacgaaggcgagggtggcgacgggtagaggagacacaggggatccttttataggggcaaggaggcggcggcgaaggcccacggctgccggcgacgagaaggaaaggtcggggtttggaggaaagagaccgatccgaatcgacctcgaatccacgaatttccaaacgattttagccggtgattccaaaagagaaaaggtggaggagatcgagaagatcatttcccctctatcaatttcaccggagaaggaaaggatcgagcggattggaaagcggcagcagcgcgactcggctagggttccgggcagcggcggcggcgcgaggaagacgaacctgacaggtgggacccacctgtcagcgacagagagagagaggagagcggcagctcggcggactgggccgacttgggccgagggagagagagaagagaggttttgggccgactttcggcccaaagccaaaagaagacttttaaaaacctttttcaatttacattattcatgaaatgcaattccatttattaaaaatacttccttggctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaaaaatttataatttaaggatttttaaacaagaaaagcacttaacaattataattaatgataaaataattattgaactgttctttgtatcatttaggaattgaggtctgaaaaatccgagaaaattttagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacaaaaatcaggatgtgataacgcttcacccgttttttcttctggaccacatttgttgcaaacaaacattactttgtcacgttctccatctttggctgacttccttgaagtgttgattttgattgaaaatccaacgcactttgcatacctgttatagtgagcccttgcttcctcctctgagttgaaagtcaaggtgaggtatggcacttgtgtgctgcacaaaaaatcctgtgatggcgctgactgtgcttctgaatcatctgtgccagagtgttcacttgaaattgtgttggcagtagcagttgttgcgccagttgcaacactagtatgcattgtgtctgcatgatctgacatttcttcaaatagttgcatctcatcattggcttcaaatacttgcatctgatcattggttgcaaatacctgcatctcatcattggcttcaaatacttgcatctgatcattggttgcaaatacttgcatctcatcattggctacattgtgtgctcgtaaacttccagcatcatcagcagtatacatagtttcaaagtcaaaagtgttgtccaaatttatagtaggaatctccatgctagtgtcagttggatttacagggaattatgtttcacttctgtcttcatcatcaattagtaaatgatgtagtggatgttcattttcaccagaaactaattccgggatactgttgaggtcaaaatccatttttgctgcatgtgtttcagactattagtaagtttatacagagcattcattgaggtaattcagtaattggggggagaagtaacttgcacatcacatgaaagtaaagcttttatttttttcagaggagtaattttgtcagacaattacatctgtggtatagaaaattacttgcatgttttagagggagtaacatttatatgttttgaagtaagccagtacagtttggaagtaagttacatgcaacaggatagcaactcttataactggactcgatgtaattaaataacctatacaaacatttctgtcttttttagatgctttctaggaagcaattttgtcaaattgagaccagtggctatactaattgaaagtgcatctaggcccctaatgattttgatgattgattacaatgcgattagagaggactaacatttttattcaagcaaatgtgaaggttgttaagtcctcaacatgttgtaatacaatgcatatcccgtgaatgcgacatcgcgatgcaatgcggcaatgatcaaatggtatattgtatctttttcctcgcattgtgtcgtaggaaagccgtactattaagggggatgatgcatagacatataaggagtgatgcgtgtgctcaaaatcaatttttcttcgaagcatttctcttttggagtgttctggaaatttttggaaggtccgaaaatagttttcggaagttccgaaaatagttttcggaagttccgaaaatacacagaattgtgtttgagtgttctagaaattttcagaagtttcgaaaatagttttcggaagttccgaaaatacacagaaccgtgtttgagcgttctggaaattttcggaagttccaaaaatcattttcggaagttccgaaaatacacagaaccgtttgagagctttctggaaattttcagaagttccgaaaatgatttttggaagtttcgaaaatacacagaagcgttctggaaattttcggaagtactttcggaagtattttcggaagttccgaaaatgggcgttgacttcgatttttctcagatctggaattttcggaagttccgaaaattgtttcggaagttccgaaaatcccttttattgcactccaacgggcagatcttgtgagggctgctggttccattccaattatttgtgcccttggcttgctctctctctctctctctcattcatttgagccttgcttcctcgattcatctctccacccgtgtttgatttggatttggtgtgtgtgtgagagtgtggattcgagcttgtgtgggtgcttcttgtggtctttgtgaagatttgtgagcacttgcatcatctccgggagttctttgcatcatcttttactcttggaggttgaggactcctagacggctaggtgtcactcccgagccatcgatctacttgtggttggccgggagaagtttgtgaaggccggatctcgcctccgcaagagaagagatacctcttagtgaaaggagaagtgcttagtgcaacctcttgaggaaagggttagctaagacccggctcttagtgagctcctcaacggagagtagaatcccctcaaggatttgaactccggggaacaactttgggagctacatcttggtgatatttcttcatccctctcctctagctttgcttgcttgtgctgttattggtctagttgctgattgtgccttgtatttcctgttatagtcttatagatctagagttttcattttttgtgtgcgctgctctgtgcattttcggaagttccgaaaatcatttcggaatttccaaaaattcctagcctagctccgaaaattactgcttccgcatttcttaagttttaaattagcctattcacccccctctaggcctaattgaccctttcaattggtatcagagcctaatctcctaattaggcttaactgcttggagagatcttgtcaggccaagcgggggatgggaacgatggtgataagggagctaagatcccttatgactatccctctacatctacatcttttgtgagtacctatagcggcaaagctccgtacttcaatggtacggactatgccgcttggaaacataagatgaagatgcatttgaagtctattaacccatctatttggagaatagtcgaaaaaggctatgttttgcagaatcccgaagatcccaccaaggaggacgacgagaacgagcacaagaacgttcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggtaatttgagagatttgtgatgttggatggtgagagcccaagcgacatgtacgaccggttgagcaagatcgtcaatgagatcaagggacttggctccaaggacatgaccgatgaggttgtggtcaagaagatggttcgagcaatcactccaaggaactctaacttggtgaccatcattcgtgagcgtccggactacaagactctcacacctcacgatttgctcggacgcatctttgcccatgacatgctcgtacaagagtccaaggatgtcatccaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaaattcggcaagttcatgaggcgaagcggcttcttcaagggaggattttccaagcactactccaacaagtcaagtggaagacactctgcaagagtgtgctacgtgtgcaaagagcccgggcacttcatcgcggattgcccccacctcaaggatggttcccacatcaaggaagataagaagaagagtgagaagaaggatgagaagaaggagaagcacaagcatagcaagagggaacattatggccaatctcaccttgggatgatctttggctccgactccgagtcaagctcaagtgatgaagaaggagtcgccacgttcgccgtcaagccttcatcaccaccgagactctttgactactcaagtgatgaggatgctccggtttgcctcatggcaaaggagcctaaggtaccttctcctcttaagtcatttaatgttgatcttgttagtgatgaggaggatgaggttgaggatgagattatggatgacgaattgttcaagtccataactaaggaatccctaccacacttgagtgagttgcttgggagaattgaggaccaatatgcaattcttgagaggcaagagactttgctcattcgtgagaaagagcggtctcatgaactcaagagtgagcttgttaaggagagagagaaaaatgaggcattggtacggctttacaagcaaaccaaagagtctcatgctaatcttgatgtggcgaacgctcaacttcaagagagagtggatggcttggacaaagcatacctcactcttgaagaaaagttcgaaaccttaaagaatagtgtctctctccctagcgagccatcttgttccaaaattgtcccaagcaatgaaccatgtgtgagatgcaaagatattgatattaacgcttgtgctactaactctattgccttgagtggtttgcaaaagcaaaatgagaagcttacgggactccttcacaatggcctacttaagtgctatatgggtagtaaggccctaaatgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaaagattgagcaagagtgagtacaaccacagtactcagcaagccacaccggagatgcataattaatgcaagggagtacaaggggataataatataggggttaagttttgcagtaaacagcatttaaaagtcacttacttgcccaaagctattttgtaaacacgatcctagagctatacaatattattaatcaaggccatgaacccacacgaacctgccttaacccaaggcctacgatgattcagaccgaactggcaacccgaccttgggtcccagctcgtcccaagccaacccaggccaaccattccacattttagttgttaagcaaattttaagaattaaaacactgacttgggtacattgctcggcttgcccatacccgtgggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagtctgagctacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtacccactagttggggttttgtttattctagggtgaacaaggtaataataccaatagcaataataatgtcataacaaaggtaaataggcatggctaaacaaaacagtgataacgcgggaatttaaataaagcggtaatgcattaatttaaatcaaaataattttataaactgagattcaatatgctcaaggatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10463 - DNA, 35729 bp, Oryza sativa
acctccatccaccaacatcctagagaccggcttcccatcaatatgacctttgagataaataggcttcatatgacagtttgactcatcgggcttctcaaaaaccgcatctttaggacctagtgaaaattgagcaacttcggcttcatccatagcacaaaaatccataggcaacatacacatcatgttgacatccatgtcttcctttggatatgattcatcaaccgattgttcttcctcctccttttgcacaacaaccaattcttcaatatctatggacttacgcctccacatctttgtaggcggtggtcgcaactcattgaaccttctatctctttgctcttcggcctctctctctctctcttaattcttgggcctgaagacgttgcaacctcctcttttgagcagctgtcaaatccttaggcatccaccttagtttcggctctgttccagaaggtaaataatgcccacttttgattttactcgaagacgatgaaacccccgaactaccctttgaaattctcccatcaaaccggcgctgaagcccggtcagaccggccagaaggcccggtcagaccggcctgcgacaggcggtcagaccggcctgaaggcccagtcagaccggcctaagaggttggtcagaccggctgactgcgatgagttggttctggcttcgaatttgttgcttgaagactctccaacctcatgtccagaaggtattagcacatcatgagaccccactttgatagtaatcacttctgaagtccttgtctccaccttgatgcgctttccttccctctttccttcattgacctgatttttagcataaaactaaccattatttggtgaagataaacgctcacgagctggcctccttggtcctccccatccttggttgtattacattggaggcatatgattgaacattggcggtattgccccccatggcacgtagtaaggaaaaggataacccggcggcggcattggataaggcccccatgacatgtcttgagaacgatgatatgtaggtgattccgaacgtcttggtgaatgaccaaatcgctccctaggagatgatcttggtctctttcctttattgcgagttttctcaccaccttgcttctcatacttgttcaaaagcataatgaaggtcatcttagtcttcttaggagctttggaacttgaagcctcactcctattctccttccaaacaccaacttctggattctttggcacaatcatctttggcataggctcttcactgaccattcctttccccttagtagattcggcttgcttcggccaaatcaacaccttcttatcattgaaattaattgtattcgccggaaaagcatcatgatcaagcttcatcttggaaccatcggaaaatttcaatcgttcttcatctatggccgattgaacctatcgtcgaaacacatagcaatcattgtagaatgagaacgagaatcaatttgtttttcttgtaaaagataatcaaaaatcttatcacatttggccacatcaaagctatacttaatctcactttgtcgatctttacaaggagtcggcattaaattagaacaaacaaaaggcttatttttattagttcatgaccactcggcaacatacatatcatgatcaccctcattattagaatcactagcttcagggtaatcaatcaaattaacatatgatctaacaaatttcttactatctttaattcggctttcctgagccggagctttttccatgagttgactaacatcaagaaattgttggccaactaatctttccttaataggagcaattaaaccattaaaagcaagatcagccaaatctctatcagttatattcaagctataacatcggtttctaacatccctaaatcccttaccataatcaatgacagattcattgtatttttgcctaaccgatgtcaaatcacttagcctaagttcagtttcacccttatagaaataatcataaaatctttgctctaattgaggccaagtatgaatagaatttaccggtaaagaactaaaccatgtaaaagcagtaccggacaaagaaaaagaaaacaagcgcaattaaaaagtatcggaactactagcctctccacattgcgctaagaattgacctacatgctcccacgtggtcctactatcctcaccactaaatttggtaaatttgggaactctatacccatgaggatataggatattgtcatagtaatcaggaggaggcttttggtaaaccttagcaggattcccagcttcaatcccgaatttatccctaatgataccactaattaattcctctatattctcaagcctatgctggtttggtggtgggtttggtggtctaataggttgtgtttgcggcgcaatataattatattagctatatctagtatcgggaggacatcccctagtaggatcgttgtaagcattagggatatgtgggggaatttggggactaacagtagatacggggggattaggtgctggaatatggtataaaaacccattgtttgtcattggatctaccccctgtataggaataattgcgccggtctgaccggtctaggacccagtctgaccggcgtccagaggcgcggtcagactggtctgaccgccaggataaaacccggtctgaccagccgttggcccggttgaatcggctgtgtgcgtagcccacccttcgcaggttgtttgcatattcgctccatcggttttactatatatttgatctacaggaggcttgctagtactggtagaggctttatctttgaatacaaaatcggctatgacagaaccgagtttgttccttatataatcatcaaaacgagattcaatagatgcatctaatttagtatttaaagtagcaatggatgaatctattgtactcgctatttgttgttggatagaagttgatacctcttcagtacttaccacatcgaaattaggtttaggcaaccatcccggcttgagaaccacaccttgacgggtcctagtgcacgtcttcatcaacatttcctgggtatacgccttgagatgttcctccatggccttgagtgctccctcatcaagctccttcaatgtgattggtatgacattggatggttccacctccgccttagttgatggaggctttgttatggcgacgtcaaagctgagatgacgttgagcagatttccccagtggagtcacaaaaaatcgtgttggcaactttttgtgacaagttgacaaacatgatcacagcacctaaagctttgcggtgatagtagagtcgccaaccacctcaatctagtcaaagctaaatcaagatgggttttgataactaaaccggcttgcagagccaattctaaatagaacgatagataactacccatctcgtgggaaaaacggaaggttttcaggacaaacttaaaaagaggtgtcgcactttcgcagcggcggcggacgatttacagcgcaaatcgacaaagatggacaaactaagcaaaaaactaaaagcaatatgaaaaacgattcgattgattgtttgtagaatgaaccggccatgtcccttatataggggttggtcttgccctctacaggccctcctccacgtccaactagggatagaatccaaaggaaacccgaaacatgccttcccgagtaaggaaacctcgagacccgatgaaacagtcccagactcagactctgccggtcagaccggccacacactgccggtctgaccggcctatacatggcggtcaaaccggcccaaccagagaaaaaccggcagacttccaaactggtaattttccctattttatcccttggtgccaaatttgggggtaaacaccttctttcctctcttcccctgattccccgtccaaatctctctatacagcttctctccttggtcatccatgcccaaccttattcatcgggggggatttacaattatgacactgcaaacattaacttttgctataatgacactggacccacatttttatagacacagatggacccatttatcatccactcggagtgtcaaaacagcgaagccccaatgtttgcagtcctagctcctctcccatcgatgccgtcgtcggctgctgctcccaacgacgacgacgccaaccgaaaatcccaggttgggaattccccaaccccagcgcccttgagtgaagcatggctcgcaccagctgtgtctccccaagctcctcctctctgatccccttctctacctacttctgtaatgtgatttgaatggtgttcttctgtgtggtaacatgctgtgaatttttattcttgaactagtcctaatgaccaactagatagtgttatactcaggattatactgctggctctagggttctaaatcaattgatttactatagttggatgatgactatatgccatggatgaatacatggatgcatgctcaaatgaatcaaggatgtgtatttattttttttagtacagatattaatatcataataacaggattgatccttttatatacttatgcaatggttatcaagatattgaattttttttacatgctactgcactagagaatcagatccttatgtccttgtgctgagtagtaattcagataattaatatgaattcctgtataccaaatgcatcatagtaatataactaaagtgatcaaatgacaaaaaaaaattatgaatcttgattttgatatcaaaatgtactgattacttaagtaacttgtaattaattgtgttctatggtattggtcttagcaaggttatgttgatcacctaccatcgttctaaaactgatatatgttcttctaggacttgtgataaagactcgtagattcctgcatatgtatctgcacctaaactaaatatgtacgtttacacttgctatccatattaattctgcagattcggtattacttatatgaagaactaaatacattggttgatttttgaaacagtttcagttcactgtgggataaaatttgtacaaaactacactgatgaaagctaatagatgcatgccctagtctaaatatcatttactctaactaccctgttataagtaaatatacctactctgttattataccatatattcagaataattcttgtactgaacatgctgctacatgttctactggatactaatataaactacttatttctctaaagtattattggaactagagtctgatttgtttaggttataactaattctaattaaatatgcacatgtcaatgttatgccctgtttagatgactagaatctgaaagcttataagttacatgcatgatttggttcttctatatatgctctattcctaaataatttatgtcatgaacactagttgattttattaaaaaattatagctacagacgcttattgttactattcagatttcttctatgataatttatatatgtcaggatttaaagacatgaacttatctttaactttatcatcaacttttgttacttttattcatttagaattgctaaggttttaggtcaggatggatggtatatatctgcatgaaactctagctctaacaaatgctgttactataaatgcaggatctactctcctcccctattttagtttttggttacctctgatgattctacagtgattgaaaaatgtgtggttcagctcctccttcagaaatccaagtcttctcttctactgctgctcttttagatctaaggtgattttgctagaactgagcttctccaccttgagcttggttgattgttccccttcttgaactgaaccccctactctacttggaactcaggtaattctcctccttggctcttaccctactggtaatgcttgactacttcctgacatctttcttgatctgctactggtgattctcttcctcctcttgagactgatcctcttgcttgatttttcgctccatcttgcttcttgacctaagtttcatctcctcctatagttggagttcatccaagaactgaacacctctacttttcctttagatttggttcaccgctctctgattgcttggccatggttactactactgttggttcatgtattggtttgagctggacttcagttgagctatttctctctgggtggagctaacactctagctgattttcctatagcttggttctatggttgtaactactactgccgcagctgctgcttgtgttgttttgcacgaccaaaacgagacttgggttggaaatgattcacacaaattattttatccctggtggatcttgtactggtgattcacctgcttgcatggctattcccattctgtacctgtgacacctcaacatggcttgtgttggcaacttttttgacaagttgacaagcacgatcgcagcactttaagccttgcggtgatcctagagtcgccaaccacctcgatctagcaaagagctaaacctagatgggttttgtaaagatggacaaactaagagaaaaactaaaagcaatatgaaaaacgattcgattgattgatagtagattgatttttacaatgaaccggccatgtcccttatataggggttggtcttgccctctacaggccctcctccacgtccaactcggggtagaaaccaaaggaaacccgaaacatgccttcccgagcaaggaaacttcgagacccgacgaaacagagtcggactcggacctgccggtcagaccggccacacaccgccggtctgaccggccctcaaccggcggtctgaccgcccaacacacagcggttagaccggcccacttcggaggaaaccggtagactttcaaattttggtaatattttctattttaatcctaggtatcaaatttaggtgtaaacagcttgttcggtggaataaccagacctatttgttaatttccctaattattggagaattggtagtctgatgtgtttgatcttttgcacttgaatccctcaagtatggtaaaattgtaaattactacaaatttagggactgatatgcaattgccctagagcttaagagtttttctgaaaaataaataattattgaatctttgactgagatgattcagtttatgataatctataagcaccatgtatatgcacaatatatgtgatgcatgctgtataagatttctattgtacaattatatgcatatatgtatgcagacctgtcgtggtaaattgtaaataaagaattgtgatttctactgtgcacatgtgtacctcgtgacaactaatctacgctacaaaactaaattatcccactcctcaccaggtttactctaactataaataaatcaatgatccatatggatatggacgacttgataaataaatgacaaggaaacgatcaaaaaattatttgatccataatagaacaacaatcaacatatttataggtcctagccagcatcgtggctccatcgacaccgctctcaactagtgtgaccaagtcattagcgtgaccaggactacagctaaaacccgggatgttatagtatgaggaataagagatggaccaaaattagcaaatacatatgtatcgggtcgggcatggattatctgctggcaaaaaacaatacccggctactcccgctatgttctcgagtctcggacgggcatgctcacgggaaaaaaattacacccatgcccgtgcccatcaggccgggtatctaaggatatctggacccgtgtatgtctaatagcaaaccttcttagatatatgtttatatagtatcctaataagcccctacattaataagattagccatgtggtgtcctttttccttcctccacacgcaccagataagttcatgcaccaaaacgagcattttacaaattcgtcaactagattgcacctcgtgtaccagcgatgcaatttactattcatttatttatagcttgacaaatctattgatctggttttgctgataatattaattgtatgaatcatttttatttagataaaatatatatttttttaaaattactagtacgacacaaacacttacaacgcacgtacactcacctgtatgaacgcacgcacgcaaactaggaataaaaatagaatggatatagtgttcgtagaaaaagataaaaaaaccgagcaatgatataagggttagaaatatataaaattcatcacttccatgataaaggataattaaagtagagaccaaatttataaatattacatatcttagtatactcgctacacgtatgcacgtcacatcctaatcaatatcagttcataaaattaacattgtcaagctattttggtccttgttcgcacgaactagataaattcatgtatcaaaactatcatttcacaagtttatacagtaagttacaccgagcatcaccaacagtctacctatatgattcccaaaactaattttgagagattttagtccaaaagtcagctccaacagatctcctacgcttctacccgagttttggagttcccttcccccggttcctcgctccgtttatatgcgggcgcgaaagtcgctcccaatcacgcaatcccgcctctctccttcgttcccacgcgtgggagatagcgatctttctgcgcgtgaaagaaaaaaaacggaattttctcttggtagtttaacgtaagggcccacttttaagttttgaagattgaatttaggctatctcttgaagagaggagttttttcacttcttattttcagtttaggaaaccaaaaataaatttttaggagaaaattatagataatctgttgatgatgctctaaacagtactatcaatgcaatttactcgtaaatgaacaaaccctatgtctcacaaaattttcttcccaaaaggcctacaggaacgcgctagctcttgattctggagcgattcccgcagcctaaccagaagccccatccaatccaggtcgaccagcgcggcggatccagagccgtagctcctcggagtccctgtctctgtggacgctctcaccctaatccgacgccgggcctctccgatcttccttcgccttgtgctgtggcttctcttccccctctatatatccctatcagcgagatgctccactcatggcggcatctacaacgggcttcccggtgagttcttccgtttccctacttctgtagctcgttctgctgattttttttcttttgaatctggattgggcgaactatgaatctagagtgtttaaaatcaaattcggacaaagttttcttaattccacattaaatctaaccggaagaaaaattgaaattgatatatattcgaagaaattaagttctcaatctgatacatcagcttatttaggtttacaattatttatttagcaggcttcatttgtagagtagaaagagattactgctgcgaaggttgtagcggtgctcgacggggaggcctcgccctccccggagccgtggtgtaagaaaggaaggaagtttgtagattaattttttcttgatttattccatcacgaactggccttctataggtgattacaatctgctaatgaataggaactaactgaaacaaacctcaaacattaaggataattcttatctaatgcgagcaacacatgatggcgagaacaccgctgtggcgcaccatgcgcacttactggtctctcgcattcctgcgacgttccaagggaattccccacatagcagatgatgatatatggtagtatcttatttgacccatacactagtcatttgtgctccttggtactaggttttcgtatggatcaacaacaaccagcattggagggaaaggggagaacaaatggggcaagccatttcggagcagatgcttcccccctcatgccaatgcatctttgtacaacactgcccaaggcgaccactgagctgtcactgaagagatgtatcgagcagagaagagagggggaattaatgggctcgttgttagccattccgctgttgacatgttctcgatgacaatcattgagaattcaagacaccgtgatggttctatatatagaaataaggcctttgaaggacatttctgtatcactaaccgcgatgagagtaagtgatcaaaaccttctccttctttttctaatttgatatgatttgttttagtactaataaatataatatggattctggtaaccaaaatgccaagtaaatttgttactctaactacaatatgatttctttatattttcttctttcctactattgttttcattcgtatgtgcaatcaatccacttaggtgaaatccaaatattgttgtaattctagccgatcctgctgctcattatgtatatatctatggttcaaacataccatctattatgtaactgcctaagacgggtcatttaggtaccagttactggtcggcaggatattaatgtaaattaaaatttcaattcttaaatttaccaatcaaaagtttaaatttttggaggttaggagaccaatatttttgtgaataccagttttcaaaaccttagctgtactgcagcataaagcactaaagcatcattcatatctctccaaaaattatactgatccgacaaaacaccttacaaatataaaattaaaatgtaatagctaattagttgttctcaatcataaaacacatatacatgattatgttagaaagctctacctacgtactcatatgcaaacatgcattgtttttctaaaatttcacaaataacacacatgcctaaatatttatggccatgaaatgttcccagcattaccacatatgtataagtagccataaagtgtaataagaaaagcctacatattcttgtcctaaccaatgtggctattagacctagagagtgtatttggtggtgccggacttattattctcttaattctgcgtacttacttaagaactcatgttattttattagaatagtcccagaaaaaacctatgcttgacctatgctgcagacatgggaaacgatctacttattggcaatatggaagtttagcatgctctaacaaaagacaatttggtcaacttcaatgtccctttaaatattttccacacaaaattcggtacttagcacataatagggaaagcataattatcactttgtaataagcattgtctattgttataatttgtgagttgatatcttttggtgaagctcggttggagccaatgatgttctcggagccaacagattgccgacctagttgggaaacttgcagtatgcattcagcatgtgccatgatgcaaattttctcactaaagttggctaaaattcctattgacaatgactgcatacaattatatggatacatagcagtgcgggatgatttggataaattgcttaattatgttgtcaactatagcagggataatcccatcattatgcggcaggtacacattttgttcatgttctgttgatatggcttctaaaatatgcttggaggtgattaaatatatccaaaagtaggacatgggaactttcgatttgaagtcattatgatattagacaagtctactgctatggtgaatgacaattataattttcttagacattaaactacataaataccctttcgacttcttgtttccaataaatatttaagttcgcaaatcttctccaccttcaaaatcttacctggattgtttcgtgaatacatgagccttagaggatctgcaaattatgctttcatttttatttgtactctggaaaaaaaatattcactcatgccatgattttatatgcgatccgcatattgatggttttttgtttgcatgataaattttgttgggtttcataaccctttaaaatttactttgtggacaacttatgtttattggagaaattatatattagtttcgaattaggcaaaagtgcctatattttgcatcttttgttgtgagacaataaaatgtggtgcaatgctctcgtgtgctttcaagaaaaaaattgtggctcaaccaaggggcgctctagttttgtggctatttggataacacacgctggcaattatcgtaatatgcatgtgtgacttaaaccagagataaaccgaaagaaacttttgaccttaatttgtttgctagaccaaatggatgacttaagcctgaccagttctggatccatccatttgcggatcaaaagtatgacttctttcattgtcaactgaactgttgaattgtctcggactgttatgaacactggttaggccatacagtagtttagttaggaaagatgaggcgcacatggtctgttctaggtaacgtagagaaaaacactcaaatcaagggtaaatttacctcttgtttagattctctatcctgttttggtaagatgtataatagtggccacagatagttgcaaaattatgcggcatagccatagctgcgccaatgattttagtgtcctacagcacatgctacaaagtacaaactatcttgtcacatggccaaatttgcctataatttatgttactgttatttgagatctgcctatgctttgctagaaaagaaatcaagctttgcattcagtttactatgagatgctattaaataattttaatgatgttttagggagatctgattgaaatgactggccccaagcgaggcatatcaatgtgttgctctgttctattggagtttgacatgaggataaaaaaaggagagcaagaaaaagatgacctacagttaattgatggagcaatagattatatcgggctaattacagcaacgtttccattcacaaaacgcattaatggtgattgtggtgcagttgatatcactttagcacgtgtttactgggccgtagaggccaccatacaagttatcatatcagatgtgcaaagtggtttcaatttatatctcagttccttgtgttttgttagtgatgtatggaaagaaattcaactcttcaatggccctattggtgagtcatgtggcttaagaagatatgtggttgctgtatccttggacacttggatgcatttgaagttgaaggtaggccaaaaaggctctaaccattatgttgaacgctattgttctttcaaagcaatcaaccatggatgttccagtcaacaaatattgggtgagcttgcatctatctcgatgaaggtgacctggtcaactttactagattaaactcctggaatgtgtttcttaccaaccgtcacaaataagtgatgtttttatgatgcatgcagtcaagatgttaaactttgaccactaatatctctttgaatatttagattcaacttttagaaatattacggctagatttggcttcaataattgttttaatatattatatttcctctatttcatatcataagccgtttttagtttttttcttactcaaatttctttagctttggctaagttttttgtctaagtttatagataaatttagcaatatttacaacactaaataagtctcattaaatacaacattgaatatatattttgataatatgttgtattgtattgaaagtattgttatatttttctattaacttgatcaaacttttaaaaaattgattaggaaaaagtcaaacgacttatgtgattataattggaggtagtacttaccagtaagtatgcacgtgcaccacacgtctctacaaatattaagcaccatgtttttgctgattaattttcctctcctccgctataggcatgcttacatgtgttgtatgcctgtatatacatacatgttgttactttcaagtgtatgagtagggctaaccataaaatttcaagtgtatgagtagggccaaaaaaaaaataaaagtgatccaaaaatttagtactccctccgtactcgtttaggacaactgtttaagtcaaacctttggaatataaatcatgaataactcttaagttgttgagtttgtaattgtaaaaattatatgaataaatttgtcttgaaaaataatttcataaagagtgaattgcatattgggctagttattatgaccaaagtttcactttggaccatggcacatccaacatttttagtttagaccagagtcttttaccttgggttgcacattagaccaccctatccatttccacatcccctgtttccactcagccactgcttgctcctacatcaagatgctgctggctgccaatcgtttgtaactttggcagtgacattgggtcaagccggcaggtgagcacaacaccaccagcctgaggtattgagagctgcggggaattaatggccttgaagagaggagctttgtctacattgcccctgatctcgagctcgagctccatctgtggccacctttgccagctgcgtgcttgagctcgacctccgcctaacatgccacgtgctcgagctccacttgcaccgctgtggcgcctcaactgccctgccctgaagctactcttttttctcccatgtgttctgctgattgctcttgcaacggtagcggcagcaggatctggtttagtgcttgatctagtcatcaagctcctaatctagatgctcaagctcgacggaaacaacagatgggcagcgagactactataggcagactggaaaggtaagtggagggagcgatagtggggatggggatgacttttctggaggaggaagagagaaggggaagagggagagacacacctggtctggttgacatgtgagcgtctagtccaaattgcatgctcaagtaactatagctggttgaaaataaaaatgtttgataacacctagatcattgtgaaacaagggtaagaaaatatagtccaacatgcagttcactctttcataaaagtatacatatatcacttttcaataaatatttttagagaaacaagaagtcaaggttgtattttggagaccgtgtcgctgtccaaaacgattttctttacgagtacctttacgagtacggagggagtacactatagcgaaaatcttgttgtccatttctccagaaaattcattttagttgtcgatgattcttcatctgaaatctgaaaaagaaggaacatactgaaattattaactggaaaaaaggaacatctgacatcactacatatttcgtcctggattgccaaacaataccagaattgaacactgtagggatcaatattaatgatccacgaaactgcagaaaagcccatcatgcaaacattttgcctcccaaaatctatgttgtgaattacaaattatgaccagaacaatggtagtgttgtcgaacctgacattgccggcaatgcattgtaacatcctgaaaaatcctgacaataaaagtcactaaaattttgaattttttaaaacttttgcatcatgttggatgttatggttgctattgcttgccaaacttttgcatcaatgtaactaatcaatctacaaacaatcaatcgaatcgtttttcatattgcttttagttttttgcttagtttgtccatctttgtcgatttgcgctgtaaatcgtccgcagccgctgcgaaagtgcgacacctctttttaagtttgtcctgaaaaccttccgtttttcccacgagatgggtagttgtctatcgttctatctagaattggctccgcaagccggtttagttatcaaaacccatcttgatttagctttgactagattgaggtggttggcgactctactatcaccgcaaagctttaggtgctgtgaaaagaacatctgaaattattaactggaaaaaaggaacatctgacatcactacatatttcgtcctggattgccaaacaataccagaattgaacactgtagggatcaatattaatgatccacgaaactgcagaaaagcccatcatgcaaacattttgcctcccaaaatctatgttgtgaattacaaattatgaccagaacaatggtagtgttgtcgaacctaacattgctggcaatgcattgtaacatcctgaaaattcctgacaataaaaatcactaaaattttgaactttttaaaacttttgcatcatgttggatgttatggttgctattgcttgccaaactataaattgtcacgattgaagattaagctaaagctatacaactacgtaacaattataaaaataagatatttattatgaaccctatagatatttacgcacaacacaacaaagccatataaagagaaggttaattactaatttaatttataggtcaaatattaatattgtgactgtgtcatggcatccactcatataaaataattgatcacataaaataaattgatctttatatatagagattgaatgatgggagtatataattaaatatttagatcaatattgtgccaagtctcaatttcttttgtgaaataaatagattaaacctatccgtgtgtaaatacattgttaatacaaataaactcgaccaatgtgccattgtattaatatggtgatattagtatattataattaataattgtccaagcctacaagttatataggataattatgttaaaccaacacatggtgaaaacgaataaataccaaaatcccaaaagtataggaaatcataaaaggtatagtacaatttaaaaatttggacaatattaattttgaacaaaattcacatttgaatacttcatattgtcgttaaaatgcattggtgaaaatataaattgaaatagacctttttcctcaatttataaaatcaatcaaaaaccctaaatttacagcctggctctgttcattgtgcgccaggtgttcgactcggttctaacccggccaaacacccagcgcagcatccgcctccccgtgcacgcgcacgcgccttctctgctcgtgcgccgcattgggcgtgcccgtgcgccacaccgcgtgggcccgccgccgaccgagccaccgaaaacccgcgccaaagccgcgccgccacgggagcgcgcatcagcaacgtcgcgtcgcccatcgtctcggagccgaggggtaacggccgcgacgtcacccccacaccacccctaaaccctatccaaccgccctacacccgaaaacccgccctcaccaagccgccgctctgccatcgccatgtgcgcgcatcgccgtcgccacgtccgccaccttatccgaatgcggatgccgggtccctcctccattgtaaccagcgggtaaaacggagccttcctctctagctagggctagaacacacagtataggggtcatagatgcaatgatctgctacagaactttaatggaaaaggaggaggaaacatagccgcgtcaacctccctaatctaggccgtatagacagccattgagtgcaccagctgccgatcctatcctccacgccatcctggcttatccccaagccaatcccccccataaaaactccatccctatctgccttttcctcgaatacatttcatcgaacaccttgtgagcatgcttcatcatcactggttggagccgaagccggcgtagctgaccgcgggagctgtggctcgggccgcctctacttcttctgctgccttgcatcaacgccgggagccgctggacgtcggggagagtgcgtcgaacacctgcgtgcgctgccgacgtcgattcgcccctgcttcacccgcaccgtgccgcgcatcaccgacctatgccgttgctccaccgcacggtaaatacttgcgctcttagcaccctctactgacctagaaacatttggccccctcgatttgaggtgtgtgtgccgctgctagcctgccgacgggccgccattgcgccaccgttgagctcaccgtggacggcactagttccaaactaacctaggccatattattgcatgaattagttcactagagaccctagatggtgaatttaggctcggttaggtttaattcgtcctctcccgcgccatggccgagctcgccgtgagctccgtgccacccgtccgtcgcgtcatgccccttgtagccgccgcgcctcgttgctgccggcggtgggtctccggtggtgcgccgccgcttccctcaccacggccgagccgtcccggctcgggctggtcgcattagccgtgcgcccgcgccgctgccctgcgcgtcgggaggaggaagacgaccgagggagagaaagaaaggaagagagagagagaagctgtgggccccacatagagattagtgcacagtaatcacctattaatccaatgcaaattaatctattacacgtgggattggatgattagaaaaatcaaagaaaaattgattatgaagttactgtcaatggcatgcgggacccaccgggattaaagggctggtttggacccaggtcaaatagggccggtcccacttgtcaatgactctctgcattttctatgggaaaataaaaacaaaggaaaaagaaatggggtgaccctacatgtcagccactgtaatcatgcccctctcggctgcacagtgccatttcacaactgtttgaattaattcaaatttgaatctttaaacaagcatagctcactcattttagctcggatttaaatgaaacttgaacctaaattcatctaaaatcaagatatagctgatggaatcacttttgctatttatttttgtactgttgaattttggtgatttaatttgaattctaattgaattcaaatcgaatctttcgcacgtacatatagattccgagggagtggttgagttgactgcaaaacaaggacagcaagacagtgagcaaggcaagtcatcactaatctttgagcatattggacctattgcgaacttattttgatttaaataaagtttgcatgctatttatatgtgaatgtcctactttgttatatgccatacctttgatattgattatccatacaatctttgtaatccataatatcgtgtgtttttagtcaatgcttgaccaaagcatgggtatgatttgactgataaacctgatgttttattattttttttctttttacttctaacttgattgccattttttttgagaattccttcgtaaatcccacagcaaagcacggggaatcacctagtcaatactccctccttccaaaagtctcagtcgtatttggttttcttgtttttccagatgagatgggcgcattccactctgcatgcatgcatgcaggctttaaatgtgtagctggtctcttcgttaaacatgcatggatttaattcctctcagcaaccgaacagtattcttttgcatgcatgcaaatccatccgttgcctattcgcgagcggtgggcgcggacggttgcggtgttgcacacacgcgtatcgtgcatcaaccgaagcgtcgcttcctctaaatccatgcagatgtagcgatggttaaatgcgtcggagagttccttggtcttggagcaaaacgtaatacgactgagacttttggaaggagggagtatatatgagtgagaccaatgtttacttgaactttatcttatttagtcttctttacattgagaacatcaacataatgaaggtttgtatttatgtgtctttattattgctacatgcgttctccatgtgtagggaacaaaccccattggtttttctctaattatgcatatatttgtctccattatatattccattatatgcatatatttgggggagcatatcttatacatatatcgtgcatgttctagatccatgttgttcacctattatcctacactacaacaaatctgggcttctgtgacgattacctaatgacagaacacatatatgtcataaacagagaggctgtttatgacgactgttcataggatgataactgtttatgaccaaactgtgtatttgtcataatcatcatcatagtatactttgcatgggctctgtgaagatagcacgatgacaatagtggatcgtcataaaatatagaactattatatttttaaaaaacaaaaaaaatcttgttatactacattgctgctagatcacaaatcgtttgtcctaggtggactcttcttgtctctcattttagtattttaggattgaagtcatcgctagtcttattttatgaataaaaaaatcagaattatggcgtttcattttatgattgaatgaaaaaactttaaaatggctataagttggtttgaacctacattactacaagaaatatgaccttctatgacgaatttctcgtaacatcggagctattcgtcattagcacattccattttatgacgattaattagtatgagatggggaggcttagtgacgaaaaattttgctttaaaaatcatggctggaaatatatttgtaatattctacgtggtctaaattattctctgaaatttttttgtgaattttcggagctcaataactaattttcataccacaaagttcattttaacctattataataaatggaaaacaaattaaaattcctctctatgtacttgggccattttcggcccaagtattactctcaccctccctcagcctgcagcccctctctctcttcctccctcttcaggccaccggcccagtccttttgctcctcccttgcaaggaagtctattttcctccctcctctcaattcaaataatttttcggtagtaaatgatttcaattgaaaaaattgtcaacaaaaaagttgtataacttattaagatctacaacttttgttttggtcattttgctatatgactttggttcaataatttgaatttgaatttcaaattatgataacttcaaacaacattttcaaatactaaataatttcaactgaaaaagtcatcaacaacaaagttgtataagtcatcaatatctacaacttttgttttggtcattttgctatatggctttgtttcaataatttgaatttgaatttcaaattatgacaacttcaaacaacatttttgaaatactaaatgatttcaactgaaaaaatcatcaacaacaaagttgtataaatcatcaatatctataacttttattttggtcatttcttcatccgataaagtgatggtaacattgttcacaaaatttacacatctcttatatagtttataaactataagagagatatataaattttgtgaacaatgttactatcactttatcggatgaagaaaaaaccaaaataaaagttatagatattgatgttataactttgtttttgatgacttttttatttgaagtcgttcactaataaaaaattatatttgaagttctcaaactttgaatttttcaaatttcaaattattcaaatagagtcagatggagaaatgaccaaaataaaaattttgcatctcgataagttctacaactttggttttggtgacttttccatttaaaattatttattaaacccaatttttgtttgaagttgttaaattttgaaaatttaaaatttgaattgttcaaatgaacttatttgtaaaaaggaccaatacaatagttgtagatctcgatgagttctacaattttgttgtttatgatttttgcatttgaaacataaaaatcagtctaaaattaaatttaaagttctcataaattaaaattaaaaagtacaagatattatttgtatttttttttgaaaaaaaagttaatgctggagaggcgccaaaattttggtgtggctggaaccaaatttttaggcgccaatcttggcggtcatgccaaaaataaaatttaaggtgaaatgttcgttttatccatacaatttggtaaatactgttaagggtgtgtttggttgagcttttcaacctgcttttgcttttgcaaaagctaaaagccaaccaaagggctcaaaagccacagctacttttgccaaaagccagcttttggtgtagtacaactcaaaagcacctctacccctgctttcacctgcttttggggaaaaaaaattacccacctataccattaaaaaaaacggttcgcttcttttctctcccatccttctccctcctcctcacttcgccgtcgctgccgctcctcctcgcccgaggccgacgccgccaccgccgaggactccgacgacgccacagccgactccgtcgtcgctcctcctcaccatcgaggccgactccgccgatgcccgaggccgataccgccgccgccgccgactccgccgccgcccgcgtctacctcccctccaccgccgccgccgaggactcctccgccgccgtgcgatctgcctccccgccgccgcccgaggcctccgccgccgccgccgatgtctccgacgacgccgcggccgactccgccgcccgcgtctacctcccctccaccgccgccgccgaggactcctccgccgccgtgcgatctgcctccccgccgccgcccgaggcctccgccgccgccgccgaagtctccgacgacgccgcggccgactccgccgccgcccgtgtctactccccttcgccgccgccgccgccgaggactctgccgtcgccgttgaggccgaatccgtcgccggctcgccgccgaggccgactccgacacagccgaggtcgactcccgcgcgttcgactccgccaccgctcgcgtttgcctccccgccgccgccgggccgccgaggtcgactcagccgccacgcgcgtctgcctcccgcgcatctgcctcctcctccgccgccgcgcgcgtcttccgccgccgccgaggccaacgccgcgctgccgacgccatgcgcgtcatttttttctttcctctttttttcccttcttttccgacggcgactaccactgccgccgcgactcctcctccaacggctcatccgccgcggcggtctctcctccctattcccctacctcagcgtcccccggaggtcggcggcctatgggtacggggtgctcgtcgcctcgtcccgcaccacgggcgggaagccactcacctacatcccgtaggcggcggcaggccggcctcagggccaccagatctggcctcccgccggccagatccagcgaggagcatggggcagggcactcccggaggcatgggcaagcagggtggcacccccggtgagcgcaagtctggcggcgacggcgacaagaaggagcgcaagttcgagccccccccccccccccccccgcggcgccctccggcgaaaaagttaccggtggcggcggcgtccaccatgcaatggagcaccgaccatgacagggctctccgctcccgccaccccagtcagtacactagacaagtcccttcacttcatctccctcactcttaaatctcaatctcccccaacccccgcgacgtaagtgaggtcaaaaccctggtctccggagcggagttgctagatctggggggtttgattttatttgttttactcgtgtgagagctcgtgtagttggcgattcctccgcgtgggaagcttagattagtgtgtggtctagtcgcgtctcgcagatacgatcgaacactacgatgaattcgtgtttctggtgttcctttacggatgaaattgatcgaagtgtttctggctatgaactgcttcgtgccaaaattcctgcctctgtttagctgtaatttgaactgtgtgtgtaaccctagcagtctagccccctagaactcattcattcattcattcatgctgttaccttttcagtaagagctaaagctaattcctaaatttgtccggggaccaagctagtcctgttttatgtagcagctcctattttcatagcttccagctgattcctgctagtataatactataatttataatatgaatatgccatggactgttttattgtggctggctgttttcgtctgcacaagtattgtgtctcactgcttgcctttctttcctccgttgattttattgttctatgttatattggaatctagtaagctaacacagtgcaccgacttttataatagcatcttgtatataggatgagctcataggtaaaaatgtgatgatactctcgatgctatctgtcgactttatgttctgaaattgaacttaccaataaagctggctaatgttctgaaatggagtagtagaacataagggactaatgatatattttgctttatacatcgatcttagctggatgctctgcattgtttttttttcttccagttgttttcaccacattggtaagtgttggcaacttttttgacaagtcgacaagcacgatcgcaacacctaaatgccttgcggtggtatggagtcgccaaccacctcaatctagccaaacggccaaatcaagatgggttttgaggaaaaacagctaaaccggctagcggagccgatttagagatcaaaatcagcctctaggccgatttagatcgatatgaggataactacccgtctcgtgggcaaaacggaaggttttcaggacaaacctacaaagaggtgtcgcactctcgcagcggcggtggatggtttacggcgcaaaccgacaaagatggactaaactggggtaaaatagaaaaacatagtaaaaaaaacaattcaagtaaattctattcaggggttttacaatgaaccggcattgtccgttaaataggggttggtcttgccctctacaggccctcctctatgtccaactcgggatagaaaccaatggaaacacgaaacatgccttcccgagcaaggaaacccgagacccgacgaaaacagactcggactcggaccctgccggtctgaccacccacatacctgcagtcagatcgcccatacacctgcggtctgaccggccctgtgaaggaaaaccggtactttccaaactttggcaattttcctctatttcgtccataggtgccaaatttgggtgtaaacacatacccccgtctttttggtgaacatacgtgaacctaaaagcatagaacatgttatctcagggcgataatctaattaccggccataggacttcctaagcatcttgccaaatgctcgggaagtatttcttcaagtatttcccattgattgctctctgaaaacaccgtcttgaagtatcttcatctcctcaaagtcttcaaacgcttgttgatgacgtcttcaaaattgccttctatcaaaggtattgtaatcttcaatcaacaagtcgtcttgcttgaaatactgaagaaagccaagatttacctcaaccgacaaaacagctttttgtctataaaccaactcaaaaggagtgactttagtagcatcatgtttaaatatcccatgaacccataatgcctctgaaagcacctcatatcacttctttgagtgttcttcaattttcctttcgactaatttcaacaatattttattacccgactcggcttatccattagcctgagcgtagtaaagagaagaactcaacaacttaaaatcataaaattcggcaaaacttctcacctccttggacataaaagaagatcttcgatcaaagtttaaggaataccgaatctatgaacaatatgctttaaaaataaagtcaattacctccgtgtaagtaatattctcgagcggcacagcttcggcccacttagtgaagtaacccattgcaactagcacgaaccaatgcccttttgatgacgaaggataaacttgaccaatgaaatctaaagcccaacctcggaacggccatagtttaatgataggattcaacacagcggtaggcgctaattgaacattgccgatccgttaacaagcttcactccctctatagcatttgaaacaatcatcaattattttcggccaatgaaaccccactctcctaagcaaccaatttatcctatgggccgattgatgaattccacaaatccctacgtgaacttctcccatagcaactctagattgatcattatccaatcactttaatagcactccatctatatttcggcgatataactctccatcaagcaaagtgtatttgaactcttgccgctgaatttttgatcaaccttaagactaggatctttcaaatattctattcaaaggaattctccaagctatttctaactcatgggcacaaatgtccgaattcacaattaattcggccttttaatcaattgtaacgtgccccccagcccctgtccgggatcggtcagaccggccacacaataccggtcagaccgccctatctacccggtcagaccggtcatgcagagctggtcagaccgccggtaccaccggtcagaccggccgtgcaatgccggtcagaccgcccctggtctatgactttgctaatttcgtccaaacttttgaaatcaagcatcggcctttagtatataattttttttcacataatagccagatgcttggtgtatcaaattattggaccaaaattccttctctctagacatatgaaaaactataacatccaactaacatgtctagatgaatactaattcaaatggcttttgaaacaataatcatcatggcatcaaaacacttagccaattgaagtatgatcaataatgaatcaccaaaatcatatgtgtcacatgcatagattcgaataaactacaaatgtaagtaatcggcttgagcatgtatgcaaaatattaataatcccaatgttcctaaagaaaaccactctagagcaaatcatcatattcaccattgacattagcggaattactaagcaaaattttcatggtgcaataaatatgaaatctatatattatatggcgatccataaaaacatccataatttggcttcaaataaatatcaaagactcatgagccaaatcatacattcaaacaaattatatgccaacttaccaattccactaattagaactggtatttgcaacatgtatgtataatatcaatttgataagcaaaaacacacatgtgctagatagtaagcaatgttctaacatggcataggcatataatatgatgatgaacacaataaacccatacattgccttagcatccaacaaacgacagctcaaagatgtgatgttgtatctatcgccgttcatcctctcttggttccttcataagcataataatgtcttgccccccaagcaaaatcggctttctcgactgcacgatttcaaaggcaagacgaacaccgcaccaacatccacagcatcatgtgaaggagacttattttttaagggaaaatttgaaccatgccacacaaattttgcaaaatttgtaatatgccatcctgacccacatgtcattgactcatgtgggtcctacatgtcattgagatacgggtggcatatctcaaattttgcaaaattagggtggcatggttccaacaaaccctttttttaatgaccgatgattcttctctcatcaaattgaatccatcactactccatgaaatcaccgatcttttaacttttacttctttaggtctccacactcgcttaggtgtcgttcgaggctctaaattattacatgttttattctctacatcttcggcgtctttttctttttgacctatggctcgaagacgctgtagcctcctcttttgagagcgagataagccagaaggtatccacttcggctgtggttgttttccaggagctaaacaatgattcttaatagttttgggcgaagtagaagctcctgtgttgctctcaattttcccgctcacctttaatgcccctcggtctgatcggcctctgggcccggtcagaccggctgcaagccgtcggttagaccggccaggagggttggtcagaccggccgtagtctggcgatcagaccggccagacgcctcggtcagaccgccgatgtggacagtaacggtatcggcttcaatcttctccgcttgtatagttttcgccgcatctcgagtaggcatagttattaagaccggaccggtaattgaaccggtgaggctctcggttcaatggttcactggttcaaccggttaggccgttggtctaatccggttcaatacgtgttaaatatattaatcattctgtccaaacacaaggcgcttggtagcgtggtggttcggtgagttagcttcctcccatgtggtcctgggttctaattcaccctagcgcgtattttcactcatttttctcccccaccagcgcgtgcccatgcggccatgcacgcgcttcgtcgccagccgtcaagagcccggttcaaagcggtttttattcccggtttaatagcggtttttctccgaaaccgggcggtctagccggttcatagccggctcaattgcataccggtcttttacctggaccggaccggcgggggctctggttccggttttttccggtccgaccaccggtccggtccggtcttaataactgtgccagtaggtacttgaacatcttttacctggaccggaccggcgggggctctggttccggttttttccggtctgaccaccggtccggtccggtcttaataactgtgccagtaggtacttgaacatcttgagattcctccttaatagtgacgacctccggagctttggcttcttttctcacccacaccttctttacctttttcacctttgatccaccggaccgattcttttgtgggaaacggtcttgactagagttaaatgaatgagttggtactgacctaggtgattccttccactcttgataatacggcataggtggttgatgcatccacagcatataatacataaaaggataaccaaatggtgacattggatatggataccatggcatcactaccggaggtttgtatggagttggtatagttgatggctccgattgctttggtgtttgaccaaatctttttctacaagatgatcttggtctttttgaatcactagtttgattatcaaatcattgaccggctaatcctttattgtacttagccataagcatctcaaaagtgagcttcggctttttggtcttttgggaactagatgactcaccctttgcaactttatgatcttcggccttcgcattttttatcctattcttgggccgaggatccccaataataacacttttccctttctttttgccaacatcaataaaactaacagggagaggatcactaacaattccggtcttaggcatagatgtaaccgaaatagtttcacaagtgaccgatgaagtatcaatcggtctttgctccatcaagcttgcatctttaaaataatcatgaaactcatgctccatttatgaccatgtagaaattgaattaggagcaagtaaactataccatgtagatgcaaagtttgacaaagaaagaggaaacaattttaacttaagcaaatcattactaccgaccttaccacattgatcaataaattggccgatatgctccattgtagtcatagcattctcacctgtgaatttcatgaagttgggcacctcaaatccttacggatatgggaccgaatctacatgttcaagatacatgcataactattttagattctatctcactactatcccgcaagacattatcattatcttttccaacatccacatgactgatttgtgattcggtcttaggtgacaatgctatttcactttcgcttgtgatataatccaaaccgtcacttggttcggctatattttcaatgatgtcattgtctaaactagcaacacaatccgaaccatcacttggttcggctattccattattgtctaatttagtaacacaatctgaaccaacacttggttcggctataatggttgttgcattatcatccaagctagtaagacaatccgaaccaacatttggttcggctataatcgctatggcatcattgcaaaaattattaacacaattcgaaccgtcgcttggttcggctacacatgatattgcactatcatctaaactagcatttaagctattatcatccacccggctttcctgagccagtgcttcatgcaacacataacacatgatcaacattaagaaatatttggccattcaacctctctttaatagaatcaagcaatccatcatatgcaatgttggccaaatcttgtcagttattttcaaactaaaacatcggcttttaatatctctaaacctttcaatataatcaatgacagattcattttatttttgcctaaccgatgttaaatcagacaacctaagctcagttttaccagtgcaaaaatgatcatgaattttttgttctaattgagcccaagtataaatataatttgccggtaaagaagtaaaccatgtaaatgcggtaccggacaaagataaagaaaacaagcgcaatttaaaagtatcactattagcctcaccacattgcgctaaaaattgacctacatgctcccatgtggtcctactatcttcaccactaaacttggtaaattcgggaactctataattacgaggaaatggcacattatcataatagtcaggatacggcttttggtaaaccttagcacaattcctagtttcaatcccgaatttatccctaataatcccactagttatttcctccatattatcaggcctatgttgatttggtggtggatttggtggcctaataggttgtgtttgcggcgcaatatgattatattggccttgcctagtatcgggatgataccccctagcaacatcattataagcattaggaacatgtgggggaacttggggattagtcgcagcagtagatacaggaggattaaatgttctaagatgatacaaataactagaattggtcattggatctatcccctgaatcggtatgattgcgtcggtctgaccggtctagggcccggtctgagcgacatccagaggcgcggtcagaccggcctgagtcccggtctgactgccgggataatacccggtcggaccggccgtttggctggtcggaccgacggtgaagtcgcggtttgaccggccatcaggcccggtcagaccggctatatgcgccactccattggttccactacttgtttgatctataggagcttggctagcagtggtagaggctttatcttttaccataaaatcggccaagagagggccgactttaaatcttaaaaactcatcaaatttaccctcaaaagttgcatctaacctatctttaaaaacagtcatagatgaatctattgtagatgctacttgttggatagattgtgttacctcttcattgcttacaaaatcggaagcgaacttaggacgtggcccgggcttggtcatcacgccttgacgagtcctagtgcacgccctcatcaacgcctcctgtgtgatctccttgatgtactcctccatggacttgcggtcttctccttcgaaatcatccaatgtgatcggcatgatctcgttctcgctcatcatggttgatgaagaaattccttgattaatttcggccatatagctcatagccgaaatatttgactaaataaattaatatacggtgttgatttttcctttgaatataacaagcgtgtgtgcaactaaaatagaattgcttctgtctcctcgtgtgtaagcaaaaattcagaaattcgatctcacaataacagccgaaacaatatgaatcggctttgatttttttttaattctcttcagtagatgtgctaatgtatgtgctaacagattgatgttgcttctgctgcttgtgacccggtagatcggctctagtagcctgatcttttctctgttgccgtgtgaaacaataaggaaacgttgctaagccgtctgctgcttcctgataatgattttcgatacacacggcaagtgcttatatgaatttgatgacgaccaaatagcttcgccgccgaatagattaatccagcgataagaacagtgcagcgactaattaaggtatagattaatttcggccgtttggccgaaacaaactattcgacgagatgactagattaaacaaaattcggccgtgatatggccggttacatcgttccccagcggagtcgtcaaaaatcgtgttgacttttttgacaagtcgacaagcacgatcgcaacacctaaacgccttgcggtcgtatggagtcgccaaccatctcaatctagccaaacggccaaatcaagatgggttttgaggaaaaacagctaaaccggctagcggagccgatttagagatcaaaatcagcctctaggccgatttagatcgatatgaggataactacccgtctcgtgggcaaaacggaaggttttcaggacaaacctacaaagagatgtcgcactctcgcagtggcggcggacggtttacggcgcaaaccgacgaagatggactaaactggggtaaaatagaaaaacatagtaaaagaacgattcaagtaaattctatttgggggttttacaatgaaccggccttgtcccttaaataggggttggttttgccctctacaggccctcctccatgtccaactcgggatagaaaccaatggaaacacaaaacatgtcttcccgagcaaggaaacctgagacccgacgaaaacagacttggactcagaccctgctggtctgaccgcccacatacctgtggtcagaccggccctactagccggtcagaccgcccatataccagcggtctgaccggccccgtgaaggaaacccggtactttccaaactttggcaattttcctctatttcgtccataggtgccaaatttgggtgtaaacagtaagttcaatttttgcacgagatgtcggagtctttttatgctatctgaaacatgtaagattgaccaagcagatgccttttttttaagggcttttacagtgatctcctttagtagtataaatctaagacattgatttataagttctactgctagtggttaaggtggtagtataaatagatatagtccatcggatgagaaaatatgaaaggtctagattgattctgctactcctagatccgctgtaaaacttgtcttttcttttatacatttggaatctccaaggacacagttgtgtagtgaggtaagatgtgctattttttttaattaataagatgtgataaatcgtaatgaacctttatttatataataatgcaaaactgaaaccttgctttaattgctaggaggatatgcatgcccgggaatccctcacttcaccatcaggacctccttcgacaaataatagcatttggacaaggtcagatcaatcctccctaagctagttgtatgctcaggtacatagctttaacttgtttcttgtgcatttgcatccatatcaagcctattgtactgtttcattggtggctgaattttttgttcatggtgtgtatcaaaattgcctatttcaatttacttgatggattatttatagttgttgttactgtgaaattagatattgtttagttgtgactggaaaagagccatttcattgattaatctagatactctattttttctggattattagctgcaaaagagccatttgtttggatttagttgtgactagaaaagagccatttgtttggacttgctggaaaagagccatatcaatatattgttattactcaatttacctgctggattattactctctaaacactgtttgctcatttgtttgcctccaaatccaaacaaaatggactttttattcatcagcaactgaaaacatgcaccttttgatggcaggaatgaggtgtctgagcttggaatttgatggctcgtgttaatgtagtggctgctaggtggaattttttggtgcaagaacttggcactacctataggaactttgtagtcggctgggacttgtgtagttggatggtggatggatcattttgtaatcatgttttgtgcttttgtatggaacatgttgcaaactgaatgctggaacttgcttttgtatgagctgggaaattaattatggctggaatgtgattataatataattattcaaatggttgtggtttatattctgtgattgctttttaattggattggcccataaaagcaaatttgtagctgggtcaaaaaaaatatttgggccaattgtaattgagaataaaaaagcccatgtatatgggccgaatgtgaattgccatgtcatttgctacatcacctgccttgtcatctgtatcacatgtcatcatacacgtggtgttattcggttcaatttgttatgacgaatttgtctcgtcattcatcaatgacaggagaactatcgtcattgtatcaatgacgatgtcctttggtggtcacagaagctggttagtgacccaccttttgtgatgacagccatttcatcactgctggcaggcagtgacacgaaacaggctgatatcgtcataatgtaatcgtcacagaagcctagaattcatgtagtgctatatacctatacaagtcatccccactaattttattttcctgctctctcgctttgccacatcatcttaattgttttggaccattagattggaattgtgtggtttgatcagcgttaaacgtcatgtccctaggcttctagtggacgggcctacaatgaagcccattgaagtccaccacaccagtccagccatcatgcaaaacagatcgttcttttcccgtagtcatcaattggaacggcaggaaaagaaaacgtcgcgatcgttatcgctcccccaaatcattgagattccacggcgtgatgccttcatgcctttttcatgtatggcaaaactaggaaaccctcatctacgtttcatggctgtcatgacacccacctttaaatcatagtgtaacccatcaaacaccagctgagattcgtagtaattgaactactacgaatcaaccatgatgtccttcagcgacattgttccattacaaacaccagctgagatttgtttttgtgtttctgcacggtctcaacttttcgttttctgtcctcatcaatcttcaagttggataaggtacattcttctcttccctcattctttcatgttgagttaattggcttaccaaattaaaacaaaagttttttttttgttgagttcactgggtgtgctttccgtctgcctgtccattggtgacaccatgtatcacttattttatcctttatgaaattttatgttacattccccctcctttcatattggagtagatcatattaagcgtgccaatacattatatgcttcaccaattgggaatgtaaatctgatcactaatatgtaccttcatatttcacttatgttatgattcagaagagaattcagttttcctcttcaattaaagtgattattttagaaatttcaaggttgtatcccgtaacttagtttctttcttattgcagtataatttatttcagtcaaataatgtaacccatctctatcaatcaaccatatatatcaagatgaaaagaatattacaggtggtcatttatagcaaggtgcaacaaacaggtttatgatcattacacatttttagaccttttatatccgacagtaatactcaaaactttcatgatctctcagtgaatttctacttattgagttattatttccaaaatttgttgtcatgaaattctttttcctatagttgatcaaataagataaaataaaaaatcctaaaaaagagggaacatttgttgttgcgtaattcctttttctatagttgatcaaatgagataaaatcaaaaaccctaaaaagaggggcaagaacgcaatttcacttatttgttaaatgtgatagatcaaatattctcatagaattttgttacatgtattgtgatggatcaaatgttctcattgaattttccctctttcgttggtatgcactatgtcccgctgcaacgtgcggggtattatctagtttatattggatctttgcacttaagcttacatgcaagtatttggcacttgtggtcttgatgagtactcaactattgtattcatatatttcatatgcaaccgattagtcatctatggaaggatacaactgatttgtcaggactaatgttttcctttgagttatgtattgtcgtgatgagactaatggatgacaccatgtgttgatggtcatcaagacatgaacatcatgttgacaaggatgagttcaagcttgtaaagactt

SEQ ID NO: 10464 - DNA, 1126 bp, Oryza sativa
gccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatg

SEQ ID NO: 10465 - DNA, 1841 bp, Oryza sativa
  unsure (1)..(1841): unsure at all n locations
ttcgtgtttacaaaatagctttgagcaactaaatgtctttaaatgctgtttactgcaaccctaacccttacattataattcccttgtactcccttgcatttattctgcatttgtgggtgtgtcttgttgagtacggtggttgtactcagtcttgctcaatttttccaaagcccagaagaggagctccttggagatgaaggcttcggtgtctagctcgtgcctgccgtcaagcgtctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaagaattaatgcacgcacgtaaggaatgcccgttgggttatttccggtcgtgacaccctcgttctgggttcccaatctggaaaagtccaatcccctctctaagtgggcaaggtcctccttttatatcttaaggggataccacatgcaccatctccccctctctttcttccaatttgacttctcttcattaacagacggagatttgcatcgccgccgtccgaatgaccttctgacgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgcccttcttcatacaatatcttgcctgtaatggttaggatgaagcctgacatatatttgaccggaaccaacgtgccatctccaggagctaacacgccggctccagctagggacgagtgcttggaggctctcgtcctgacaggatggggcgaggcgtgcgtcaaaccgcctgtagccacctaacccatgatctgaccggtctgtgactggtcacagaccgataaacgagcgtgctatactgcgatacatgcggcgtgacgcgctcgtcaaaactgcaataaatgtggttaagtgagcccnngcatgctcacctaccccatatacgtggcgcaaaacccacaaggggtcggggcgcttcggccctcggggccgagacgggagcgcccgaccccttggggagacaaagagaagggcggccgtatcaccctcgggcccgacccccccccccccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcatgcctctagtcatgatactcccggtcccatgtcaccgacaggcgttatcttcactaactttactatcattcgccctcctcttcgccattcagatcgaagcccccatgggcaagatggccagatccacttagggtcagggttggtcgctaccacttcggaggtgccagatctggcttcctgaaggttggagaccatcagatctagccatccacacagttttggtaggcggcgacgatggtgatggggacaatgactatgacagcggcgatgagcttcggaggggcaaagcgatttcattgtcatcatcgatatttttggttttattttcacgggtattttatatcggtgatgggccgtgttgtataaactgattttttttcctcattgtccacatcggcgacgggtcacaattaaaactaacacccttcagaaataaaaatcatcagtgatgaaaggggatccgatagatgaggttttcat

SEQ ID NO: 10466 - DNA, 6538 bp, Oryza sativa
attcagatcgaagcccccatgggcaagatggccagatccacttagggtcagggttggtcgctaccacttcggaggtgccagatctggcttcctgaaggttggagaccatcagatctagccatccacacagttttggtaggcggcgacgatggtgatggggacaatgactatgacagcggcgatgagcttcggaggggcaaagcgatttcattgtcatcatcgatatttttggttttattttcacgggtattttatatcggtgatgggccgtgttgtataaactgattttttttcctcattgtccacatcggcgacgggtcacaattaaaactaacacccttcagaaataaaaatcatcagtgatgaaaggggatccgatagatgaggttttcatatcgctgatcactcattgtgatcaaggcgtccatcccccgcatataattaagggttataacttgttatgaatgaccggctccatagtagtgtataatgtcatgaaaaaaatattgctggatccatgttagaaagtattttcttttactataataattctataaccgtaaacgagacagagtaagacttatttttgacagtcaagatacgtttaatgcatgagagagtatatatatagtgcccaagtgccttcgtcccgaagtctattatgcatggtgaactggtggtgttccgagctgtggtcgcatatatatcactctcactgccgacacaaggacgatctaccaccgggtgcagtattatccatccaaagggcaaacaagtcgctgccgaaaggcgcccgccggctagctacgctagtggcagtgcccatcaatccacattccagcccctcatatactccagtactccacatacgaacaatcggtcgaaagctctaactctagctttgatccatgcatatctatccatcctttctttgatcggtcgcaacgcccagaaactgatcgacgatgcagcagcagcagcatccggcgccgggcgcggagttcgtggcggaccgggacacggcgcgggcggaggtggagcgtgcactgggcgggtacagcttccgcgacggcggcgcgctgctgctggaggacgccctgacgcacagcgtgcaccccagggacgaggccgtcggtcggtccaggcaccagcggctcgagttcctcggcgacgctgcgctcggcctcgccttcgccaccatcttctaccgggacgacccgggcctcgaccagggggacctcacggtgctccgctccgccaacgtctccacccagaagctcgcccgcgtcgccgtccgccggcgcctctatccgctgctccggcgctacaactgcgcccctcaagaccacgaagtacgcacgaacctctcctctgctttcctctgtactctctctctctcgcggatccatactttgctagtatcgattaattaaagtataaaaaaatataggactacctattatatactaaaattttactgtattaaacttactacaaacgcttccaagatatcatgtgacactctacaaatacttctaaatcaccacatggcactccaatatattgaagaaaatcctataaattatgattaaaaaaatacaactaactattgattttcttttaaatagatggacccaatgattttaaccattaaatccggtatcacacccgcacggcggttgtgccaatgaccaaacggcccggccctgggccaaggtcagtcgggtcatcacggcccgacctacacatcgggccgtcccgtgccagccaatgggctatactcacggcccaagcacggcccaatatgactcgggccgtgccaggccagcccgaaggcacgacagtccatcgtgcttaataagtctattttctctctcaactctttgggctgtgttatatatggccgaagtaagtctgttttgtattcctcttctctttggaccatgtcttatatggctgattaagtctattttggatatttctactatttttcttcttcgaccgtgcagtaccgggccagcccaccatgcaaaggcatcggccaggcacggcccaactgtcgggccatgtagtgcttgggccgggccgttgggcctcaggccttatggccatcaatagatgtgcgtagtacatactctgtactccctccaccgtccgtaatctctcatattttctaactaacttctcatattttctagctaattaacacttaatatatatatctctactattataaaaattgaaaatgtttttgccaatactctgtacgtcatccgtgtttgtaatacagccgccagcaaaaatggatctttgctggcggctggcttaagacgactgccagcgaggatattgatattcactgccctttgttttgtggcggctccaaattccgctagcgaaaacctaaaatagccgccacgaaagatggttttcgtaggagaactaggacttcacgtcatgtgagaatattgaagcaagtcaatgtaaggggcctaatgggttctgtacctacgaggagcttaagtgggcacatgagtgtgggtctcaagaagcatgtcaatgctcgaaccagggtttcacggtgcatgatcatgtttgattttaacagtattatcctgctaagaggcaggagtggtatttttacaatacttctacacagatttagacaaaatgatacatgaaaacatattgccaagtttggagcaaagatgatttttttaatacattatcttgtattaggtttatttcggtggtataactgcaatttcctctatgaaaaggtgcctaactttcaagataataataataataataataataataataataataataataataataataataataataataataataataataataataagtactccatttgtcaaaataaatataaggcaccgtacttttagcaaaatcggcattcataagttttgactaatgactaaactaatatatatgtttagtatcatgtattccatattattatgtttatatctgaaagcacttttatgtgatgtgaaattcactttttctatagcatattataaaaaataagtcaactataatgttaaagacattgaaaagctaatacacgttatattttgagggaagtagggaacagtactggtagtgatttatgactgaatccaataggcatttttatcgttcggaagatttaagtcctttctctttttccaacacttatagcaaggcaattttgtaggtgtttttgtcgttcggaacattcaactatgttctcttttctttcttgtcaactccgttctcttttctttcctccacttatagcaagataatttgtaatgaaagtccatgagctattttacagggttataataagaaaatagataagaggcacgtgcatatgcgctggcttcttcctagttgtttataaaatgtgcatgttatctatcttttctttttctatggataatattcacttttatttaattttatatgtggatataattgtattttattattaagttcatttgcaaaatttacgatgtgataagttgggatggtagattcacactgttatcatcgttagagcctttaacgacacatcgggatgtaagatttaggttttctcttcataatcttaaatttcatatatacattcaaaaccttccccatgaataccctgaaattaagaaagctttaatgacctgtttggttggagggtgtttgtgatgggaatgggagtttatgatatctagaaatttaagtctgtagtttggttgaaagacttaggaattacagggggtttgggatggggaattaagaggtccaattcccaccaatctcttacctgggggaggcctgttaattcgtgagacttggagagaattcgatgtgaaaccaaacaacggatgaggactaaaaatgtaactcccataaccaatcccaccatcaactccctccttaagactctcattcctcgtcccttctcttgccaaacaaatcgtaattggatactcatattgtgtgctaagcatttgatatgcttaaataaacattaatcataagctcaaaataatatgttgtagatcgatccataattttatttggccagttaacaactctttgcatgagatgcaaactcgctccgatcaataatattcgactttgggatgtaactaaacttagcaactcaaaggagtagtactatatacaaaggtgaactaaggtattattatggaacaactgaataccgaccaccttcgtttaccgctaaaaaaatgttttaatttacaggcggtggaaagccattttcgcacgcgtttagccaccgcctgaaaaagaattttacccaagtcatctattttacctaagtgtagcagactagcacaatcccacctcacactcatagctgatagctggagtatcaaacaatttattattttttcagctaaatatatattcaaacgaatatttgggtatgatctcaaatgagaaataataaaaaaatttcaaccacaaagtccataaagttgtaagtgaaaactatttatttttttaaatatggttgttttataaaacaaaacccaatcggggacagattcagaccaaccgtaccgtgcactttgatgattggtatgccgtatgctcttactgactatagcatttgtgatgcaggtcagccgttttaccaagtcagttgaaggcccatatagtggtgaccccattgagggtccaagggtgcttgctgatattgttgaggccattgttggtgccgtctatcttgattccaagcttgatcttgaagtactccagaaggttaattttcagccttctttcatattgtatgtttgcttttattaatgtagatatggttcctatatattgagtgatgtatggtgtaggttgcgaagttgctgtgtgagccaattatcaccaaaaaggcattactagaagatcctgagtccatgttgaatgagctagggggagaacatagggaagatttggaaatcaaaatattggcgtggaggaaggtggcaaacgtagtcgatgatggccgggagcaagcgatcacaactagtggacttggcaacggctcagaggatgaggttggaaagcttagaacaataagaatagaagaagcttaacgagcagcacagcaagttacagtaaattggcgaccaggaaccaatcagtaagtacgattactattatctcctcgagtcaagttttgtttttcatcccaacaccttgggaacttgaaatttcattcctccaaagtcagggttaagagctaaatgaattataaaattaggaacacaggaattatagaaacacagaatggcatatgtgtaaaattaggatataatggcaaaaaagaggaatagaaaatataggaaacgcatgtttggaacatagaaaagaaaaatcaaggatgggaagtaggcccacctgtcaatcacttgcaaatcttgtcaaccactatataatgaaaatggagaggattgatatttcaactaagcaattggaattttgaaaaattgcacaactacttactttagtgattcccaagtccacaacaatggagattaattttccgaatcttcttattcattgttaaaccttacattcaggcattttgtaaaatttcactatgtcgacctagctatattcaaccatatgtaatgtaggtctgctagagcggagtgaacgttcaaccaattgcttaagatacacttaacacaccatgtaaaatttcactatgtcgacctacattcaaccattgttaaaccttttggatggttcagatagctgcttgattcggtaaatacaaattttgagtcgatgtcttagttttccctgttcttcttttcctgctgcatgaggtttctttgtgccacgtgaggcatcatcctatcgcgcaactaaaatttttctaactacaggtgaactagcagcccatatatagtggctggatctgaacttttgtgggtcaggtatggaacatattcatgtattgcgcaggcacttctatgctatgctagctctgaacattgatgcctggaggtttgtttcatggcatgttcactgctagatagtagtagctgtgaaatcaatgtatggctattgaaattgatgcagacctggtactattgatgtctggtaccctggttatcaggccaagcgtgtcctaatcttgtcgagcgatgaacactatagtgtattttgtcttatgtacaatggaggtttgtcatactgaatctgtgtttgtactcaaccaatgtatatgtagaataccatgtaaagtaatattattaaagaatgtgtgatgtttgttcatatggacttactctcagtgtcctagatatgaaagagcatatagcttttcaggtgggctcagctattcatttctcatggccttgcatgaattcttgttcctgagctaaaattttccataattcatttttcatgtgtacaaactagttggcataaatactctaagacaatcaatgttcttgcttgacaatgccgggaggtgccaacattt

SEQ ID NO: 10467 - DNA, 22279 bp, Oryza sativa
atttgtgctctgaaaattccactaaaatttatttacgcatttaggcttttagaaaatatacaaaaatcctcaaagccttatttgacttttaaatttgcacattttaattgttgaaggctttcacatgaattttaattattctatgcacaatttcgaggatgtattttagagtcgatttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggaactcggaggcatttcttgagttgcgacacatggaacacatcatgcacgttgcccaaggaggcgggcagctccaactggtaagcgacttctccgcgtcgagcaacgatacggaaaggacccacataccgaggtgcgagcttctctttcgtctgaaacctgtgtacacctcgcaatggcgtgacccgaagatacacaaaatcatccactgcgaattccaggtcacggcgacggttatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcataaggtgccatttgtatgctggcttgataactgttattgtaggagaactcggcataggggagactcttatcccaggtcttcccgaaatctaggacacatgcgcgaagcatatcttctaggatctgatttagacgctcggtctgcccatctgtctgcgggtggtatgcggtgctgaaatttaatcgggtacccagctcttcttggagtttcttccaaaagtgagaggtgaattggcttcccctatcagatacgattttcttgggaacgccatggagactcacgatcctagcgaagtagagctccgctagtttgttctctccataggtggtcttcacaggaatgaatcgagctaccttggttaaccgatccacaactacccatattgaatcatatccgccttgggtttttggaagtccggtgatgaaatccatcccaatttcatcccatttccattctggtacttggagaggttggagaagtccggccggtcgctggtgctctgctttgacacgctggcacacatcacatagggccacaaactctgcaatctcccgcttcatgctaacccaccagtatttctccttcaagtctaagtacatctttgtactgccagggtggatggaataaggactttcgtgagcttcctgaagtatcagctgtttaagttctctgttatgtggaacgcatacccgctttccgttccatagggttccgtgttcatcctctgtgaaaccagcggctttaccctgtttcatattcttgaggagtccatgcatgtccggatcgttcttctgagcctcgcggatttgatcgagcaagataggcttggcttccaacgcagccaagaatccacgaccaactatgcttaggttcagggcttccatctgttgactaagttcgggtggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaagtcatgtgtagggtagttgccttcatgaggtcgtagctgacgtgaggcataggctaccacatgaccgtcctgcatgagcatgcaccccaatccttggcgcgaagcgtcacaatacaccatgaaatccttgcgagtatccggcaagattaacaccggcgaggaaaccagcttttctttgagagtttgaaacgccttctcgcattgcgggctccacacaaatttctcttctttcttcaacaactgtgtcatgggtcgagcgattttggagaagttctcgatgaatctccgatagtatcctgccaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggtcaaaccgaacgacatcaccgtgaattcatacagtccgtatcgcgtggtgaatgcggtcttcggaatatcttcttcacgaatacgtaattggtgatatccggaacgaagatcaatcttggagaatacagtggcacctttaagctgatcgaacagatcatctatccggggaagagggtacttgtttttgatggtgacctcattgagagctctgtagtcgacgcacatcctcttcgtcttgtctttcttctctacaaaaatcacaggagcaccccatggggaagtactcggacgtatgtaccccttttctttcagctcttccaactgtctctttacttcggccagttcatttgctgccatacggtacggtcgcttgtacagaggagtggttcctggagcaagatctatccggaactcaatctctcgcttaggcggcataccaggtagttcttccggaaacacgtctccgaactctctgacgatgggaatttctgacagtcctatctgatgaagtcctgaacttctgacagaggttgggggtgcaaagaaaacaaccggttgttccggccctcggtacagagtgacagtgcgtctcgcgcaatccactactccttggaattgagccaaccaattcatcccaaggatcacatccaaattcttggtgtctagcagaatcagatccgaggaaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggcgcttggccttgctgacgccttggcttcgggcatttatccgcaaagtgcccgggctcgaagcagttgaagcacagacgctgctgaccttgagcgtccctgcggccttgaccagactgcacagttggcgtaggaggacggggcgcacgagtcccttgctgattctgctgctgctgcggctgtgggatgcgcaccacgaattgaggtcgaggcgcggagcgaggttgctgctgctgttgttgctgctgcgaggaggatccccctggatagggattggtgtagcggaccctctggttagcaccctgttgattgcggaaattcgccaagcggcgcttgtgtgactccagttccttgtgcttggcttccaagcggatgctcttgtccaccagacgttgaaaatccggatagtccccagagactagacggacggacagctcggggtccattcctgccaagaacttctcttgcttctcctcatcttcccgcacatcctccggagcgtaacgggccagattattgaactcatgcaaatactccatcacggagcggttgccttgcttcaactctcggaattctcttttcttaagtgccacgactccagcgggcacatgggttctccggaaagcggcggtgaagcgagcccaagtaataggttgcccctctggttgcgtagcctggaaatggtcccaccagagagatgcgggcccctgcagctgatgggcggcgaagacgactttctcctcatcgctgcactgcaccgtgtctagctttttccccacggcatgcaaccaatccaacgcatccacgggattgttggaactagagaaggtaggtgggcggatgcggaggaactcggcgagtttagagtgttggggaggtggtggtggagcattctgttgtggcggattttggaggtggtggaggaaagcggtcatcatgttggcttgctgggcgaggatttgggtgagaatggcgttggtgtctggtggtggtggtggaggcggaggaggaggtggaggtggattgccttggtggttgtggttgctgccttcgggttggttgccatcaccggtaacagcatttctcctggtcgtcaccatctgaaaaccccacacagaaccagcaaacagagagagaagctgacaattaaaactaaccacccacgactaccattattcttaaatttgttactgctattatattggttcattaatgttcaagttgcttaggcgaataaaataagacaggctccgacatagttatgccacacaccggcataaccatgccccacacgactcaacaagaagacaaacgaaaaaaagaacacacgcgcaagcctactaactgctcgtctactgctgcgacgggccaggacggaaggtgagcaacagcgcaccctccgtgctaccaacaccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctgatgcagctgcgcctccaccgcgtcgaggtccttcttgagctgcaggttctcttgacgcagctccaggatcttcatgttgttctcgaccatcccgcggcgcaccatctgatggaagtcgatacgagccgcgtcgtacgcctccaccatgcgcgctaggtgcacgatggtagcgtcatcctccgagctagcatcccggaaggtggcgtagtcgcaggctcctccgcggcgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagagaggatcacagcagtgacctcccaaccagcgtggggctccgcgtcgtctccctcctgatccggaagcggcctggcctggtagtccactccatgtgggtaccctaagaccacgcacatgccccgcagctccaagacgaagccagtcatgtccaaaccacgacgggtgacgctaccggccatctacaaacaaaaacaaaaagagaaacaacattttaaaggtcagattttgacgataaatgaagcagcaagacagagagagactagacagttttcacaaataacaaaggatttttatttttgaaaatattgctacggcttgggatctacggctcgtcctagggtcaaggatggctctgataccaacttgtcacgaccggaaataacccaacgggcattccttacgtgcgtgcattaatccttgtcccaggaggcaaggtacaccaaaagttgatacaaatcagagtttaacaagcggaagcgtaaatagttaacttattacatgggcagcgaaggcccagcacacacaaagacaaacgagaaacagcggaagactagggcgacgaccacagacgcttgacggcaggcacgagctagacaccgaagccttcatctccaaggagctcctcttctgggctttggaaaaattgagcaagactgagtacaaccaccgtactcaacaagacacacccacaaatgcagaataaatgcaagggagtacaagggaattataatgtaagggttagggttgcagtaaacagcatttaaagacatttagttgctcaaagctattttgtaaacacgatcctagaactaaacaatattattaatcaaggccgtgaacccacacgaacctgccttaacccaaggcctacgatgattcagaccgaactggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaagactgagcccctagcagcagggcaccaaccctctgccaatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaataaagggggcggggtgaatccaattccacaatactccaacaattccacagtgtccgggtgatatgaatatttcccaaagtctaaagttgaaaagccacctaatgttacctaattaaattgcgaagcatctacctaaatttaaactagtggtgccatgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacggccaacggaaaagaaaaaggattttactctaataaactccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaacccatttattgcgccagccgggagagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggccccacctggcagccgcggggcgcgcccgaaggtggcctcgccggcacggccgacgggaggcggcgcactcgcgccccgatggtcgccgccggcgaccaacggcgcggcggagcggcacccgagagagaggagggaagggggaagcgaacggagcggtccacggctcaccccgggtcgacgagggcggcggaagtgacgaccggagcggaggaagacggcggcgcggctcgggactgcgaggacgacggtgctccggcggtcgacgggcgaaacggaggcgcggacgaggtcgacggggacgcggcgaagccgatggaggtgacgccgagtcgggaggaggtccggagcgacgacggcggcgaaccggagctcggcggcgacggcggagagaaggtgcgacggtgcgggcacaattccgacggggagagtgagcggcgagcgacggaaacggaggagcgaagcacgaggagcgattatatagcgccgggagagagagagaacggccggagaggaaggaatcggccgcggggatctcggctccattgattgcgccggcgaactttgcgggcataaaatcggacgaatccgagggagagagagaggggaaaacggggggaaagagagaggggatcgtggggaataaattccccctcattatggcgcgcggggacggcgggatgcggcggattcggcggcggcggcggcgctagggcacgggcgggcggcgggcgcggcgcgaggaaggcgatgacaggtgggccccacccgtcagcgagggtggcgggcgggcccgcctgtcagcggcgcgcgcgcggggaggaggccgatgggccgcgggggagaggagagagagggagggagagttgggccgagccggcccaagagaggaaagggggggaaaagaggacttcttttagggtttttctttttataaaccttttcaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatgaattttaattattctatgcacaatttcgaggatgtattttagagtcgatttgggacgcgacagagggagaggctggctcatactttgtagttccttcatacacgtatccaccaaaacacaggagtagggtattacgcttctcagcggcccgaacctgtatacatcgccggcgtcttgtgtgcttcctgtctcgcgaaccttccacagattgggagtttagagtctcacccagggtccccggccgaaccggcaaaggggggccagcgcggtctcccggtgaggagccccacgctccgtcatctggcgcgccaggtaggggactctgcgagtgatcttctgagctcttgcactctttcgtgtgcgccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagaggaccgaaggatccgcgacttcgacatccacaggaggtggaaaagggcggcgagatggggagcatcgcctcctcgtctatggtgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgtctagatgctggtgggcggtcctccgccaccaaggcctctggtgctgctaccaccggctccgcgtcgtcaagacgaagggcgcggcgagcggcagccgctgttcgccattcggccaccactccttcgtcgactccttcgacccgggaagatctacgtggggggccggacgcccgcaccagcatcgagcggcggcgtaatgaccaacgtgctacccacgcaacggagggcgcttcctcgtccagagtgtcacctcaacacggacgcgggaatcagccctccgtgcccccagttggtggtgtcggctgtagagcctttgtggcgagtcttcggaatgtccgttggcccccaaggttccggcccaccatcgccgaaaaatatgatggcagcgtcaaccccaccgagtttctccaggtctacacgaccgggattgaggccgccgggggtgacgacagggtcatggcgaatttctttcccatggccctgaaggggcaggcgcggggttggctaatgaacttgccacccgcgtcagtccactcctgggaggatttgtgccaacagttcaccatgaactttcagggcacatatccgcgcccaggtgaagaagcggacttacacgcagtacagcgaagggatgatgagtcacttcgctcgtacattcagcggttctgtcaagtccgcaacaccataccatgcatccctgcacacgcggtaatctacgcgttcagggggggcgtgcggcacaaccgcatgctcgaaaagatcgcctccaaggagccccagactaccgcggagctttttcagctcgcggaccgagtggctcacaaggaggaggcctggacttggaacccctccggttccggtgtggcagcttcggccgcccccggatctgccgctcagacagggcggcgtgacaggaggaggaagaagaggtcagtccattccgacgacgagggtcatgtcctcgccgtcgagggcgcttcgcgggccacccaaaaggggaggcctgcgagtgacaaaaagaaaaaggccggcgctcccagcagggagcgcccagccggcaagtggtgcaccgtccacaacacctccctccacgacctcatggactgccgtgcggtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcggccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgtcaacttccgcacggagcgagtgaactttgatgtggcggacctcagtctgccctacaacgcggtcttggggaggcccgcgttggtaaagttcatggtggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcggcaggccccggaacgtcaagcctttatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccatagaaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgcaaccaagaaaccttactctcggatctagcggaaacttttgaaaacctccgctccgcccgcataaaactgaaccccgataagtgcgtgttcggtgtacctgcgggcaagcttctcgggttcttggtctctgcccgaggcatcgaagccaaccccgagaagatacgagctatagagcggatgcgcccccccagcaagcttagggatgtgcaatgcgtcgccggttgcatggccgccctaagttggttcatatcgaggctgggggagaaggcgctacccttatttaagctcctcaaacgctccgggccgtttacttggacggaggaagctgagcgtgccctcactcagttgaaggcgtatctcagctctcccccggttctggtcgccctggagccaaatgaacccttactactctacttagcggcgaccccgcaagtggttagtgcggcgttggtcgtggagcgcgatgaggacaatcctcattccgtgcacccccaccttgtgcagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaagtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacaacacgctatcaagagccaggccctcgccgattttgtggcagagtggaccccggctcccgagcccgtctcgatccccgaggccagcacggacccctcgcagctgcctcacaccgcccactgggtaatgcagttcgacggctccctgtctcttcagggcgccggtgcgggggtcacgttgacctctccgagtggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgatggccgacgaactctcacggctcgcgtcctcgcgagcccagaccccaccgggcacctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaagttcattaagggcatcacggcccggtttggagtgcctaaccatattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcactaccatcagcgtcacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgccgggttggccgggggctgccacacatgcacattcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcgacaaaaacccacaatcgggtcacccataaccctcgatcaccacgttccaggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactaaagaatggcgggggtctgggggctcaatccgatgcgcccgggtcgccggcctcgtcgtcactgtcgtctgcaccaccggcattgccctcctcgtcggagttgggggcgaacgcgagtcgaggggccgagccctcgaagctgtcgacgatatggtcggcggcatcccggacctgcgcgcgcgcacggtcctcggtcccaggagggaactcatccagcgccatccatagagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcacaatctaggcaggagacggcgtcccaaagcatgccgggcccaacctcgcctgccaagcggaggtcttcgacctccccggcggacgagtccagcgcgccctgcagatcggcgatggtgtgttcggcagctgcgaggcgggcggctaagtcgctttcgcccgcggccgccccgccgctgcgcgccctcgcgttcagctccttcgcccgcgcctcgagctcagcggcccgttggttcagtgcggccctctcggcgcgggcaccttccagattacggcgcgcctgctcctcctgcgctgcctcgcggagggacaggctgtccgccagctgttgcgccgcggcctcggccccctcgagagctcgctcccgctcggtgagcgcgtcctcgcggaggcggagcgcgagctcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcgacgtcgagctccgcccgctctgcctgcagggcctccacctgggcacttaacccatccaacaccgtggtgtttgcggcggccaaggcctgcagaaggggctctgcgttcagtggggcgatagaaggcgtggggaagagccgccttggagaggatgccatgcggctcgggccaccgatggaagtgccggactcggggatgtcccccggacccggttggtcctgagcgtcgcccgagggagtgggcccaagcgacgcgcccgcagcctcgtcgccagctgccccggaagctgtcgcctgagcgtcgcccgagggagtgggcccaagcgacgcgcccgcggcctcgtcgcgagctgcctcggaagtcgccaacgcctcgtcctggcgaaatccggctttctcccgagcggcttcctcggcctggcgggctcgggtggcctcctcccgaacggcttcctcggcctggcgggcccgggcggcctcctcccgagcggcttcctcggcctggcgggcccgggcggcctcctcccgagcggtttcctcggcctggcgagcccgggcggcctcctgggcggcctcctcggcttcccgtaggcgatccgcggcctctcgccggtcagattcccgcctccgggcctctgcggccgccggatcctcggcctcagactggccgggcttggaatggcgggagggacgcgacgggatctcgctgaaacaaaagaaaagaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttatgtctcccccatcttgcggaaccgcttcttcttgcgctccccctcgggctgcgatgtcggcacggccccctccgggcgcctgctgctggcgcgcaccgccccgccccctcggggaggagatgggggaggtgttcctccctgcttcctcttcccccgggcgtcggcagggcggctgctccccgggcccctgtcgcgggacccagaagcacgaccccctcccggggtagattgttcccccctgcggctcccgcctgcgccgtcgtggccctttggagctcgctcctttgaggccccgaccgccatcataatggttaggatggaggcgcggtctggatcgctgcagagggggaggattccttggggaatgagggacgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcaaggggggtgtagaaccagtcgctcttccagtcgtcccacttcttgcggagggcgcaggggatgtagcggttcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcgggaaggcggcagcacgctaccatcgagcagagcggagccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcgagtaatgtggcagtcttgaagagaccgctcattattgacagccgagttaccattgccgatgtgcgtaatttgtggccgttgggtttctgcccaactgtggagaccggtccccacctgtcaccaggccttaggaagtggcgttacgcccgaccgcttccctcgaggagggcgatcgccctggcataacgccgggggctactgtcggtgacatgggaccgggagtatcatgactagaggcttgaggcagacacaatcgcccacgtggcctggcaccgtcagggggcgtcgggcccgagggtgatgtgttcgccctcctctttaccgggagtatcatgacttagagacttgaggcagacacgatcacccacgtggcctaactccctcgggggggggggggggcgggcccgagggtgatacggccgcccttctctttgtctccccaaggggtcgggccgctcccgtctcggcccgaagggccgaagcgccccgaccccttgtgggttttgcgccacgtatatggggtaggtgagcatggcggggctcacctaaccacatttattgcagttttgacgagcgcgtcacgccgcatgtatcgcagtacagcacgctcgtttatccggtctgtgaccagtcacagaccggtcagatcatgggttaggtggcgacaggcggtctgacgcacgcctcgccccatcccgtcaggacgagagcctccaagcactcgtccctagctggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcaagtcatcagcagacagccatcttcccacgtcgtgcctacctccggcggaagtggaggtaggtatgggccgtcccgtcagaaggtcattcggacggcggcgatgcaaatctccgtctgttaatgaagagaagtcaaattggaagaaagagagggggagatggtgcatgtggtatccccttaagatataaaaggaggaccttgcccacttagagaggggattggacttttccagattgggaacccagaacgagggagaggctggctcatattttgtagttccttcatacacgaatccaccaaaacacaggagtagggtattacgcttctcagcggcccgaacctgtatacatcgccggcatcttgtgtgcttcctgtctcgcgaaccttccacagattgggagtttagagtctcacccagggtccccggccgaaccggcaaaggggggccagcgcggtctcccggtgaggagccccacgctccgtcaacgccgatgatggaagcgaagacgcgctgaggagaattataactaaaattttgggatgctcttggtgatgctattagagaatccgttgaaataataaggttttgagatttacttattcaattcagtggataggcggatcgaactcaaagcaaggtgtaaagtgataaggcgttacgccgtggtcaatcttcagatatagagtaggtaacgaactggagtcagagtgaactgcaatatttcattcagtcagccataagggggaaaggttggcggtgacaaacaaggcaccgaccctggttctgacttgtcgcggatctcacttgatcagataggctacataaccatatgtcatgtaccatatctgacttgagaagataggcaaaaccacctatggttatgcagggtagagaccctttactttctagtcattgacttgacttaacttttaagccaaaactcgctagaaaagagaggaaaatccagaggctttaatagttgaaataggtagagaaaatcctaacaaaaccctgaaactataatctactatctcaaatgaaaaacagtatccattttatgtttagcaaattaccattgtttaacaagttgaattcagcagctgtatataaaatcccacttgtcgctaaggaacatcaaaacgattttatctttctgcaggaatttatcaaaagatataatcgatactacatacttcctccgtttcacaatgtaagt

SEQ ID NO: 10468 - DNA, 5895 bp, Oryza sativa
acattgtgaaacggagggagtacataataaaaagtcttctgttggtacagctaaagggtctggcggaaattctttcggaactccaaatccgttttgggctgaacacttgcgaccctatggtcattcgtgttcttttttcaatttgaatattcccatacataaagtttctttgttgaatattgctatgcatttccttatcaagaatataaacacatataaaatttaaaatttgtccaagaatataagcacatccccatatgctttctcatccaaaccaatcatgcacagtcatatctcatttaatattttcacatattttcacatctcaatcaatcataaccattactcatcttgatcttaattaaaagaactccaaatgtgtttatattattagagagggattataaagtttctatattgaaaatttccatgtatataagtcgtccgtgtgacttcatcaatctcaacatacgctggtataatattttagatgtgctcataaggacaggatgtgtgtattcatgaaagtgagtatgcgctcgttacgagcttctacgtttctactgtgttattttaaaaaatggtttcaagcttttttttattgggccgaatacatgcatgcaaatgggtcgttgcacattggacgtgggttagaaacatgtccgcttcccaaatgaaaaaggtaaaaggtcgcacacatggacgacaagagattgatgtaatgcaatattttttttaaaaaaaaacaagcaggaaaaaatagtttcttcaagaaacaactcaaatacagtgttgcaacaattcaactaaacgcttgtaaccataaaaagctgcaacaaacattaatcttactatgaaaaggatatctattgcgtatatcttagaacttggaagaagaagataaatagagttagagaatatttgtttatagtccactaatggatcgatacgttttaaattggcacatactgtatggtttaagtatgtactccgtataaacatatctttctttttttctttaatttttttttcatcgagtgctctctctgatccagatacgctagattggacggcccgagcatctccaacagcctctccatcagactctccaagttaaattttggcaactttagcagaaaatagtactccaacagactctctattcagatggccaagtaaaatgactggtcaaactcctctcccaactagccaaatttggccattcaaacagactagccaaatgtgggccccaccatctctctcctctctcatgccatcctccctctttgtccggcacagttgggacatgcggcccctccctctccgtcgttgtccccatctccgcccgtgcccgccgtcgcgcctccgttgtcgtccccatctctgttgtcgttcccatctccatcgtccccatctccgccaactccgtcgtttgcgagggagcatgaggactcatcgcttgccttccccgacgcatgccgctgccgcctccccacccagtaaaaccccacttctgccgccgcgccttgccaagccaccgctgcaggagagtggcacgagggagcggcgggctgcccctgcccctttccctcgcccacgagctccatatccagttgcctctacatccgcgggtctatatctatggaggtgaactcctcttcctccgctccgccgccgtcgccgccctccatacccgcctccagcgcctgggctgatgcctcgctgctcctcgatgccgcgtgccgtggtatgccaacgcaagagaagaggaagaagggaagaaagaggaggaagaagaaggaagaggctgacatatgggtcccggtgtcatagagtcaaagtagagagagtggatggagaggctgttggagtaaataactagtttgactagccaaatcggatggagagttggttatataaatgtttggaaagtctgattttgagaggctgtcagaaatgctcttacaagttactccctctgtttctaaatgtttgacgtcgttgatttttttaaatccgttcgtcttattcaaaaaatttaagtagttattaattcttttcctatcatttgattcattgttaaatatacttatatgtatacatatagtcttatatatttaaaaaataatttgaataagacgaacagtcaaatatgtgcttaaaaagttaatggtgtcgaatatctagaaaaggagggagcacaaagcatttgctgctgtcttgctgatcacacctttcctcgtcgtggccgtccgattcagcccagaaggccagcatccaaccgtccataccgctcgttgccctactctttgctcggctcgggtgggtcccactctcagtctcagccgacgccctccttcctcccctcgcttctccgccgccacttctcctcgccctcgcgcactccaccgccgccgccggctctcgtctccgtctccaaccaaagataatggcgtctctggcccgcgccgccgcctccgccgcgagggccgcgctccgcccggcgccactcgccggccgcgtcctcggctcgccgctccccacgcccctggcccccgcccgggccgcccgcatcctccgcaggtaggcgcctaggctaaacttgtgagagttcgatgcatcatcgtcgtacatatacattgggttcatggtggcgtgcgcttgctttatgggatcggtgcaggtcggcggcggcggcgtccgcggggctggagacgctgatgcccctgcacagcgcggtggccggggcgcggctgaggtcctgcatcgccgctgactcctcctgctggagctcgctgtcccaaggtaaacgccgacaatgcttcccctccctttcggattaatcttatggatattcacatttgcaaacgtaagcctgcattggatctgttgttgattgttgcatggtgtgtgtgaattattcttgtggatgtatgcttattgtcggttcagtatagagttcctcagtgaaaccatgcaacttattaccaatccttggtttacagaaactaaaaatagaatcggttgatagtaccatcctggtttgtgcaccactcagtttgcaattattgtctgtgctgttcaaaacttggtctgcacctagaaaaattgtcgtgctaaaatccgtagttaaggtatgagttgtaagttatgttctttgtcagttagatatgaggcatcgtttttcactaaatagtttgaacacaagatatatcatccagctttacagaaagcgtaggagttcagagtactactactttagaaaaacaaacactgacatatgacattctagaagcctttgggttgtgtagttttcgcatttagctggcaacccttcctttattggttaactttgtttgatttaccctgtaatacctccatttttttatatttttcgtttgatacactaacactgatagattgatacacctttgacaatttattttcctaatatctgttgtttttttttgaaaaataaaatgatcagagactatatctgaaggagaatgtttttcaaaatacatggatttttcacttgaagggcttggtgcattttttgtactttgttattccctacatttgtgaccaacttagagcttctgctttctgttctgtgagctcttttggtatgactagacgtaaggaggcttagctgagatctatagaaacattttttgttgatctcctgctgttattgctactgtaaaaccttgctgaggtatttatcagtaagcccatagaacaattttctacaatgcttgggttcgtattcattgatttgtagacacatagacacttggtaagtttgatcttcttgagcttctctggtaagggcaaactttctttggatgagcttcctgggcaaaattttgttgaaagatgcttgcatttaaggtttgcattcatgaccaaaaactaatactacttccttttttcatgttggtaatgaattaacaaatgcaactgttgcttgtggttcccttgctctttttatgttgaaatcatggattttgttgtgttctaaaacaagggtttattggatttactaatatttgttaattggttagtatagtagactatcaagaatctagttgcgaactgcatttccacttttttttttcttgtttctgaaattcgaaggattgttgttgctgtagtcctccagtctggttaagtaaattactgaatccatgtggatagtgatacattgaattgagatgcttgtagataaggttagctcgtcttaaaaaaatattatgtttttcctttattaaaagtatggggtttctatcttttgactctgggttattataggtttaaaaaagcgcatctgatcatggctaggagctgtgctgcagtgaagcgaagacacactgagtttaaacaaattgcatttatttgcagatagttctagaactccagtttttgcagttgctccatgtgtgtactcctgttagcacaataatggagcaagcaaaaagttagttcctttgtaacaacatgcttgactctggttttcagtcaatcttgataatgaccaaatgcattcctgtttttattttgagccggagataaagcaactcgtaattgaaatgaggcaacgattgtgtattcatgacctgacttgctcttatatttggtgatataggatatgctttgcctttgtgacagagagctgcacctgaagaaatcaatgaacattattaggaattacagacattgcgttctgggctgtaacacctagataactgtgtggtgttgccttcaaacttgttttggttttgtaatgtgcttcaactgggttttttgaataatatctgttgatcctgggatctatggcccatgaattatcctcttcagtacgattgattgttgctgcgtttcccttcatttgccctgctatttgaaagttccttcacttgtagataggggtggacaaaaagctcgaaactcgtggctcggatcggctcgtagcaagctcggctcagatcaattcgaactcgtagttttaatgagtcgagtcgagctagccttttagctcatgagcttaacgagctagctcgcgagctgctcctttagctcgttagtataaaatatcaccatatcttcatgaacttagtgtttcttgactagtgcttagtcttttagttacatcaaaactattcatatttagtgagtactatattagttagtgtttattattatgttaatacataataaaatcttaaatttaaaattattaatatggtattaatgagatatagcttgttaacgagcttaacgagccaactcgcgagccgagccgagctggctcgttaaaacaacgagctcaaacgagctgagccttaacgagttgagctggatcgttatctacccctacttgtagatagcatagtacagccgatgaaaatatcatgaaatgttctcgagaccagggttcacagaactgatcaggctttgtgaaaccggtcggtattagttggtttccatatggtgtttttggtaaaacggtgggaagttgtttttactttaaaaatgaaaatcgaaaagataaatttaccctgctcgaggctaaggtcacgatttccacaacaaaattcgagggttacctaagttgctctgttctcgtgcaattttgtttgaaagtcgtcaaattttacaaattttatcatctcgttgtggttctaatgcattttttttacggaattgctaaacttctgtcgactgaaaatacaacctcaaatcttgcaaattttagatcactggatgtgcttcacgattcgtgctcttcttctccaactctggcaaccccctcttcttctcgggtgctggctaacccaaactccagcagagggccgacgaattagggtcccagggtggggtgggggtgggagg

SEQ ID NO: 10469 - DNA, 19105 bp, Oryza sativa
tcgccggctttaaagggatggccgtaggaggcgacagcccggtggcgaggcagcggcggcaccgccgaaaccgtggggtcgggagctgcggcgaggcagcggcggtgccgccgaaaccgtggggtcgggagcgggcggtggaccggcgtaggcgacagggcaaagcggacggattattaggaggaagaggccggtggtggcaccccgtcgctggagacggagaagacggcagcgcgagacaactcgcttgaggaaaaggagaggagagggagggggagggggcccgccagggggggcgatcgccggcgccgttgacgccttttggccgatcggcgaggcgggcggcggcgggggatcgggcggaggcggtggaatgggcgatgggagggagtggcggcagtggaatgagtgaggggaggggaataggaggagagttagggttaatactatgcacgaatcttaaagcatatccgacgggctaaaatttgaaagatgggaggtgggattttctgttaatacatatataaatagtctcttttttttttaatcccggagcctatactacccttgtctagattatgtagactgtaactactcttgtcgagttgatagatacggtaccaaatctaagggctcggatgtcctagttgatagataatgtacctagacgtgatgccctagtttgttcctctctcatgtctatatgcaggcaaggaccgtcagattcgaatctaagagctcacatttaccgagaaagtggtgtgatttattacactgtagtttgatcccagattttgagatacctggaaagctggaaaacagcgaagccggcggctattgccggtatgtatgtcgccggcttgcatgcagcacgacgagctcgctagctagctgcaagcatatgcatgcagctccattctcaaaatttaaaattcaggatcttcgaggattcaaaaattcacattgttttttataaaactatacttcaatttaacaatattcgccttgaaaccaacaaaaactgcatactccctccgtactcgtaaaagaagacgtttaggacaacgatacggtctccaaaacacaactttgactactagtctctataaaaatatttattgaaaattgatatatgtatacttttatgaaagtatttttcaagacaaatctattcatataatttttacatcttgaaactcaacaacttaagagttataaattgacttaaacattgtcctaaacgattttccttacgagtacgaacagagtatcatatctttatatcaggctgaacacaatttagctttaatcaatgtagtaattctcatcaacaagctaatgaacacaatagcccggggccaaaaaaaaaaaaaaggtaatggacacaaataagcttagttagcagaagtgagtgctcgatcttcagatagccatattagatatgaacatgtacaatttagttcaacttaattaacccagctgatgggaatcaaaacattactactgatttacttaattagtggattgccagtgccaaaatcccactactatttaccaatactactacgtatggatcattgggtaccactacgatcgagcacgcatgctgcagctgccgttcaatcagtagccgaagaaatctctcctacggtggtcggcggcggcagctggcggcggcggcagagccagctgctggtggtggtggcggtggcaatgaccggcggcgaagctgaagcagtggtcgaggtcgagcacgtcgacggcagccgccctcctccgcttgtaattctccttgaagcacgcctgcctcagcttcttggtcctctccgtcagctccaccgccgggttcctctccatcagcgcgcagcaattctccagcgcctccagctcccgccgcatacgcgccgccgacatccccttgctccccatctcctgcacgccatggacggacggtgcaatgcaagcaaagcaagaactgaattggtctggaggaagaagacgaagacgaggctgatcgagaaggttctaggggttaggttgatgcgtgcctggacgttgaggatgagggacttgaggctcttcatcttccggtgaggccaccgggcgacgccgagctcgcggcagcgcttcttgagcacggtcagccccacgttcatctccctcgccgccttggtgaatggcatgtagaagtacccgctcaggtcctcgaatccgatgtggtccagcccgagttcccgcccgccgtcgccgcgatgatccgtcgcgcggcttctcgtcacgccccgcggcgccgccggcggtgaagaaaaagaaaaaggcgtcaatgtcgttgcggctgatgtgatgatctttggcttctgctcctgctcctgctcggcggcgtgacgtcgcatgcccatctcgtagctctcgacgatcaccatggacagggagtcgtcgccggcgagggcggcgtcgttgcgttgcttggtcacgtcgaacttgacgtcgtcgtcctgcgtgccgaagtggtgggcgccgccgccgccgaccgccgggagcgcgatcgccgcgtcgagagtgtgctggggactgggcttgggctcgccgacgccgacgacgacgtcgcgcgcgtcggcgaacgcgtcgaggtcgatgtcggtgaagggcatcctcaggagctcgtcgtcgtggctgccgccgcccgccgtcgccgccaccgccaccgccaccgcgggcaacgtcgagacgaactgatcaggctcgagctgaaactgctggtacatgtagtggtcgacgtcggcggcggcggcggccgacgcggccaccggcaggtagccggcggccatctccatctcctcgtccctgatgacgacatgatcaaaaccgttcaaattctaggctgtaataaatccatcgagttgcagaaagaaagaaagaaggtgaagaaatgatgatgttcacctgacaacgagatcggcggtcatgcaggcgccgcctattccggccaccgcgccgccatgatcgccggcggagtgcaagagtacgtcatcgtgatcactacacgagacgattcaacaacaatgtcagtttcatgtactactacactcctactcgtgaattctacaaaaccaaaaataaccaaagcgatgatgaaatgaaatgcactgacctgaggaggagaagctgcgacgaccacgaagaagaagaggaagaacacggcggcgggatggcggcgagtgggttgagccagtcgccgccgatgctgccgccgtagtagcagcactcgtgcatctccatcatgatcgatcgatcgacgacggcagttggccactgaagctacctagcgaagaacgtactgcaaatttagcctgattgatggtatcgatctcagagttgccgatggatgctgaatagtgcgcctatttatatacacacacaaccagacgcgtaggaatactagtatactcctacatatgtggatgtgtgtgtacagtaaatcttgaaaagagatttcgcatgatgggggaaaagatggcgagatgagcaagaagcagcaattaatgtgtagatttggtggatcaattgcatgatgcgttcgtgtattcccgagccgatcgaggattgattgatcatttccactgagattcatcggcggcgcgtgcacaggataaaattaaaacgctttcagataagacgatgcaggtaataattaaccaacctgtttgcttgtttaaaaacgcacgcgtccactacctcaccatcgacggatggatggatggatggatatgaccgcctcggtaactaacgcctgcatgcatgcatgatatgatggatgcgtccgcgcttgactgacgtcgtgtgcggccgcgcgcggcggatagacgtgtgacgtgtgcacgtacacacacacatcggatgcgcgtcatcgtcgatggatgggtgatggatatgggcgaacgtgtgaacgtgcctgccggatgatgacggtgtatgccctcaatttgctgggctttagtctattgggctacagttgggcctttcgggtcagatgtgctttcggaagcatggcccggtcgacttagatcaggcccagtgataacactaactgcacattccgcattgaataagtaataagtctatcgtccgtccctcatctttccgtcgagtttgtatcgtggtcctcgaccgcgcgcagaaccgggtacaatgcatccctcatctcccaaaactagtgtaaacgatgtcctaaggaaatatggaggatggtttttagcttacatggtgcctacgtactgaccttaaaatttagaaataaataaaaattataagtgtgcctcacacatgagtgacattgcagtcttaacctcccctctctatcctattccccccatctttcttgtagagcagggacgagggggaggagcttcagtagccaccatggcgggaccgtgccgacattgatgtcagttatgcgcatccgctaggagcatcagatagtcgcacaggagtccatccccaccaagcgctaaagggaggtatggagggaacatgtggagtttgtcgagttcgccggtaaatagcatggcttctttgaggtggacccccagcggtgcagtgcctccagagctctaggaaaaaaatttcaattccgcttaagtttcttgctgtaaagttcgttatttaactgttactgctcatgtgtttctgagaagttttgagaggatggtttgggttcaagaagtcagaggaaggggatggatccggcgttgctagatgacatcacccagaggcttagtgtgacatgcggcccaattttgatggcccgtgagagttgtgtacgcatgtttagtactgcattgctagtctagcaagaatgaaatcaacttataaggtcttatccctccagtcatatcactctttgggttaaccctcttacaaaaagtgaggacggaagtgtaagtgggtgcacccgttagatgggctggattgcacggttctggagtcagagatacttatcgaggtgaagaatccatgttccatatttgtagaaggttgacctttgtgtttctctcatgattcattcctcttcctgctgagtccctttctcatctcttaggagatcttatctcatcagcccaacctttcctcacttcttgccatgcccgagcaatattttgatgttggccatcctcaaaatgtcatcttggggattggcttggtttttcaatggttaccaagtgtcatgttgtttggatgcacttgcttaatgtactatacccgatcttcggggtgatagcccactgttgtccaagaaaaatggcggcgaaggaggcgggggcgaggaagatcggaggacgatggtggcagacgacagagaggagaagaatggcaatggacggtgggacatttggggatggctcagccacaccatctcccttactagcattccactggtctcatcggtgccggcctcccacaagatggtgccactacaccatctctcttgccaccgaggatgccattcctctctccattgagagagatggagagaaaaggggggagagaaaggagggagagagaagatgggaggagagtgagaatattgtgtgggcccagttttgtttgtgccacacaaatacctaggcagctcaagtagaccggtcaacttgccatgatagcgaaaccaggtatttatattattaccggaggacctatctaacctggttttgtaagttgtgggccaagatttttggtgttgtgatttagggatgttattgagggacgtaaagtgtgcatgaaagtgatttcatttcatctcttgaagatgaaatgttatatgtacaaatataatcaagaaaagttttaggagaatttgacgataatatatagatcaacatttgaaatctgttcaaaatatttagtcgattatggctttatagggcatgccacgggcgtattcgatgaatcatgggtgggtgatgggtgagtgtggatatgcatgccttgcggtgtatgtatgcgcgtacggttgtgggttatgaacacgagcttttcctatttaaggcatcgaaagattatgctcggataaggcaccgcttgaagaactcgagcctacttcctcagtttttttaacactattcccaaaatactagataatatgttttaaaaaatattctatataaaaaatcataataaaataaaataaatatttttaaagtttgtaatagtaaataatttattatgcgctaaggcttgtctcattctatgtaccgctggaatgatatgctcaactactaattcaatcattgcagttacttcgtcgtttttcttaaacatgtttatctaactgctaaatagtgtgtatttttctaaaaaaatatatagaagtttaataaataaataaattttattttaagtatgtaataattaattaattgtgcgctaatcacttatatcgtgtggttaattagcagcttggaagctaaagtcaacgctccctaagatggctcacaaacacgctttcctacttttctctacatcgtgtagcgcatttcatttcttcattttataaaaaataaaagaaattttctattgagttaaaaagccatttttatctttggatgaaagtttgcactataacctttttaagaaatatttgtatgaaatattttgtatgcatatagatgaaattttaaacatattgatgaaagtttctctttgtcaaaatcttctactagaattcttttaaaagaaaggcatgaaatttgccttatatatattactgtattgatagagcaggagttgaaaatcagattatttataaccgggtgggagttatggtcatcctaagaccactacagactggcttactctcgcagcgggttactacactactacaggccattggtaattaggttgactactccaaatgtgcccacacgagtgcatgcatactgacacgatttctttcccccaatacatgcattaaaaacacacataaacatggaatgacacgctaacatgcaacaagacccggctatggactgaaaaccctaatggcggatagatgcgagcctcctctcccgcgcagcacagccacgtggcgcacgcggagggggggggtgcgtgatggtttctctagttttccttctggctttttgtggtttttttctttttttatcccggtttttgttggttttcctaatatgtatgtatacaaacttcaaactttatatacaaagtttaaacatatacgtatataaagtttgtataaatttgtgtacgagacgtatttttaatttttttaatacgtacgtatgcaattatggcgcgaggagtcaccggggtggcgactcacctagacttgtatatgggctttgcatatgacgtagaagcgggcttgcatcatggcgttggaccgatccataaatagcggtgtctcagactcctcacgtagttcgttgttgccgtttcagctgtacgctggtaggacatccactcgagagtttaaaattcactctcgatgtcatcccttaagcctacccaacccaaaatattagcctgattatattggttcagatcatgaccttcccttttaagttgtgtgctttcttataatcaattaccaattggccatcaccaactagagttcacaggttcctaaaaagtcaaaaattcacagatgtagagaattcaccaaattctctaccgaatgtcatttagtaaatccaaagttaggagaaaaaaaaaggaataagaagaagcagaatcagaagcaatgctgcataattttgtgtcacgacaggagaacatgaggggagagacgcgcatggaatagtttatcatcaaatcttactcgacacatgctagaggtcgtgcgagcgactacacatgctgacatgcagaggcagccattagctaggaccatagccgtttgacgaacccaacaaaagggaacaaagtcacaccacttaaattatccagcacattacgacatctctcgtgatccgccgcgatgagcgccaataattctcttcgaatctcggcagatgagatcagtccatttcacacccacatcaaagctccccaagctagccagcatctgtgagagacagataaaagaaaaaagacgagaaagaatgggtaaaagcaatctatagcagggaagaagatgataagaccatatcatgcatggcatgtctcacaagagtactatcgtgtcatgagagaaaaaaaaaagattacaacttctgttcatgggtgagacagtgcagaggacacacaagcactgtttggctttgcttaatcaagagttaaagccaatgatgtctcccaaacacgagagcatttcttaattccatgtgtaatgatgcatgcaattgctccagggggtttctcattccgagtggtggtacgggggagcacttttgatgaattaatattggtcacccccgtttgtaaatacatatcagtttgactttgactgatcatgctttggctagcagtaataattctcaaattaaattatagatttgcgatgtaaagtactttgttctctctgtttaatattataagatgttttgatttttttaagtcaaagtttaaccacatctttagaaaaatatagcaacatctacactaccaaattaatttcgttaaatcgaatattgaaaatattttgatactacatttgttttgtgttaaaaatgttaccatgtttatatataaatttgatcaaagttaaaagagtttaactttaaaaaaagtccaaacgccctacaatataaaaaatgagtgtatttttgtatagctcacaaattacatgtcaaaattatacctattaaagtcagcacctgcaagtatttatgaattgatgtagtagtaagtttgccaaggtaggggtagttaactgataaaaatattctaaaattgttaaggagacatctttgagttcttgtgattatgattgaacctgcagtcagtgtgatgactcatgaggagggccccatatgcatggggccaaatcatgaccatgcacaagattagaaagaaaaagaagcaaataaagcaaagaggagtcctgtcctccatcccaatcaaatctcagcccagctgctccttttctgaacttttgattagccccatgcacagtatcagccaaaccatctacttagagcaaggttaatagtgtcgcccgctaatggctgaaaaataaccacatcagcctcttatagatattgctaagagctaatgtatacaataaacaggtttacatcgactattatttattttttaatctttagctaacttccccatccaattttttagtcttattgccgttgtttcgtccaaccattactgcatcgcgtcagctcacgtggacccacaatcgcatgtcccaatcaaagctagcctggtgttgctgcacttgcgttgggacgtgtgtttagccggcaacaatttagtcgccgactcatgctctctctcctatttagctcattgacaaatccgatgtggcagttttatcgccggctaaactggcttattgtacttgctcttacttgactgcttaaccaactgagcactgttgtaattaaatcagtgcatggctagccctaccaacttcacttcagagctcagactggacctgtccctctgaatatttgttttggttgttccttgctgtagaggtagggatcaggctctgaatgagttgatgatagtacaagggagaattgattatcagcatggcaatggaggaacatgcagacatagcaatagtgaaactagctgagtactataactgctactagcagttgtgccatgaatattcaccagtcagcatccagtagtagcaggaggaggagtaagtagagactagagagcagcagttatcactggtctccttggcttggtttgcacgggcattattatatgtagctgttggctgatgctgccattgccaggccagcaccataactactcctggtactatagttaaataggagtatctgtcatgctcatgacatgcttgccttcttcttattctccttccctatggtcttcttcttcttcttcttcttcctcggagctcgttgaactcctcccgccataattgcatcccctattcttcgccaccaccatcgcaagaatattctttgaagtgttttgtgttgtacttgcattcatctctctgatcaaaagaggaattggcaacagaggaggatactaggatggtggaggcagtggcgtcttttcggagaggaggcgttggcattgccgggatgagcagcagcactctggaggaggtgcagatgcaggagacgctcatcttctctgataccatcaaggtcagtagtcccaaagttcagagttcaggcatattctgttcttccctttttggtttcccttcctcttctttgcctgcaaaatcatttgtcattgctcaagctttaatcacagtcaaactcaatgaaaatatgatgaaatattgtcaaattggatttggtgttgagcttattaagggaaaaaagaacaaatattgcttggctgtttctttttcagttaggccgtatagtatttcgtttcttttctttttctcgttgacattaggcaactaaagaaaatactgcatagtttgatgagatttgagtcttcaccggtaaccagcaacacgttgcgatcttcttatttcaggatctcaagatgctgaagtcgcagctgtactctgcagcagagtatttcgaactagcctacacgcaggaagatgacaaacaggagtacgtgatgtaccgattctttctttctttttttctgcactagatcatcaagcaaaaccccagctgctgctagaataattatctcaaaatgtgtacgaacaatattatttgtagggtgatgaacaacctgaaggagtattccgtgaaggcgctcgtcaacactgtcgatcacctgggatccatatccttcaaggtttcaagcctcatcgatcaaaggttcgatgaggttgacgacacaaatctccgggtgtcctgcatccatcaggtactaattttcagagttcatcacgaatagtacctgaattcagtactgcgatctagtatagttcttgaattaacaaagtgatgatcaataataataacctgaagagagcccaagtgagccaagcatgcatggacaaggaaggcctttcacagcaatcattggtgatcacagctcccaagtatcacaagaggtacatcttaccaggtaattaaatatgtatacctctccttttgttttggtccaacttgtcagcaaattctgatggcagggagtaaacaagaattaatttgtgtgagacatttcaatcccgttattcattaatcgcagcaggagatggttcaatgcctaatgctgtgcccaacttcagcgagatgaggaaggccaagaacagagctgcacagatgcaacaggtcttcagcggtaagggagcttaaattgtactccctccgttccaaaatataaaaaaaattagaatactattaatctggacagggaaaatcccttatattttggaaattttggaacggagggagcaatcatgagaattattgcaactcttctatcaatgatgagcatgtactagttgtctcgatctccttttgacctgcaatgttttgccgctgcagcagcagcagcatcccaagcaaaagccaaagagaagcaaccttcattcaggtcagtctgctatgcacaacagcttggacgtttgtccatctccagcttggaagttggtgatctgaaaaattgacaattttgcagcaagcttcggtcgatcgcccgtgcaccttcgcaacgtgcacgctcgtcgtcaccagcacagcgcccaccttctgagaatacaatacccaccaaacgaggtaaagcaatcagcaactcaccgtcagaaaaaggattcccttgaaacacaggaacttttatggcattttcataggatttagcccgattctagcaaaatttcctctgtttcaaaggaaatggtgcttatatctttgatcagatttgctcatgtttaattgcacatgctcgtttctgcagcagataagaggtcagaatcgccaattcccaggaccacgccactcacaaggtctggatcacttccacaaaagccatccttgttgaaaacttcaagtgtcagagttcaggtaaaccacacggccttgtgaatacagtccacctaagaactggaataccctgtcaataaacctgaaatatgttcatctgtcgttgatgaagatgcacacatcagagcacaagaaattggcatcagtgaggtcacaagctgacagaaacgatgacaaggaaggcgagcagactccaaagaagggcaagaagtttctcaagtcgctgctcagcaggcgcaagtccagaaaagaggagcctttgccctgttactttgatgattactgagtccctttgagagatcccatggcacagcaagaatctctgaatactttttacatcgttttcttcccatgaaaaagtttgtccttgatatgaaaaacttgtcattgtatagcataatagtaaacagcatatataagttgttgaggatgattactggagcccaagaattctggaagttttgcaagagttttgttggtagctttgtttgatcacctaatacttagcattcagcacactggcatactgccagccagtctccagtttacaatgctgagctccagatcaaataagcagcaatgtctatcaactgtgtctgtgtcttcctcggtacaattactaaccttgtccaccaaaattaccagaacacggcacagaataataacattaactaaatacatgaaagttatagagatcgtagaaccacaacaacaaaagaaactaaaataggtgctcatacatgtgtcatcgagaaatagcattgggtacagctaaataataactgagcgagccaattacatgttacattaatcttcagaaaaaaaagatgttacatcatatgatactatacataaaattcattctcttaaaatatgatccacataaatgtagagagtcagcctgatgtctagttgccaccgcctatatgtctatagcatgaatcagcaaaagagtttagcaatttcatacaagtgaaaagaccacaagagaaaatgattgtatagtatgtcacccctgctagtttacagccttgcatgttaatcattgtcatcctggtaaacaaataaacaatgctatccagatttatggaaaattttgcatttccttgtatatataatggacatgcatggacaaacaaaaatcgacacctacatgacctaccgcatacaagacgcgagttccatgccccacatccagacagctaacaggagtacctttgtatacaaatcccattaaactgttcagattctgcccagctcttactttatggctacattcttgctatgccatcccttgcaacagcaaaacatctcatgggaaaacaaaattgcagaataagatcaattgatcaaaggaacaatctgaacccaccacaacaaaaccatcgctagcatatctcctcccttctgtttgttctaatgtgggcgtacatctgcaaaatcattttttacctgcacaagtttcacagaaccatccccaccgcacgagacaaaaccattaggtaagacttggatgtctgttacagcagcctgtaatcaaacatatagatgtattagcgagataaaactgtcatatacttgtcttatcacaacatgataaaaaagtcccaatgagatcagtcaagattatatattaggatctacttagtatggcataccctaacaacaccaccaaagcccctagaagttggttgaaaaaaggtgtgccgctcgtgcaacttttgccaatggaagactagctgagaacttttggcatcccaaagcttcacatctccatctttgcttccagttaagaacaaactggtatttgggatggttgatacactgctgacactacctgcagatagaacagaagagatcaggtagaaaaaccaactcgaaaagtaccatggtaatatcacaaaacttacctgtatgcgcctttggtatatgccagatcatcccactgttgctaacaccgttggaagttccagacttagtgtcatgcattgaagttgaagatgccttaacatcatgctcgttggaacttctgtgatgcttagtctttccagtagagatgaaccgaaaatcatgcaaagttacatctccacttttcccaccagttacaatcagcggtgagatagatccacagcctatatttctatcgaacacagaaagagaacgaactcctcctgaaagatgaagtccatggtcagcctcagccatatatcctaaattctacacaaggggcattggagggatgatagcagtgaatatagctacccctttggacacgcatacatacaatgtaatccttaatgccttctcagctcaccacttacaaggtcaatgaattttctgtgtttgttatttagttttagttgaaagtgtggacaacattgtcagcttggcagggtggtgctgaagacttctatttattagatgatcaaattaaaaatttacttatgttgatcttttacagctgtcgtggccccatgtgcaataaaatttaagacaagaaggtttagtcacactatttatctcattagcatggttgttgcttaaactttagaggaaactagattagcaaattttgtgttttaaccatgtggaaatttttatgcaacaaatattgtgtggtaacattggacttgaaaagaaattaacctttgcttctttctccaaacccatgacgtagctatcctctctatcctactgacaactgtgtgattagatactaaaaactgaacttgttctcattcctatttctgcattagactactagaaaccaacatccatatgcattgttttcatgattatagttccaaatggaacaaagcatcaatcagtggaataccttcatgacacataatagaagtttgacaagtggatggtggcgccaatgtatcccaaataacaacatttgcaccatttgaactgcatccagctgcagcaagaactgatccacttgcagtcagaaatgcgacatccctgtgatcaataagaatagactggtaaggttgggagctctatcaagcaatgaccattccattcagaaagtttgtttcacgtacgatgcgtgggtgttaaagcacagggatgactcggtaggatgcacattgcttcttccacccacctcaacttgccatgtacaaactgtaccatctaatgcagcagtagcaaaccgctgcccataataatcaaattgaacagctgatatggaagcaagggcataaggtggtgggatattagcagcagggagaacaccataggtagccatggcactgtctttgccaaactgtaaaaaagaacagatgatattaatggataattaaacatggcggcaaatctagtgcaaaaccctctctaggtatcatatttactcttttgactgaactaaaaaatagtaaaaaaaattaacagatcagcaaagttcagctcttttttttttcccttccagaacagattgagcttggggtcaaaaaaattatgcgatggtacattaaattgaggtgctgtccttttagatttcctttaagtttctgtggttcctcaaccaaaatagttagcatgatatatcatataaccaaaatgagagtctgcactctgcactagatgtgtacgcatcaagcatcataaacatcaatctatcaaaaaatatggtaaagtcaagcttagagtgaaaattacaagcaccgatggttgcaatccaacgattttcctattttccatgaagggaaaaagaatttaagaatagattcaccaaggcccttctcatgtcatcaaccatgtgttctgctgaccaagattccagtcctttaaattaatgtcttcagttgtgtcaactgtttacttgcatgatccttagcacacaatattttaatttatacaaggaaaggtttataatcactgattgtctatgataaagggtaaaattggagcagcgaaattcattgccctcctctgtaaatcaaggcatcaacaataaacagatatgctaacaagtaaaacccagtccaatgtgaagtagtagacaaatttatagagtatttttttaaggaaagtttacctcccataaataaacatgagtattgcttgacccaactagcaacaatggcaaagatgggtggcgagacaatgctcttgaatggatgttctcgagtgttgctggaggatcaacgaaatcttcgaattcgtcaggttccccccacccaaatccagatgcgccgataccagcataacctggaattccaaatgctccaccaccagttaagtcccttccaggttttgccaatgaacctaaactaatagttggtccacctgaactaagatgggatccttttcttctgccaagaccaacactaggagaaaaagaagttgaagtaggtgtagattcgcaaccagcccacccatccaagggccaatcagatcctgcccatatatactctgctaaatttttgttatcttgcttgtcattccagttgaagaaaacaaggccctgaaaatggataaccacacagtaaaattgatgcacggcataattatatgttacttaaggagacaaacagtccacatggtacttcaatgaagagccccttatggagtagcaagtagattgtctgagatagaaaagacaatcataaccttcattcaatgtgggtaaccaaaaattcttacaaatatctgattaaaagatcttcgatctttctggtgtctagggaaccaacactcaatacaccccgacttaatgttaggcagctaacctcatgttacaaagaagtcgttacaccaaatacaattctttacattgtttgcataaagtcctatttatcatccataaaaaaaaccacctgctactttggttatttcatttcaaccacaaaagctgaagcagcatgccccatttcaattatatcttagtattggcactactaataatctaatgcaagaaaataacggaacacatcttcactgttggaatggatatacacattcacctcttaacaaatgggtgaatatcaaaccatttttaaaaattttacacctgttcaaagaaacactgaaaacatgtaaatctacagttttgaaaactacactttcgttgtaaaatttaataaaatagaatagttatttttcaatgttaatgaccaaggaaacacaagaaagaaaaaatgcaaaaaaaaagggggaaacaaagaggaaatgcaaggaaggaaaataactgaggaaaggtgttcactcaaacaatttcctcaaattcacagattcactaaccactagataaacaatttcaaataaatagtcaatataagtaacaatttaaatccagaatgcataaataatgaatgattgaaaaatagtaccttccgattggtggcgatagcaccttgttgctcattgatagagttgagacatattgcctgcaccgcaaaggattaaaatgcagtaaaagaaagggaagcaaaatgattagcatctatactgtcaatatgctgatggtaaatacctcaagaagttcaccatttctccttacaagttctctgggtctttcaaaatctgcaattaaacctttccttttaggttcaagagtgacttccacaccataaggggtattgtcaattgatctctgtattttctcgttgttcttggaacttaaattgtcacgattttcttcacttctttgagcaaaattattttcagactcaactaatgtagcttctgtcatagccttccaggatcgtgttaaactaatgctgtttaaaggaaagcaattcatttcttcatccacaaaagcagtgcagatatccacaggatgagcagatatttcccacaaagtatcaaaaaagacttcgatgttctcactgttagcaagctgaaaaatacttgagaactgctcatggctattgttgttggaccttggctgagataaccagaaaagcacacttgaatttgacttcttcagtactttctctctgaaaaatgaagcatgcaattttactaacaaagatgacacaaaatggagggagcccatcaaaaactttgcaacaactgaagatatgaggtccttgaattccacatcacttgcactagtttcaagttcaattctctctttttcaacgaactcagtcaaaaactgtttcatgaaagatgacaatcgagtccacaaagaaatacctatcaaatgccatttttcatcaattggaagactctgattctcacttctttcttgttgtatattacacaacaaaccattgactgtgcccccatctgtgccaattgatacaccatgaattttatcatgtacagcttgcagcaactgatctaatagtacttgaaaggactctctgttgacacaagcacctataactggactggtcatggtaagcaatgcttttatgtcatgacataaccaagaaaaggaaaactccatgttgtattcaaggaggtccataactgtaagcatagctgatgtacgacctaacacaaaagttctagtattgtcttgtttcagaagtaacctgctagtactcaggaagtgtgataaacttgccataatgtacttgcccactttaattgtgcatggagtagtattagcgcagtccatgttcagagcagaacatatgaagcagcaggagacaacatattgtgtaagaaacttgcagctctccttacttgacaccataaacatataatcaattggatggaaagcacaaccttcaagaccacaagtaccggttccaacatctgatgatatactaccccataacaacacgtacgcgagaaaaaatataccatcgttgcaacaaaaggtaaggatctggatacacaacagataatatggtttgttatgagaagtccaacaaaaagaacaaaaataaaagaatatggtatcccttatgttaccttctcagctatatcagcaacttgaagtgagaattttttatcgaatacttgtagcgctgccttgacatcacgtgaaa

SEQ ID NO: 10470 - DNA, 20491 bp, Oryza sativa
  unsure (1)..(20491): unsure at all n locations
ttatctttagttagtggtaggctgcaccgtgaacagagtgactgatttctcagcacgcgcgacagatattttgaagccatagttattttcaggtttgattcaacatcactgactacagatgctgagagccagttggacgaagcatggaaagggttcaatattccataaacaatcttcttgtctccgccatccagtgaggtgttgtcctttccctctatgcccgagttacaacataggtattcaagtgcttcaagctaatcagtgagaaagaaacaagatttagaacaatacaaaatagaatatataacattgagatgtcaacagggcaccctttacccaagcaagaatcattcatgtgataagaatacttacaggcagtccacatctgttcaaggcgcatgaagccattgctaatgaaagcttagataaatttgcagattgagcttcaccaacacagtttctgaaactactttttgtcgcaatgattgcacaatactgacccactccagggtctgcaaagacatttgtatcaccgggaatgctggattcttcaatcagtgacttgaggtggcaatcaagtaattgattcacagactgagagtagttccctaacatccactgaaaatttacatgaactttagttgaaaagctgaatgatagttcaaaatgaagaacattaaagaagaaggcagacataatgacatacttcaagtaggcttgaaagccagtggtctcctttatcaactgcttcagggagcagtacattagcaatgagattacgctccaagggccctccagatccctcaagaagtcgacaaattacaatagcaagttgttcatcttgaaggttctttgcacaaacactgatggctgaggatgtatcacctccaaggagaaaaaatgctatagcaagctcccattgatgccttccattagcacatatgcatttttcagagcagcagatttgtgtttttcttcctagatagataagatttatcccaataagtatgatgtagaatatacttctcaacattatgtatctgaaattcctctcatgtttcgtgtgcattttgcttaacaaagatacagtccaagtatactgataaaactatcttgtttctagcagaatgctcatttgcaatgccaaaactagcaagtataagttagttcacatttacaatcataatgacacaaccatgtagataagaatgttaagcataagcgcatagttaaagatgtcaaactatccaattactagtctctaccacaccaagatacctggaagttcctggagagaaactcatagagacgtttatccttttcatctctgctaatcttgaataggccaactaatacttttgttctatttaatgctatatagagaagagcacagtcctttgggtccttgcttttaagatattgcagccttgccaacttctccatctacaatgtcagacatacctaatcagcacaggtgattatccagacaactgcaaatgtgaacaatattcattacaatgtccagatatagggcagagagagaacattagaagattcatttgaatttaattcctagaatctggacactggactaaaacaatgacaaatagttcagcagttgagaaaagctaagttcaatatgatggcatctcaagaataactgtaacataatacttcaatcacgtcgagggaatcattcaatgtaggataagtggtccaaacaaggatctacattaattcaaatgctatagtgctacagaccaaattgtaaatagaaatttcagtaattgagatatagcatagttcataaactttcaatgacctatgaggattttattagtcaacaagagagtcttgctctcacacatacaaacacttatcactgtttcgaccatttgcttttagcaaaacctatgagaacataaattgttgttgagacataccttggttcttaactgggacacgttggtgtaccataaccccataccaaggtttcgcatctcagaccaacttggttctgcaggaagaacagaattaagtagatcatcctgacaatcagactgtaaggcccacgcgatagaagcagaatcaacatggaagacttcggcactggatggatcttcagatctcctaagtgcatataggcgttcgaactgcacagcaacccagaaccttaagagaaacaaaattaaaaattaatgtagataccatacaaaaatgagtagcataaacttgtacaacacttacaagcccctggattctagtaaaacaaaatatatatatagcaatatgtcactgaaaaaaaaaacagttacatatgttaatctaggagttacttttaccttctccctgcttcatcaaggcttttatagggagatgcatggctctgatcagtaattttacccaaaagatcagaaagtgcaactatctgggttctctccatgtcacttattgttgatatgctaacattcgtagcaaggagcttatttatttctgaactttgagatgtgctagtggtggtgttgatatcctccatccgaggatatgaatttgatggtgatagcaaactaaaggctgtgctacgttgattgtcaccccaaagtaaccctctattagatatgtcattagatgtcatatcggtgaagctttcagataaagggcattcaggaatattatggcatgatttaccacagaaactgcactccaacaaggtgtttgatattttatttgcttgcatggattgaacaagatgctgcagaacagtgtttgcccgtttccattgacctacgcagagcaataaaaagagttaatatcattacctgatttacacaatatgctgtggattttgtcaatcatgatcttggacttgtacaggggggtcataaagataaaatccaataggttgccaggtacagattaaatcatcatggattttgtcaatttgaagaaggcatatcaaaccaaagagcaacataacattttgccaaagcgttattatattctatcctttcaacttgacccacaccgctaatataaaaggccagaattaatttcagctagaaataattagcatttataccaaagatttcagaaaatattgaaagccacaatatgtcaaaacagaaatttactcaaaagatcatattacacaaactttagtagggttgttaatggcaccattttatcatgttgcacaaaatttagtagtgttgttacagtatatttctcgatggatgaaactaaaagataactgataggaaacggcaagttccagattatttgatctaaatatttttccaataatatctccatatccaaatccctactcataccttctagttttatccctaaatccaaacaccctaatccaagtgatgcagtcgggatttgcttagtaccgcggaggcttttatatctgtagttttactttatcattcctgggcaatctatttgtgtgcaggctttatttatgagacatgacaggaatattttataataaatgataacaattatcttgacaaactagactccacatgatagaacagaacattaaatggcccatatctcaaacaatcggctatgtcagcacaaaaacaatcggctactgttagcgatgaaaggtgcacaaaaacatgtagtgttgtttcactttctcagtatcacatgtagattaaaatagaagcttataaacaaacagactagcgaggccttgcaaaacatgtagaatctagagaaaaaatattttgagaatctaaaatagtggacacctgaataaagagactgaataagtgctctcgggtgatatgatgccacaggtccactcattttggcagctatatccgacaagttccatagatcattagaacagtgagcactgtgtttctgtagtaacattgtgttgctgtaattttctgataaactgaatctaccaaagatatcttcattaaaatgcttagtacaaggcaattcatgtatgtctgcagctggacaatcacatatctgggtactagattcattggctcttcttactaaccatgaactgaagagtgcaagatgattcttatgaacaagcacaccagttgcctttggcccccaaaggaagctagcaatgtcatgtggagaatgggatagtgcaatacagctccaaagatgcttctcttttgaattcacagtgtgtaatacattcttaaaggaagggtgcttatgagaatatatgtgcaactcattgagaaggtagactgcaagtaaaaatctcccatcgcctaaagatagccaatccaaaccaacaacagaaccttgaagcgttagtgcatcctccaggagaaaactcccatctcccatgagttttactgctttccagatatgaatggaggtggtattcttctgaacatttctaccaacagtagcaattctaccacaattggacagtgaaattgcagtaattggtcctcgatcggcaccaaacgtgcctactagttgccagatgtggctctctttctcagtatgcaaagggttatctgcaaaagacatcttccacagtttcacagtgccatcagaatacccagtagcaatgtgataacatgaagcagttcctgaaccatgctgctgtagagataatacagtattgttcagtggcgttgcagaaacacatgtaggatattctccatccaggcatgtagggaagactgaagaacctttacaaataactgctgaaaacatatcagcattaaggtaagttccatgtctcccttgatctgcagtagaaagagagctagcagaaaaaccacacaaacacatcccacatttgttttgattttctagatgtaggacaactttccatgataatgcttgaaaactcgtcctccatagacatacaactacaaagctgttgttgacaaaaggaccatcacaattagaagttaaaggtatggtatgaatgctgtcaggtgggccttctgcattactaccttcaaagaaaggaattgtgaacattttctgacatgaaagaacatccccttcgttctgaatactgactacaaaacaatcggctcctttttcacttccaaggacaagaaacctattttgttgaataacagaaggagcccaacacagacatgagtattccacatctgcctgaatgtcacacagatcaaatttgcacaaaagcttccataatggataagtaggtgcatgcaaagttgatatgagagttgataaggttgaaagagaccagaaatgtagagttctgctagaatccatggaaacagctagctctatttcacagctgtatggatggacagacacctgtttgatgctaccgttatgcccatgttgattgatagtttgggatgaatagcatgacaaacttttagcagaatcactcaaagcatgccccccagaattcaatgataaattggaggataagcgagaccaaataaatgaattatcatgcagcaaatgaagcaaagaacatgttgtaggtgggccagaagatagccctcttgatataacagcctcaacaaaaaacgagtcatctatggatttttgttgtcctgaagcagactgcgtccaactctgcagtttgacttgtttccatagagtaatccgtggataccttggtggagatacatcatcgatacaatggacagcccaaaagtttacagaagccccagggccagcacttaccaaccactcgcatttgcctacctggttgtgcccagggtcacctgaaaacaatgtgaaattgtcatcttcatctctcgatacaacactgccagtttcaattgcccatttcacagttatatcaactcccagcactccattcagagtgttgctcatctcaattaccgcaatgacactgaaggacctttgcaaaacccgatgcttctttgacttggctgcctcatcctcgctccacagccggagagtcccgtccaagcagcacgtcatgagtatctctcgcctcacttcagactgatcactgacaaacaacgacctaggtctccactggatcatggatactggtttagggtgcgcaagctcgactttctccacacccaccttggcatcattcacaatcaccagaacaggaggcacgccgccctcggaagaaggagtagccgccgctgtcgcgacgggaccctggaggaagtgtgtagcggaggcaagggactgagccacctgaggcgagcacctccacgcgagcttccaggaggattctgccctagcccacatggcaacgccctcgccggccaacagaatgccgtcgccggagcccgtccaggccacggcggcgacggcgaaggtctcggtgatagcccatctcagcacccagccaaacgatcctgcaaacccaagtccaatctccagaagctaagcaatgctagcaaaaacaacgagaggacgagaatcagaggcgagctaggacgaacggacctggggaagaggacggcgccggctggaacacggacacggagctcccggcggcggcggcgagctcgcccccgccacgtcggcaccaggagacggcggacacgggggcacggaggtcgatggcctggcggaagaacgggccatcgtcgtcgccgccgccgccgccgccgctgctgctgcttccctcgcggggaggggaggggaggtgggagacaacnaggaaggaggcggcgccgtaggcgacccaggggaggccgccgaggtcggggaggaaggagagggcgcgggggtcggcggcgggcgccggcgggatgagatgcggcgggtggagggcgagcggcaacggcggcagctcgtccggctcccccatcgcggcggccggcggcggggatcagatgcggcggttggatcctcaccgcggccgatcgtttgggcagccggcgacggcaccggtaggggacgcggttgtgtgggcctaggtatgggccttttcctggcccgttcgatgctttctcttcagattggatttacttgggccgttatccttgtccccactagaaaaacaagaaagggcccgttatagttttataccctttccagcttgtttggcaacttgaggggaggggattgggagtttatacgaggtaattgatggtgagattaagatgggaatttgatttttcatctcagtctcttatttggtagaggtggtagaaattaatagggagttaagttggagattagatcattaatgaaaacggatggctaagatttgtttaggcgaagtaaaggaggaattccctccaaattaccacacccctacccaggtattgaaaaggagagatttcattcctcaattccccatccccatcccaccaaaattcacatgtcttccaaccaaacaaaacagttaatagcctcatccctctaaactcccaattccttctaaaaactccccccaaccaaacgggccctccggccttccgagcgtttgtcaatgtaaccgatataggctatcatggatgtgccccgtgataggagaaatttcgttacgtccgctcagtttgcaatactactagccgtgcccccccgcgcgatgcgcgggcatcatccaagatctttaatcataaaagaaaaaaaaaagcatgattgaaaacaacatagcttgcaacagtgctatacaacaacaactcgatcagaaaaagaatatcacgatagaatatcacgatgttctgaattttgattgatgtaatcgtaccataatttttttataatcaatgttacactaacaatgggtatctcggtgcatagtacaattacaacaacgtgagtaaaataaacaacatttgtatttcaatacctagctgtacccaggaagaccaatggggcgatgattaattagaaggatagtcaatcaaaactgtgtcagcacatcacaggtagtaattgcaacttatattgtacatattttacaatctatactaagacggccatgaaaaaaaaacaaatagaaatcaaggtttacttctccatgatccagaacctatgaatttgtagccagttctgcagatatgagagttcaatattcttgccagcttgtcaataattagcatcaatctactttagccaccaataaaagaaaaagggaagtagatccaccttttaaccttgatgaagagcatcaatatgttcttagtacatgatatataaaataatgaacaccatgcatatcccacgtaactgttaaaaatatattttcaacggaatgaaacagtttctaattttgtaaatcatgttgagtaatatgtagcatcagtatatatataatagcttgaaattacctggctggtggtcgtagaagaatcaatgaaaacgtgtatcaaaccataaatccatgatttacaaaatatggaacaaaccattaaaatgctatcacaatatttggttatcctgttagttaaggttcaatgcttgcctcttattgtgctctttgcaatcccagagaacgaaaatggctagtgagaaactgccaaatatatatatatacatagataactgaataacagtttatgcatactacttggtgcaataaaaaatagagtagggaatgatgtttaccagtacaattaaatgatgatcatgtatacggagataaagattagacaacaaataagaattcccaaggaactactaaaataactgaaataataccaggaaataacaggtagaggaacaccaaagagcaattgccatgcagctggaacctacaagccttgaacctgaagtatgaataaaaggagaagaattagcaaatgaagcctcccatgtgaagcaagagcatttttgtgagaaaaataaatgaaatgaaatatgcagtgtgttgttgtgtacgctagaaatgttgatatagcatgatgggcatatgaatctaggtatttaagaaaaaggaaaatcacactgcacatatttgctctagtaataaactgagctgctcatagaggcacggggccatatgtaccaaaacaaagttgcttatgtgaggcaaggacgtagaatatgcatgtaattaagcgtatggcaagattatatgaaaaatagtttgtaggcgatacaatacagcaggaagaaagtgaatttgacaaaccttagtggagataggactgaacatgtaaacacaaacagaatgggacctgtggaaaacatatatgaatatattgtctgcagcttatagctagcacactaacctgaagctggagagtccggcaaaggctcctttcgtttatgctgtgatgtagttgtcgatggcccagaagagcatgacatcgtgtgaaagctcaatgaagagtgacaaggccttgctgaaacaataataatccaatgcaatatagctttagtacacatatacacaggatacaatatatctaaaggaaagtatatacatatgcaatatttggctagaagcactaacagattgataaattaagcggcagtaaatatactctcatagccgacgaaatagagcataagacaataagacaatgataaaattgattgaatatttacgaataggctggccatggtagggagctattttagcagcaaaacatgaaagaagcaagtatggtgccaataccttgatgtccccccaatgtacagcagctgtaacctctgccattgctggcttttaagacctctggtctagcatgcagtaacccataatgcaaatagctgtaaagaaatgtatatataagtggtccaatggctaaaaattttaaataggtaatgtgattcattttctacagctaacaaccaaaaaaaaagtaatagagtataaactgatcgttctatgtgagattaagagtttgctgtagaacacttcatagacattcgcgtgatatagagtatgccttgggaatggagagcacaaattataggccgaccatgaacaaaggaacatgtattagatctcagatatgaactgagtgctacctgcaagcaaagctcctgaatgagactcacaaagcaacgccaggttcaagttgtttggggacacacattatgcaacattttcaataactccgggggtgaattgatgtcgcttttcgatatttctgcactgaaatcaggcaagacctgcaacaatgctttgccttcattgcttgcaaccaaagaagtggcaatagtcgaaatgatttttgaatcaagagctatattctttgttatcatttcacgaattaacttgagaacttgggtaaggggacagagaggcagatcgggatagtggtggtggcgccgtgcttcgtagcccccacagtcaccgagcttcggcagcgacgggccaaaggaatgaatccgcaaatgtcggtgccgncggcnacggtcgggcgtcgcgtaggtatacggcgtggcgacgacggccgggctccgcgtgagtaaaacggcgcggcgactacggccgggacccgcgggacgaagacggcaccgtccgggcgccacggcgccgtccgggccccgcggcgccgaccgggtgccgcgggacgaagacggcgccggccgggcgtcgcgggaggaagacggcgctgcggcgtggcggtaggaagacagctcgtcggcggcggcgagaaaaggaggatttggggatttttggcagggagccagcgaggatgtctaggcggtggctggtgtggtgattgcgtggactaaatatagcaagtacgcagggtatggagggatggagcgatgaccgtgtggacggctggatggaatcaccagctggacatctgacggcacatgcatggcgagggactgtagtactgtagcagcatttctctggcctgagatgaatcgcaacactgttggtagtgggtcacgaaaactaaagatttgatatgattagaactcagtttgcaatactattagaatttgccgtctaattcattcatcttttgatatttaccacttaaatcatactcccttcgtttcacattataatatgttttgactttaattaaagtcaaactgtttcaaatttgaccaagtttatagaaaaaaatattaatatttttgaaaaaagataaatttattataaaaatatttaattattaatttaataaaactaattggtaatgtaaatattactatatttatctataaacttagtcaaatttgaagcaagtttgactttgaccaaagtcaaaacatcttataacctgaaacggagggagtattttttttaatttgccaccgggataccaaattttatccatgccacttcgttcataacaccatcaattcggtgagagataaaccatgccaaagacaccttggatcggagcaatgcatattagcaaagacgaccattgagacaagacttcctgcagcagtaatggtgaggacctcctaagctagaggaggcacgatatcaaatgtcaataatagcgaaggactcgagctcatgcctgttttcatggtggcaaggtggtagggatatctaccaatgctagagttgctactcaaagcaactcgtctctgcaccttcattgtgaattgaccgaaagccatcccgccatctactccgtcacaacaatgctaactttaatgtagtcctttcgtcttaccaaactgcatcgagcccctttattgctgaatcgacgagagctagttcgctatttgcttcgttacgccagcattgacttaccacaattccatcgtctcagatcaagcctctcagcatcttgacgccatcatagtccctcaccttagaccgaaaccctttgcatcctagctctagtgaagatcaagccaactgcccgagcacaatgataggagcacgagtgaaggttgaatcagttacttggcgtattggtgacgaagggggtggtgcttattgccaacctactctcaccacttcgaacgaatgttgatgtcaaggttctttagtgcgtgggtacgcaatatattacatactacaataaagtactctcaattggtcctgtcattttttttatttagtcttatctaaatgtttaggttcaattgacaaccaaatcgacttttgcaatcttctgccacatgaaatgccatgccacctgataggctgccactatctatctattatattattaaaacagctttgaaaagaagcaccacgttcgctctgggggctagaaattcccacattaatcggagaaaaagaaaaaaaaagaaaaggagagtccaagtaaaaatacaatctaaaaatagctgaaatttggaattaaataagcaatattgaaagaaggttctatataagaacccaatacgagattaatcaaaatttgaaataaaaataaaataaaatccaaaattagaaaaaaaaggagaatccaagtagaaatacaatctaaaaatagctgaaatttgaaattaaaaataaaaaatattaaaaaaaggttccatataagaacccaatacgagattaattaaaattgggaataaaaataaaaataaaatctgaaattagaaaaaaataaaagagagttcaagtaggaatacaatttaaaattagctgaaattcggaattaaaaataagcaatattgaaagaagaatccatataaaaacccaatacaagattaattaaaattcagaagaaaaaaataaaataatatccaaaattagaaaaattaaaagagagttcaagtaggaatacaattttgaaacaactgaaattaaaaataaaaaaattaaaagaacacaatacgatattaattaaaatttgaaaaaaaataaattctgaaattaagaaaataaaaataagatttcaattaggaatacaatttataaatatctaaaatttgggataaaaataaagactattgaaagaaaagactatctaaaacacatgacgagataaattaagtaacatgcctataaaagagtagagtggtggcggttgatatgtcatataaaaattgttaataaaacaccaaatagatcctaatgacgattaaaaagaggagggacgactggcaggccgtgaagcaaacgagcaaggcggttgccaggatttctaaaaagtaaaaaaaacccattgattatcatattcgatttttaaaatatcaatgcctataaaaaggagaagcagcgagcggagtgtataagagtatagttgcagagccgccaacggttgaggagacttttagaaaataaaaaataaattccaacgatagttatattcgatttctagaatcacaatgacaataaagagtaggcggcggacgggccgtagaggagcatagtggcatcgttttacgggacttctaaaaattataaaaaatgaaacccaacaagacaataaactctataaactataaggtccattttttaaaggttcggaacttctaaaaagtaaaaaaaaacaatgataatcatgttcgattttaaaatctcaatgacaataaagaaggaaggcagcgggcgagccgtaaagcagtacaatgtcaaagccactgacggtttggcgggacttctaaaaagtaaaaatgaacccaaatgataattatgttcgattttttaaatgtcaatgataataaagagacagtggacaggccgtagatagtggacaggccatagaggagtataatggcaacgttttatgggacatctagaaattataaaaacgaaacccaacgtgacaataaactctacaaactataagatcaaaattttaaagattccaaggagaatgaatagaaatagtgatagatcgtgcaagcaaataaaggaggagatgacaaaaggggtagcaactggtgtgacttttagaaactatataattagaaacacggggatgataaggtttggtctttcaaaattttaagacaatgagatagctatttaataaatttaaagtaaaatcatactaaaagatatataattttgtttgggtgctagccgcgcaattgcgcgggccacccaactagttttcctaatgaaaaccaacatagcaaaagattttacagcaaatataaatgtatatctaatcatactatcatctttttataagagtgacaatttgccactgtagttattggccgatgctaaagatgtactccctctagtgataaatatttgatgcaattgattatagataagaccaatcatttttttattcaaagaaaactatgtaagtactatttatttggttgacttgtattttcctaagaatgacttatatttctatatatttatattaaatttttaaataaaaatgaatgatcaacatcacatcaagaatcagttgaatcaaaagatcggaggaagtgaaggcaagtgcacttacgatcattccatggaattttagaggtcatacagaaatgtacttgtctttgaaaattattttgaggcagaaggatatggtaagagggactggaaggatatggtcggataaataagttctacatatatggaactagtcaaaatatattgttttgatatcataagtagttttgacttttttttaagtcaaacttcttcagatttgatcaattttatagaaaaagttagtaatatataaaacaccaaatttattttattaaatacaacattgaatatattttgataatatgaatgttttgttttggaaacattgctacatttttttcataaagttaaaaaaattgagtagtaaaaaggtcaaaaccttaaatgaagcattttgtctattggcgttgtagtaaggaacgaatatgaccctaattgttcttctcgaatcgctatagtaggatggatcaaacaggtgttacccggtcgtcaaagaaaattcaagataatagaagagttcgttctaccgcataagattcttgaatccattacaaccactatcttttgtcttttttttctcttctctatcaaaaagaagattaaaacagagagagtaacattttagaaattacttttggtgcattatctgtactacatgtgcttgtatgtactacaggcagtactggtactcactactactcagcacaacaccctagcactcgcaaacagtctcacaaaacgacggagacgagtggaggaggcaagcaaagcccgagagagggtagcgactagcgactaccgagtgactagcagcacacgacagtgacgtggcgtcgtaggaggagaggctcagcctcagccctcaagctcggttcgcggcgccgctcgcctcttatccctctccgaactgaaattaaaaaagaaaaaggaaaaaaaatcaaaattcccgagaagaagaagggaaaaaaacacacacacatacagagagaaaatatcatggcgctgctgagcccgcgtgtgccgcggctgccgctcgcctccgcctccgccgctggagcggggctccggtgctgcgtcagcggcggcagggccgggtcggcggcgtggtgccacgcgtcggcggccggcagcgtggcgtcgtcgtcgtcggagctggaggccatccggtgggggaccgccaagctgcagggcgcgcgcgacgagatggaggacgaggtcgtcctccgccccggctccctcctcgacggcttctccttcgccgccgtcttcgacggccacgccggattctccgccgtcgagttcctcaggcacccccctccctgattctcctcctgctcttcgtcatggccgctttccgcgctaacctctctccttggcgctgacatgcagggacgagctgtacaaggaatgcgcggcggcgttggacggcggcgcggtgctgagcaccaagaacctcgacgccatcaccgactcgatccagcgcgccttcgccaccgtcgacgccaacctctccacctggtcaggcccagttaggattccgctgaacaattccgattgccttctgcttagattagctactaaggccctgtttagaactccggcaaaatttttcaccctgttacattgaatatttggacacatgcatggactattaaatataaacgaaaaaataactaattacatagatggcgggtaaattgtgagacgaatcttttaagtctaattgctccatgatctgacaatatggtgctacagtaaacatttgataatgacggattaattaggcttaataaatttgtctcgcagtttacatatagattatgtaatttgttttgttattagtctacatttaatacttcaaatgtatgtccatatatccgatgtgacacgtcaaaactttacaccctggatctaaacacagcctaattcctcgcatgtttaacgctgtgtgacgtgacgcctgcttcttcttcacaggctcgagcagatggacaaggaagatgagtccggcgccacggccacggccatgttcctcaggaacgatgtccttgttgtctcgcacattggcgactcctgcttggtactaacaattccctacacataataacatgcgtatatattaatcaattatcaatttatcatatatcccgttgtcattggctagtgcatcgtgattgtgatgctgaagtgaattgtgagttttattctgctgatgatgagggtgggtcttgaatgttgattagcaggtcgtatcacgcggtgggaggcctcaagctgtgaccaacttccaccgaccgtacgggaacaagaaagcgtctcttgaagaggtgaagcggatcagagcagcaggtggatgggtgtgttttctcttccagagttccactctaatcttctaaactaccgttcttctagttttgtaaagatcatgttcacataatttagtatagagcgcttacgaaaacctgtcctcagctcagcaagtccttaacacccatgagaaaataacaatatgttgcctttccccataaagattgcagttcatttttcaaatatggccatatggaacaataatcaacaggattgacccggtgaaattctagcacattgtttgctcttctagtttgtaattcacattctaagttagtggttactagtcatactactgctgtgggcctgtggttgcatattgtccatttagacccattattatggttttacagagaataaatgggtttggtgctgtatggagtaatataatatgctgatggatattttgttcactgcttgaaatgccgatctcactcatgtgactcttctttgttacgatatcgatgtactttttgtagattgttgatggacgcatatgtggagaaatttctgtgtctcgtgcttttggagacattagatttaagacacggaagaatgagttcgtcccttatactctctgttctctgttcatacattaagcataccttttgttacattatttcgaaacaataccctgctaatttttaacttctcatggttttgtacaggatgttggtaaaaggagttaaagaagggagatggactgaaaagtttatctcacggttaagctctaatgcttttgttcttatgatttttttatgacttgttgtcaagtatttgtttttcttttgtattgatatgttccgttacatctgaattcagaaacataccaatgcagctattcttaattctgatcaaacagcgaggccatttgttcagttacatcttctcttttcattctcatggtgaaaataaaacacaatagcagggctaaatatcatctgaattcttagccacaacttaccctctactagtatgtaataacctgatttctttttcttatatgttgacaattatcaattgagttccttatcaactgttgccaagataatttgagagctaattactgaccatacattctcaattatatatctgcttactctcaagaacaaacattcttcagtattccaacttttacaccttttattggcgaatgctgctgctgcatgtcatgagatgtcttaactacacaatatgtctcttcttctgtgattatgtatgtaatcaatatctttcttgcagaataaattttaaaggagatttaatagtctcttcacctgacgtatccctggtcgaacttggaccagatgtggaatttgttttgctagcaacagatggtctttgggattacattaaaaggtatgtacacaaatctttttattgtgtagttgtcctgcttatattcgttcttgtctgcctcctgaagacatcttagttggctattcaacactttgacatgtataatttggctatcttatatagctctgaagcagtagcattagttagggatcaactacggcaacatggggatgtccaggtatgaagtttatttcctctcaaatcaagaactcattatgtttctttttgcaacttatttttaatattgcttatttttcatttgtttgtgtaggttgcctgtgaggcacttggtcagatagctctggtattgactcttgccaccttttactttgccacttatctattctcttatttataaagttaattatcaaatatgatttggtggaccctgcatatcgaaaatgctttcttaaatttcttgctttatttccaattgcaggatcgtcggtcgcaagacaacattagtatagtcatagctgacttggggtaatgattcttaacctttacattggatgtttgtttagaacgaattcaagcattttgtgcatgaacgatgttgtccttgttctagagttcttcccattccgatttcaaacgcattatgagatgatgcccatttcgcacaatttgctccttttccgtcactataatcaggctatagtggatctctttggtcttggtcagcatctcttaaccacattcactgtatcttatttcttggcaggaggacaaactggaaggagctgcctgctcaaaggccaaatttattcttggagttaactcaagcagttgcaacagttggggccgtctcattagggatttatatttcatcgctccttgcgttgcagtaggcctaggtagttctttcaagtgtgtatagtacttacagttttacggtctgcaacttctagctgcaaataatgtacattcttatagggtaaatgcataggatatccgttgaatatgtacttcagctcctgctggccaagatattaatggggctcttttttttttttctggaagatcctttgattcatctcagtaactcaccacatcgaagtagtattaaagagttactccctccgtcgatttacataagtcattttttttatttcagaaaacaaactttgtatatttgatcaacacgggaaccttgcaactggggaagctggtgaagaatgtgcgggcccccaagctcagaagacattcggctagagaactcgaagggaaaacatattcgggcaaagaagaagtcgaatgaaaaattttgtggggactacttattaaccattcttgccagctaaagccaaaagactataatgactctgaaaatataccataatgctcctagggttgatgacatagcaagagcattataggaagttcactaaagcctgtgagggtagaaatgtaatatcatatgtaagactgtaggctataaaagctggtcaaattcccgtcgcaggacaagacatttttaatacaaaagtaatcctcagaagttgtgtttgctgtttgagctcatttctaaggataggcgggaaaacttctttccagcttatccccgatctggttcgtgacctaaggtcacgacagtggcgctgtctgtggggacataaagtctccgttggattgggctcaaacagtaaatgcgacgctcgcaacgacagaaaattgtgccggtacactacatgggagcttttgcaagcgcaacagccccacttgagagagagtgggaaaaaatagtggaggaaagtgatttggtaaaagcaacggaagcacttgacaagcggtgggcagaaatggccaaaacatccacaccagcgaaaggtaatggaacaagtcaagaagaaagaattgctagcacagtggtggaagaaacagggaaaacacccctaaatgaagtagaactcgctgaattggtccaagcacaaaggggccgtcatgatgagtaaaggacaatatgaggagttgcaaaaattgcaagctctacacagctaggcagtaggagcaggaggatcaagtgatcaaggtgcaacaccaagggttggtgagaagcaatcagatcagacaaaggaagatgctcagaagggaaacaaagaaggagaaagtatcaaagccacctaggctcaagacccaccgtggactcaagcctccagtcaaattcaaaacccaccttaaatccaaattcccattcttactcaaaatccaactcaaatcccaactcctagtcaaaaccaaaatacaactcaaactcaaaatcctaacccaacacataattagattcaagctcaatttctagctcaagtccaaactcctgtccaaaatcaaattcctactcaaacacaattttctcttcaaaaccaacttcccattcaaacacacattcccattcagccacatatcccagttcaaacccaaatccctacccacatacaatatcctcaaacacaattccatgaaattcgtattcctccaaaccaaacctatcaaatcctttccaatccagatcccccaacctcatgtacagaa

SEQ ID NO: 10471 - DNA, 10531 bp, Oryza sativa
gaaatgatgctcgaacaagggtacatcccacaaatggccaacatatacaatatgcaggtcaaataccaaaccaaaccttccaattctagcccacactaccttactttcaaccaaccagagccatagatacaaaaaaaaccctttaagccaaaacctacaaatggcaccttgcccaacaaacttcaagttatcaaacatcacaaaatatagaggagatatagaccccaatgagtatttaagggtgtatgaaacaatagttgaagaaacaggaggagatgatacagtaaaagctaaaatacttccgaccatgttggaaggagttgcattgtcatggtatacaaccattcctcctatgacaatctactcatgggaacacatgatggacacttttcgagcagggtttgttggagcttatgaagaaccaaaagagacagatgatttatatgcaatgaagcaacttccaggcgagactttgaggagtttcattgtaaagttttccagagttaggtgtcaaattagacaagtggatgacgaaatgctcatagcagctgcaaaaagagctttgttgcctggtccacttcgttttgaccttgcaaggaacataccaaagacagcgaaagacctgtttgagagaatggaaagttttacaaaaggtgaagaagacaaattgagagtgcaagaagaagaagtagctttgttaggtaaaaaaacagtcaaagaacaagcaagtttcccaaggggaagaacaaaaagtggaaaacacaaacaaaccatgaaaaaagttcaaacatgattacaagcaagaacagaagaagcaaattaactatattggtgatggatcaaacaatggtgaaggattctttcggcaagatggaaaaggtaaaaaccagtggaataacccaaaaggaggaaaaagctattgggggcaatctggtagaggtcgaggccaatggtggaattctagccgtggaagaggaagatggtggaataattgaagaggtagaggacaagaaagtcaaaaagatcaaagcaaattctttcaaacatatggcccaagtggtcattccacggaggaatgttatagcaaattttgtcaaattcatggaccaggaggtcattcaatagaagaatgctggcacatggcccatttggtggaaaaacacatcaatcaatatgagaacaagtataaaggggctcgagagcaacgagcgcaaaatgctatagaagcaccgcaagttttaaagatagaagcaattgatgaggtaccgaaaagggtaatcaatgccataacagaaggatcttcattgggtattgagtcaaagagacaaagaaaggcatatgtcagacagataaaccatgtaggaacaagtaaccagtcaaacccaccaacttactcaaagacagtaatttcctttggtccagaagatgctgagggaatcttgtttccccatcaagatcctttggtagtttcggtagaaatcacccaatgtgaagtacaaagggtgttgattgatgggggaagctcggcggatgtgcttttttttacagtaaatctaattggagaggcctctccaattagtcttaaccagagacacccatgtgctagtactttaggagttttggttgctattaatccattgagcaagtaggggaaatattcctatcatctatgcttcaaataaaattttctcttaaattactcatccgatttacaatccgattacaccgttgtgttcgtaataattaaatctttacaacaagatctcacatgattatattttgatgaaaaatcataaattacttttatgatatgtctaaattacttttagatttcattaagttacttcttagacatataaaagtaaattcaataaagcctaaaagtaatttacatatattatagaagtaacttgtaacaaaaagaaagtaactttaattaatgccttttttcattgaacaaattatcatattatcactaagtaaatttgtttggtgctccatggtgcccgggctccatgatcatccaccgtctagctgctttaggattcgtgcaaaccaaaaaatgggtattaatcaaattagcgggtttaacccgttaagaaatattagcatctgaaccattccatatttcatttgcttgcatgcgttttctaaacgtagtattgaacgtgattataattacgttgagaagactaggaatatgcccgtgctaaacgctacggtgcaattcaatttgtcacacaaggcacacgttgaccgcagcccattgagaacatagcataagggcgtgaatataaatccaaataacagtttgatatgatataaatatcaaagtaatagtttcatgatgtatataacaattgttggtcatcgcgttaacgtcttcttcaatatctacatggagcgactactaaaatttaccaatggcaaagtacatatttagacacaagtgttaacatatagtatgaaacagagcagaccatgagattgatgtggcagaactatatgctcaagtggaacttaagtgtgcatgttgtgctgctgaatataaatttgtcgagagcctagtgaaaaaaaaaatcatagtatttatgtaagatgacaatgttatccatgcccattaagacatcaacaagcaacatatatttttacagagcactaaataattttatttacacactgtcaatcatgccatgtaaaagccaacaagatggtaagatcacccaaatccacatcacatacttcctaacatcaaacacacatcgcatacaattttttccatgatgtttatgtagtcatcaggaatgaggccaatccaatttggagaaagttctgtgcgactgatctagttgcagtacctatatcaattttgttcaccaatgtaactggaaagaaattggtacagctagtgatccctcaaatagcttcacttgtgtctgatatgagccgacagtacgagtaaggatataaaacagttattagtaaaacgtgatggctgaatataaaaacaaggcaatataaataataaatttcagtatacgctccagggcatataaataataaacttaagtttgcactccacgcatataaatgactcaaagtttaacagtatactgaaagttatatcagatttgagtaagagctgctagcacggttgctatcctagctaaatgtacaaagaacaatactccatgcatgtgtttagcttactatcgcatagctgttttgagaaagtcagcaatttgcctcaacattgaaactgtcacagttaatagttaatagttcacatgggaaataaatctattttcacattaaataaattaaaaacctctcacattcggtgattaaggggaatcactaagtgcatttatcaggaacatccattgaaaaggactatttgcaggaagctgtaacctactaatttatgacatgtacaagacacaatgcagattggaccccttaagttgtacaccttgcaataataacccaatatagtaaaggaatcaaagtgggaaggggcattattttcagcataggttgcaacaacacattgaccataagagattaatgtgaagcatgtaaattcagccggcattaaaatattttgcttctccatgttaagtatggtggtttggtgagaattgcagttgataattttctgagcgagtaacccagtcattcatcttggaacaacccaggttccaccatatggatacaaacttcattcaattggttatgtaacataaaatttactgaagcaatcgatctgataatacattctgaattcagtcagaagatacgaacaggagtacatgagtaggtaataataggaatagagacattacctgatttgagtaattccttctgcatgaagggtgccatgaagaaattaaacacctaatctgcagctctgaacagaaaagatttttaattaaattaaacgtggggttctgcaatttcttaccggtggtggagaccagacgacgggggaggtggcggtgcagaggttgctcgccggggttgccggcgcagagtggagcccaattttctaataagattcaagacagacaatcaaatcactcaagtacttgaattgagttctatgctggcatttaagtgctcagagcaccaatgctatggagctcctaaataaaaaacacaacagtttttcatgtgaaaaggcatataaatatgctagaacagtattaccatttatactaattatgctagtccaaaacaaatcagtacagggtcattatatgcaaagatcaaagcacccgtccagtcagtagagggttagtatatatatgtaaagtctacatagaagaatagaaaagtattaataaggattcagtggctgcaaatattttgaattcttgaatcatatagacaaatatgggtaacgagacactcttacttgagtctaataattgtgcctaatattttctcagatgattatcagtttgcagatccaacttgttgaaaaggcttagcagctttgacaaaggttcatgtagaccagttactgggaaagggtcttcagtcttatgcacaattaccgagtaaatcgacaaagttatgagaaacgtgaaaaaaataaacttcatatgagctgtattttatagctcaacagtattactagtacttctgtgcaatattgactggataatggctgcaatttaaggtcaaattttacatcaattaagcatttcacccagatcaagaccagtcctataaatctcaaataacaacaagaaacaaccaaatgctggaaaaaatggaaaaatatttgacccataaatctgaaacaatgttggccaagttttagatggctatcggtatttcgaatacaaagtccagctatgttggctttacagggaacaagtccgaacgtaaattatacagttaacccacaataataaacatacaagtgtattactatggtttccccaaaaagtgccctgtaaaatgccatggaacatatagtattcattatttgggaaagcgaaaataaacagatagttgatatgtataactgatagcatatgttcatataagcaccgatagcaccttgtacatattaaaatagcagaaacaataggtcaaactgtctttaccttcaccgcatgggaccaacgaaaatggatttccagattgaaactacaaagcggtctttttgtttgaagctatgggaccaaaagcccagtatcctcgatgcaactgtctgatgaactgacaataatcagataatgcagttacatatgaaactacaaattaagagctcacctcgtcgatcggcactgtctatcagtctatgacacaagtactgctccagttatctccttcctagctatcctgcacctcggtagcgaactgcaggcctatctgcatgatcatgaccgttgaaatgcagtgatgctattagtataacttgatactcatgaccgttgaaatgcagtgatgctattagtataacttgatactcatgaccgttgaaatgcagtgatgctattagtataacttgatactgagattttggagtcctttcatcaaccgattaacaattgcaatatgcaagtagaaaatcatgcttatttacctttagaacaacggtcatgagccactgaattaaattttctgaatctctcttccaatcttccaaatttttttctattttgtcttctctctgtttttaactttttatttctcttttcatccctcaattttttttatgctccttcccctcccttaaggctggagcttgtgactcccatcctctcgcacacgctgcgtcgtcgtcttccagccacaccatacaagctgccgcatcagagctctagctagccacaaacacatcgtcgagacgttagctagctagctaggtggtcggcaggagcaacttgctgaggagtctatcgtcgtcgccgtggcggcgcggcgaggagcagctcggtgcggaaggcgtcgacagcgacctggcagcagggatcggtggcggcgaggagcaactcggcgtggaatgcatcggcggagacctggcgacagaagggctttcggcggggggtcggtggagggcgagccggcagcggggatcggtggcggtgaggaacagatcggcgcggagggcaccggcggcgacgtgattcctgcccgaggaccgattccatgacgacggagtgggcggcgatgtaaactgcggggagccggcacctgcggggcagatcggcgaggctgccgtgatgggagcgctgatggcggagcagatttcggcgtcagcgcgtgcgggagcgggattggggatgcggcgcaggtgcgagtgggagagcgagagagtgcgggcaatgggatgtgggatcgatctcagccgtccggatttcacgagttaatctggaccgttctacgaggaatgaaagaaagagtgacgagcgaaaccatttgttgagctataggtagaatcaaggccattaattacgttgaattgatttctttgcatgtatatgaatttagacgtttcattttttctgtgtatatatatagatatactccgtatatatcccgttggattccaaattttagaatttattaaattatatgccggtataacgtcctgccgttgctccgcgctgctgcaagcttcgtcacaatgtcatttcgccgcctgtcatccgtgaggttaattagtcactgccgcattgttgccagtcatactctgcgaggttcttcgccgtcggcagtcatcggcaagctttgacgccacgacgtcgtcatcgatcgcccatgagatacgttgttgtctctgtcggtcatccacgaggttcgtcgttgccatagccggtcgctggcatggttcgtgggtaatttgtttcaatctttttatatcctgacatgtatcagttctcccttttttttcaggtttagtgtaaacaatttcccttggtaatcaagacctcaagatgggagcggatcctcctaataagttgctcgttcatcctcctagcgatcaaattcaagatcacacaatcacggcaaaattgctcatccaaatgctgagagcatgtctactgcacatatcaaccaaatgaagggtatatgccagaaatgaagtcatatcggagaactaagcatcacttgtggagtttgatatttacaagttacaaaatacagtgtaaaaattagtggcatctatcttgaaacaatgtttactgtactttagttaccacccctttctgtatttccgtatccaatccaaaaaatatatatgcacggctgcattaccgacaggatagctagaaattagttagaaatataagggcatgtataatggttgttaatagtggtcttttagcattgctaattaggaatatttgttgacatggaggaaagagaaagaggagagacaaaacatcgttgttatgcatgacaacggcttaacaacgactcttagtcactataatatgaaaatatggttgcatgaggatataaatatggaaagaatattaacaaaaggaatattttttgagttaatgattagagcatttgtcgtcttaactattgtaaagatatggtttctaaataatcttgtattgtttaagagaccatacccgtctctaccattgaacatgccctaatgttgattattcaatgtgtcattcgatcgttttctctaaatctctaccataattattgattaagtcaaaagggaaaagcatatacccaaccacacataggatgtacataacccggatcgaactcttatctaattggttttgctaatatgcacttgtatcgggattcgaaattagggtgccaatcacttagaaatatttagaaaaattcaaccaaaattagaaactctcatctcaaattttaaaacatttaactcacattttgaaaacaactaaacaattcatctaataatttgtagaaaactgttgagtaaactcggaaagaaaggctaagtggccccaagtgtgtgtcgtgggcccttttccaaaaacaatttccatgcatgggtacatatacgcaatacttttttttaaaaatgggtatataccaaatatacatgttttttttcagggaaaaataaatatacatgtttaaatgggtacatactacattccatgcatagctattacattccattattaagtataaacattttttgtatttggaaagtcctacggactaatttagttacgtgtacatagtcataccatatacttagattccatatacatcgatcgatttccttatacttagattccatatatatcgatttccttatacttagatttcgtatacttagattccttatacttagatttccatatactttgatttccgtatacttagatttccatatatatacttcgatttccatatacttagatttccatatacttcgatttccgtatacttagattacaactgcaccgtatacgtatacttggatttccatatacttttgtcccaaaatttcggagtatattaccatatacacgattgtatcattaccaaataaaccgcaactccatgatttccgttgacaaatatatggaaaccaattgccaaccgaacaacattcatgccaacttattaaatatgcagaattgatgtttccaaatgtgtgcatgcatgcaggtgttttcactttccaaaccgtatgtacttagcgggtgcaccatatagaaaaactattttacaccctgggtatagaatagctattatacaccctcctccctccaacccacctcatctacttctaagggcccaaaacccacctcccacctcagtcaaaggctagttaaaggtccccacgtcggtcaaatctcggtcaaacccgccaatgacttcccccaccaccccctctcttcttagctctcgtatcggaatgacgtagtaacgtcttgttcattgtgcagtaacaccgtgttttacttgcagtaacaaaattaaaattcagtcataatatagtcatgatggatctacttttgataagcactttttttcgaacatcatggtacaaacagtttttaaaagtagtacatgatatgagagatattacccttcaaagatttgttcttaaaaatttaactctccacaagcagtaatagtatatcaaaaggtgttactagtgcatgttttgcgttactgcaatcacatcatgtcgttactacaagatgtgtaatgattataagtttcatattaacatagtgtgttactgcaattacttggtaacattactacaagaatatggggaattggctcggtttactcgtttgttttaacccatatatttttttattcctggtttactacaatttcatcacgatgttactgccaaattaagatgcagtaacgctctatatgtactacagtaataaagttttttttactacagttcttggatagtgttactgcataaacatacggtaatgtgtaactatcaggtagtaacgtgtatctgccgtgcagtaacacttttacttttgtgcagtaacaagtatatggttagcatctaagactttgaacccatatatttttgttccaattccaggtttactacaattcaccacaatattactgtcaaaagtgcagtaacatcatatacatgcacgcagtaacactatattggagggagagaccagttttcttgagaagagggaggaagaacgatttcttgaggaggggagtatgtagatgcattttgaagtttaaccctccacatgcagttgcactatagcattatgatggaaacggttttaaaaaataatgcatatcttgtgagatattgcttttcaaatattggcattttgaactttaaccctccacatgcagtaacagaatgtgtaatatgcattaacaggggcatatacatgcagtaacatggtttgaccaaatgtataaaattgttcaaaacactcctacatcaatcagacctcgctcaaagccaactacagactttacctatggcccacctattcaatcttcatcttgtaaaaatgacatagtaaaactacaattatcatgcagtaacatagctacttggaagtggtaacatgcacctattatgcagtaacacttctacttttgtgcagtaacaagtatatggttagcatgtgaggctttaacccatatatttttgtttcgattcctggtctactacaattttaccacgacgttattgcagtaacgtcctatgtgttctacagtaacgtgttaatgtacttttatgataattttactattggagcatagtaacatgttatgagtttcgtagtaacatatctttattttttgttttacggtggtagtgaaagatattagaattgataatcatattactttctcacaaaattcttgaaacaaataatatcattaggtgaattggttagaagaatgtgctttgaactatgaggttatgggttcaagttttgaatttggcaaatttattttttattttcctagaaaagagaaaaaaatgttttgggaagaaaaaaccagaaaaaaaagggaatcgggaggagggggg

SEQ ID NO: 10472 - DNA, 26944 bp, Oryza sativa
gggggacgggatgggcggtacagatgagaaaggggagggggtatagtatagaataactattctataccccgtgtgtagaatagtctcaccctatatatatatatatattgtgctggttaatttaatttctagatagagtcatgtttttatctctacaacagatttacttcaaatgacacgctaaagttaccttcgttttgttctaagttacttctataatatatgtaaattacttttaggttttactgaatttacttttatatatctaagaagtaacttagtgaaatctaaaagtaatttagatatatcataaaagtaatttgtgacttttcatcaaaatataatcatgtgagatcttgttgtaaagattttaattgttacgaacacaacggtgtaatcagaccatagatcggatgagtagtttaagagaaaattgtatttgaagtataggtggatggtgcctcttatagatggagtagtagctggttttgacaaaccaactaccactagctatatagttacgtccctttttttatgatgatttcaagaaaatgcaaataccggaagacaggttgactagtgcaggaatacctttacaaggttttggtggacaacaagtacatgcacttggcaagatagctttgcaagttgtttttggcaagggtgacaccgtaagaaaggaggaaatagtgtttgatgtggttgacatgctgtatcgatataatgcaattcttgggagatcagcgatgaacatatttgaagcaatcatccaccataattacatacgcatgaaacttccgggaccaaggggagtgataactatccgaggtgctcagctagcggcaagaaagtttgaacttcaaggaacaacaagcgtgaaaggggtacatgtagttgatcaaaaacatagtgaatacttgaaaatgcaaaagccagtcccagaagggaaaactaagaaagtactattggatgaaaacgacctgggaaaatatatcttgcttggagaaaacttggagagacaacatggatgtatttgcttggtcaccagatgatttgtgtcagggttatggataccacatacctaatagtagctgactaaatctcggcaagacccaccacataccatgtcctatacggaaacaaccttcggatatattaggagttccggataaggaaagacaaccagagttctacgtggaaacgacaaggactactcggattgtatccatattggtttccctagttctacttggacaaggggacacctatgggtataaatacaagcccccctaggaggacatggggacacccaccatggaggatcaacacccaacacaatcaacatagaagccacagcataaaagcctacatacgccaagacacgccgccggatatcgacttcagggataagcacggctagtcccctacggtgtctccggatactgtcaggagagacgaaagcgctatctctgatctcgcagggcacggatttgaggaggaaggctaccctgttgtcgactacgagtcagatcgtcagaccgccatgtcgacaacagttagataggctaccccaaatattgacctggtgtgattatcatgaataaaagcaataccggctttggccaacaggatgtagggttattacctgacatttcaggggcccgaacctgtataaaaatccctgtctccatctcttttacctcagtctcgcgtataccctagcaccgacgatccccatactgtccaaataccgtagtctagacatcaaacgtcgacagtggcgcgccaggtagggggattttggtgcttcaggatttcgacaagatgggtttaagagatggactctccgacaacgagctactcgacgaattcggctgtggggagatccaacatgtccaagtacatcttccgacgagatcggaaccatcgtcatcaataattcgttctctcgagatcgaccaaactttgaagacgtcaccgacgcggagaacggcgttttgatgttatccatcatgaagcctcggccagatctactacctcgagtggatattcaccgacgacggcatcgaatccaatatcagggtctttgttgactcgtgtcagactcggttatcctgggtagaagcagcaaatcgcaaccgaccaggacaacagacgagataacaggaagctatggccaaatttcctgcccactcgtgcgttgccacgtcgccaaccggccgacgtcctgacgtcaggaggtgtatcagatgtccctgtacagagcccaacacctatgcatacagtgcacatacatgtctacccggacatgcatgtacgtgtgtgcatatatattggtacgtacagtgctgttgcatatgctttgacacacgaggtcgtcacaacattaacacaggtaattagtggattgattttttaaattgatctactaattccgtagatatatccggcatatatctacacaggtatgcaataatttatatgcaatttaccgtacctatttttccagtctatacaatattgtcaaatctataatttattacgtttacctagagcatgttttttatacaatatctgttgcgcgagtgtccccgatgttaaatcgactacggtttaatgctgggggctcgctctattttcttctgtataaatcatgcttgcttacggtttacataatccctgacatttacatatgctcattatatcctgatgatactagaagatccatgcagttttgagtacatactcgatatcccctgctatatatcttctcttctagaaaatatttttcaggaataattgagcactcgagtaggttgtggtcgaatacaccgcattatcgagaacgatctcgacaaacacagagtcgtcgcacccaacctaccaacgaagaccgacgacctatctcatagcgccggccatcgctggactactcgagaaaaggttgttaacggataattcctcgcgaacgtcgtcggcttgatcacccgacatgattgtgaacggacatccggatatgctacaagttgggtgcgtgagtcatgctggccacataagatacacatgtaataaaccaactttagcgcccctataggtgattaagagactcctactcctggttctcgaaccagtaagacgcactgatctctctcgcctcactttaagtggtcgagttacgactactgcctggtcctcgaccagcaatgtagcgtttctcccagtactttcactttaagtggccgagttacgactactgcctggtcctcgaccagcgatgtagcgtttctcccactacttccactttaagtggtcgagttacgaccactacttccactttaagtggtcgggttacgactaccacctggtcctcgactagaggtgtagcgattctcccattacccctgcttcaacaaagttgatgtcaggtacacaagatcgccaagtgttttacccagagatcccttaccacaatgacacctagcgttgaaacctatcctactgtccctttacgccgtcttgacaaggcctccgaggaacctaagggaacttcggctggggacgcccagagccgataaggccttgtcggatccttcaaagacgaaagaatcatgtaagatctggtcgtgtaagagttctcgccgtgtgtattaaccaagccgtgtaatcggaaattgagttttccaacctcatggctgggggctaggatcagtgcttgttcaaccgaggcaggtcaaaggtccaagagccttatcatccaagaacgattctccgacgacaaggctgggggctagggagagtgtataactcaacaaactgactgatcgaagtcggtaaaagagtagacgctcgtatacaaaatattggtctgtaaatttaattcattttcagttttccatacatattataacatgtcaccctttgagcgttcgcttggggggctatttctatctaatattcttttctgagtattgatttcaggaaaattctattcgacattgttgaagacctcacgtctctatggttttacaccaagatcgactaaggagagtatgacaaatgttgacaaggctccgtcacagactctacgccttctcgattgctcgagaacggttgctggatctcgacaaggaatacgaactgaagagatgtgtacccaccgagataaaatttcttgacttgaatccaaattctcgattacagcaagacgggagacttagtcgcatgttctgtactttcttggttggcatcggagattgactcagacaaaccctttaggtgcccacacgaggctgacaaaggaagtctaacgttatctctgaactcaccgagaacggtcacttgagctcgataacagttactccatagtcagcggtcgagaatatgaattcgttcatttgcattgaagtcgggggctactgtcagggttatggataccacatacctaatagtagttgactaaatctcggcaggacccaccacataccatgtcctatacggaaacaaccttcggatatatgaggagtttcggataaggaaagacaaccagagttctacatggaaacgacaaggactactcgtattgtatccatattggtttccctagttctacttggacaaggggacacctatgggtataaatacaagcccccctaggaggacagggggacacccaccatggaggatcaacacccaacacaatcaacatagaagccacaacatagaagcctatatacgccaagacacgccgccggatatcgacttcagggataagcacggctagtcccctacagtgtctcctgatactgtcaggagagacgaaagcgctatctctgatctcgtcgggcacggattcgaggaggaaggctaccctgttgtcgactacgagtcagatcgtcagaccgccatgtcgacaacagttagataagctactcaccatccaaatattgtactggtgtgattatcatgaataagagcaataccggcttcggccaacaggatgtagggttattacctgacaattcaggggcccgaacctgtataaaaatccctgtctccatctcttttacctcagtctcgcgtatatcctagcaccgacgatccccatactgtccaaatactgtagttgagacatcaaacgtcgacaatttgcaaggagtggacagaagtctaattgagcataatttggcagttaaaccagatcaaaattcgaagaaacagaaattaaggagaatgtcgacagacaggcagcaagccacaaagattgaacttgtgaaattgctcaataccaaggtgatcagagaagtaatccatcctgaatggcctgcgaacccggtgttggtgaaaaaggtaaataggaaagcggcgaatgtgcattgattttacggatcttaataaggcatgcccgaaagacgattttcctttaccacgaatagatcaattagtagatgccacaacttgatgtgagctaatgagttttctagactcatattccggttatcatcaagttttcatggtgaaagaagatgaggaaaaaacatcattcataacactatttggaacatatttttttattagaatgccattcggtttgaagaatgcaggaacgacatttgcaagattaatagggaaagttttggccagacaattgggcagaaatgttgaagcatatgtagatgacatagtagtaaaaagcaaacaagcatttacacatggcaaagatttacaagaaacatttgagaacttgaggaagtattcagttaagctcaatccggaaaagtgtgttttcggtattagagcaggaaagttgcttggttttttggtgtccaaaaggggaatagaagcaaatcctgacaagattgcagccattcatcaaatggaaccacgaaagaatataagggaaatgcaaaggctaacaggccgaatggcatctttgagtagatttctttctaaatctgcggaaaagggtttacccttcttcaagacattaagaggggcaaatacatttgagtggacgaatgaatgtcaacaaacttttgatgagttgaaaaagtacttgcaagatatgccaacgttagcaagcccgcaaaaaggacaacctttattgatgtatgtggcagcaactccggtgacagtaaatgcagttttggtactagaagaggaaaatagacaagtgccagtttattttgttttagaggcattacagggacccaaaacaagatactcagaggtagaaaagatgatttatgcaattgtgatggcttgaagaaagctaagatattactttttagcacatgatatagcagtgccgtcagcatatcctttaggagaagtgcccatgtacaaagaaggaccaggaaggatagcgaaatgggctatggagcttttaccttttgatttgatgtatacctcaagaacagctataaagtcacaagtgcttgctgattttgtagcagctagggtagaacaaaaagaggaaaatgaaacaccatggatagcatttcctgatggagcatgcaatgctacgggtgcaggagtgtcgtatcccaaaactaatgattcggaaaccgacatgtttagactgtatcaagccctaaatcagtagattgatacaagttcaataatctggatcgtctttgcatacgtttagacatagctttgaaggagatattattacataaagtaatagggtatttacaagattgtggctaactattacagcagaagctttagaatggcctaattctgctgttttgctatagacttaaaccatctatctaatctagacttgagaattaggttgaaatgaaactaacttatatgattgaactcccggcttcgataagaactccaaattgactctgaaaaagggggttgaagcaagggtgagtacaacgtactcagcaagctattatattattcaacaatgaatgcatgagaggtaatatctgagtggagctagctttacttgtagaaagcagagaatgtaaaagtaagataaccagcaatgttttgtaatgcaacaatatttaataaagtttggaattaagtttctaaccaagatgccactgtgagtcccaatgcccgataaccgcgagcacggctattcgaatagttttaagaatattcatactgcagtagatgtacgctttacccgtaattcatgacgtgccaaacacattagccttgtcatggcaaagcttttcggtcactaacatcagtggtacctattccctgaactctagtccccatacgctctgaacgtaacgttatcagcagcgagaggagttctggcgttcccgaggtctttagagagaactgattgtatgacaccatgtcatcgcaatcagggttcacaaacaatttgtgcacaagtcatctcatatatttacctgcgcctcggtaaatatcacaattgcccttcgcggcataaatttgcctcctgcgcgaggacttaagaagaaccactatacagaggtaccacctttgctagataacttaattagctaggtctatgcccatacgagaattgcggtcgtactcgtatgttcttcacatgtacttgcagtcttatgtcggttggaacaatactagccacccggaaatcaaccatttctaccgtactgttccaatctaagttcattatattttatgcaatctaactaggcatggctaagcaaaatctagcatatatctggtttgctatatgttcaagttatgcatttgaaatcatgtatgactaatgcatagaatagagatataagaatataggatcgttatgctcaaaggggaggaataataacttgccttgctccaacgcaaacaaatccgagattggcaacctaattatccgatcctcgaaataccacaggttgccatccaaaagataatagactctgctaagaaagacgaggaaccagattcaataaaaatcatgaaatagcaagaaagtggtaaagagcaagaagggctaggcttggggtataaatatatcctttaaagtggtatagggttctaggtagttggagagtaaatggctggtatggagtttggatagcaggttggctggggtttcatttgattaagccgatatcgaggtaggatgaatgtcggctgggatttgggtgtttgctagtcgtcattagaattggatagtatgacaactaggttaggtgtctagccgatgtcaacggatgtaacatactgaaaatttgctattttctaaatatgcatcatgcgaattcttatgtttttaataacttcctaaacctaagaaattataattagagggacctcctaaaactaacatgcataaaatccctatctagtatttaaaatctttcgtggttttattctaaaaattgatcttgttaaatcgaggtattctctttgatttgattttgcatcttaaaccttctttcgaccaaaatttcttttatttaaatttagtttaaaaatcctttttacttttatgaatcatggtccaagaaatcctccaacaatacctttgaacctaaacccaagttccccattagcctcaaatacttctccaaattcttgccaaataatttgaggctaacatcctatttatttcccttccctctcaatcgagtgcatcaaataaattccgttatattctatctctcaaaagattgcactcaaataaattccgttatattctatctctcaaaagattgcacttaaataaattagaacatccttgttttaaaacccctctgcatgtatcaatatctccgaattcaaatcctttttaaaatctagccatccaaattcctctaaatcaattatttgaatctctaggaaaattagactttctttctttctagactgggccgaaaccctttccctcctccagcccaagccggcccagccaccacagccgagccgcccttcctccttctgcagacgcgcacacgcacacgccgccgccacccacagttttgtgtgccgtcgccgcttccttgccgccgccgtcaagtcgcgccgccaccgtcgctgtgccgtgttcgtcaacagccgccgcccaaccatatagcagccgccacgtgtgagcgccgccgtcgccgaccaatcacgagcggaagccggcgccgtccctgtaacatactgaaaattagctattttctaattttgcatcatgccgggtcttatgttcttaataacctctttaaactaggaaaatataattagcgagacctcctaaaactaacttctataaaacctctctttttacttaatttcttttgaagtattccttgatttggttttaatctaaaaccttctttcgcctaaaacttcgtttatttaaatttagtttgaaaaaccctttttactattatgaattaaggtccaagaaatcttcccatattgtcctagaacctaaaccaaagcaattccaattttattggaattaattgttaactcatcctttgatattaaacctatcctttgatcttaaacctatcatttgatcctcgatccaaatattcaagttcctccttttgatctagccaccaatttaatccctatggcttgattccctcttcgggacaagaaatattattattacaaatattgtgagtaattgctcttgtgctaagagaatagactttatccttccgccccaaattcaaaacctcatttagcccatatctaattctctaaatttcataccacatattttgggctagaattctatttactctattccctccatattccctccacatactcaaaaatattcaaatctagagccatattatttatggtgttgaatattttgaagttctattttgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctccttccttgcccttccaccttttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccactccgcccacgatgtcacccacgtcgccggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgctctcgccatctccgcgcagcgccgtcgccactatcggcatcgccgtcccacgcttcaccccggcatccgtttcccttccctcctccaccccggaaccacttcttcaccgtgcacccgaggccgccgacccattcgtcgcctccagccgcacctcgtcgctgctagcgccaccgccgcgccgcgcaacccatgccgtcggcatcaccactccacgccgcacgtcgtccaccgctacactcccccaatccaccaccgggctgccacctccactgccaacccgagccgccattgcctttgtgagcgccggctgccgcctcccgtcgctagaaccgccgcagcactgctccgtcgccaccgccggcttcgttgccacaagcccaagctcggccaccgtttttctctccctcgccaccaccgaaaccaccttcccaccacacacccgagccaccacatccattcaccgtttccggccggcaatcatcaccgccatagccgcggtcgccgcttgccgtcacctttgtcggcttcgtcgtcgtgtgttgcacctagtctgcctcctagccctcgccatacaccgccgtgcgtccctccgcgtcgtcgacccaaggagcgccgccgcctccctccgcggccgctccctccgtcgccgcgcctctcggtgagccgcctccctcctccttttcctctttgccggccgcctcccgtgccagcgccgcgttgcgccgccgccgccgccggttgtccggccgtctgcgcgccgccgccctctgtggtcggtcgggccagccctggctgcgcccgtgcccggccaccgccctcctcagccgcccgatcggctttgggccgatccgggccgtcggttcccgtggaccgacggtggaccgcctcggtggtctcggtccacggtggaccggcgcccttgagccgctgccggtggggcccgcctgccagccgccccctctccctttcttagtgccactgacgtgtggggcccgcgtgtcggcgccggctgccccttgctgacgtcagcgaggtccatttcctttgagaaaatatttaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccaacgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatcagggtttacctatctgctcgcttgtgccatgtttacttgatatctgtcctttgtcaaccttgggtgataaatcgactagcttgtgttacttaggtgacctagctagaactatatgcttagccatgcttaattaccactagctcagtcgatgggataattgcagtattagactttctagtatcttgttgagctgcgtgctcgagacatctggccatgttttatggtcgtaattatccaactaaaatgcgactgaatggtgggctgtgggtgcatggttttgcgagtcgcacccatagcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagttcaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtgtattacttgtcgttttgtgtaccctggctggtcctggacagggatttaatgcacaaaatagtctggaaatttgggctaaatttctgggcgtgacatatttgagtgcaataaataaactccctctccaaaatattgcactcaaaccaactagagaaatatttcttttggaaattatattcaaatataatttccttctaaactctctcagtcaattttccttcaaattcaaattattcaaatcctttttcaaaatctacccatccaaatcaattattcaaattaaacttcttcctttttgtcattgggccgaaactcctttccttcttcatttttggcccaatccttttaccttctatttcctcctccctctcgggctgccggcccagctaagccgagccggcccaaaccggcccatagctgagccggcccctcctcctcccgcaagcgcacgtgcagtgcacgtacacgccgccgccaactccttttcgtcgccgctaagcaagcaaaagtcggcgccgtcgtcttcttctccacgccgccaccaccacggacaagttccccttctcctctccaaaccgacctccacgatctataaattaacgatgaggtcgcccctctccctggagataaccgagttccctcacttccctctctcctctcatacccggctgccgccgccgtcgaccgatctcctccaccgtagctccacaacccaaaccctcgcgccattggctttgcctcggcgaggtgaatccgtttttcccctttcccccttttctttcatcccgtatcaagccccaccggaggtttctctttcctagccggacgaggctttgtcctcgccgttccggcctcttccctaactccctctgccggccaccaccctccttggatgcgtgttgctcggtaacaagcgtggccgccgacgtcgccgccctccagccaccggagcgccgccgccccgctcgccttctcctttctcttctctcggctctctctggaagagaagaaagaagagacgggaggaagaagaaggagaaaagaaaaagaaaaagaaaaagaaaataagatactgacaggtgggcccctgcacagtaactttcatattttctagatttaattcaaatcccaatctttagaagcccatatctcctaaaccgtagatccgattccgatgaaacttggacctaaattcatgtaaattcaaaagctacattttggtaccaaatttgcaattttaatattttatttgaatttccttaatttattcaaatgccatttgaataaatatttgatttaatcttacatttgaatttccaatttaaacttagatttgcctttcagatatttccttttattttcaaaataccctttagccactaaaaagccgccggttggaactttactccttccatggggacgtttgcgcggtctacgggcctcaacgtcggaccgttggttgtaaagcccggcaaaatcaaacctaaggtcgaagtgctgctcttggcaccccacgccttgatgcgtacagtggtcgaagcttcactattccctcgacctcatctgcacaccgcacagttagcttttaagctctgtgtgattctagccgctccgccgccactcacggttgtcggagtaacacctccaccccactaaactatacccacctcctattcttctagccgatatgctgtctatcgacaccggctagaaatgtcaccaaacctagtcgtcatactacccaattctaatgacgactagcaaacacccaaatcccaaccgatattcatcctacctcgatatcggctcaatcaaatgaaaccctagccagcctgctatccaaactccataccagccatttaccctccaactacccatagcttaaacatgaaatacgagccgatatgctatcctatttcagcatcgactcgagaactaaaccctagctactattccaccaaagcctaatcttgatcccctctccaacctagcctacgcataaaatactaaggagatagttataccccaaacctagcctttcttgctcttcatcgatttcttgctatttatggcttttattgaatttggttcttctttttctttaatagagtctattttattctgaatggcaacctgtggtatttcaagcatcggataatcaagttgcctatcttggatttatttgcattggagcaaggcaagttattattcctctccttcgagcataattatcctatactctatagctttattctatgcattagccattcatgattttgaatgcataacttgaacatatagcaaaccagatatatgctagattttgcttagccatgcttagttagaatatgcataaaatttaatgaacttagattgggacaatacgtaagatttggttaatttctgggtggctagtactatctcgatcgatataattgccaccaaatacttatgtcaaacgaacgagtacgaccacagcttttagaatggggacagacctagttattaggttaattaacaatgtggtacctctgtacagtgattcttatataagtcctcgcgaaggaggcaaacttatgccgcgaagggcaaatgtgatatttacctaggcgcaggtaaatatcttgattatattgtgatcactgtgtgtgtgtattgtgaaaacctggttgagatgacgtggggtatctcatccagttctctctaaaaacctcgggaacgccagaactcctctcgctgctgataacgttacgttcaaagcgtatggggactagagttcatggaacaggtgccactattgttaataacctaaggctgggctacgactaagatgatgaatattggcaagtcgtggactgtgggtaaagcgtacatttactgcagtaaagtataaatgaatctattcgaatagctgtgcttacggaattgagtatcgggactcatatggtatttggttagaaacttaactcaagattttacgaaataatgttgtataaagacatcccaggctttcttcttctatattctcagctttctgccagtaaacctagatctacttaaatactatttcatgcattcattatttgatataatagcttgctgagtacgttgtactcacccttgcttcaacctcctttttcatagtccatttgatgttcttgccaaagtcaggagttcaatcatataagttaattcccttttaacttagtcctcaagtctaggtaatttaaatggtttaagtctatagcaaaacagcagagttaagtcattctaaagcttctgctataatagttagccacaatcctataaattccctattactttatgtaataatatctccttcaaagctatatctaaacaaatgcaaagacgatctagatcatttaacttgtatcaatctactgatttagggcttgatacagttttaatatgtcggttaccgaatcattagttttgggacccgacagtccccttttcctccacgaggtcatcgccgtgccttcctcatcctcctccggcgaaccgaccttcatgaaccgacatccgccgcctataaatagccggtgcagccctcgcttttcccacataactgagcttcgagctcttcttctctctctcctccctatgccggccgtcggccgatctccctcatcggagcatttccggccaaatcttcgcacctataccttcgcctcgacgaggcaaacccattcccatagtttccccttcctttcccccttcgattgaagccatcaccgtcaaccccataaccggccggagcaaagttactccatcacctgttccggccatctctctttctttctccaccgaaaaccaccctccccggacgcgcgacgctcgggaacacacttttccgtcggcgtcgccgcctcccagccaccagagccatggcgcccctcctccccctcctctcgtttgctcagctggaagagaagaggaagatgacgggaggaagaagaagaaaaagaaaaaaaaaagaaaggctgacaggtgggcccatgaacagtacattttcgtattttctagatttaattcaaaacccaatctttagaagcccatatctcctaaaccgtagatccgattccagtgaaacttggacctaaattcatctaaattcaaaccctatcttttgaccccaaatttgctattttaatattttcaaataccgtttgaatttatatttgccttttcaaatattttcttttatctcaaataacccctttagccactaaaaagccgccggttggaactttacgccttccatggggacattcacggtttactatccccgacgtcggaccgttggttgtaaagcccggcaaaaccaaacctaaggtcgaagtgctgctcctggcaccccacgcctcgatgcgtatagtggtcggagcttcactatttcctcaacctccacagcacgccacacagttagctcttgggctctgtgtgatcctagccgctctgccgccactcacggttgtcggagtaacacttctgccccactaaacccacacaaacctcctatccctctagctgttatgctgtctgttgacaccggctagagaagataccaattctagtcgttatactgtccaactctagcaacgactagcaaacacccaaatcccagccgatattcatcctacctcgatatcggcttaatcaaatgaaaccccagccagcctgctgtccaaattccataccaaccatttacccttctactacccatagcctatgcatgaaatacgagatgatatgctatcctatttcagcatcgactcgagaacaactaaatcctaaccattcttctaccaaagcccaacctcgaccaatgctagccacataaccacttaaccagttagactattcgttaaacccacacatgaaatataagtgacaaatgttgcttaatctcctctagcctccaaccctttagaacctacacatgaaatgttagcccaataattcctataccctataaaggagatagcttataccctaaaccctagctctcttagccgcttatcgatcttttgttattttatggcttttattgaatttggctcttcctcttcttcagtagagtttattttattttggatggcaacctgtggtatttcaaggatcggataatcaggttgcctaccttggatttattcgcgttggagcaaggcaagttattattcctcccctttgagcataattatcctatattcttatatctctattctatgcattagtcatacatgattttgaatgcataacctgaacatagcaaaccagatatgctagctttgcttagccctgcctagttagtctgcataaaaatataatgaacttagattgggacagtacgtaggaattggttgatttccgggtggctagtactgtctcagtcgatatagttattaccaagtacttatgtcaaacgaacgagtacgaccgcaactctagaatggggacagaccttgcaaagtaagttatctagcaaaggtggtacctctgtacagtggttctattttaagtccttgcgcaggaggcaattatatgccgcgaagggcaaatgtgacatttaccgaggcgcaggtaaatgatttattgagctcaagtatatatatataattgtaaaacctggttgagatgacgggggtctctcaaccagttctctctctaaaaacctcgggaagccagaactcctctcgctactgataacgttacgttcagagcacatgaggatgagagttcatggaacaggtgccactgatgttagtaaccgaaaagctttgccatgactaagctaatgaatattggttgtcatcgatttcgggtaaagcgtacatttactgcagtaaaataaacatgaatctattcgaatagccgtgttcacggaattgagtatcaggactcatatggtactttgattagaaacttaattcaagattttaataaatgttgctgcatttaaaacatcaggctttctacttctatattctctgccttctgcaagtaatcgtaatcctactcaaatattactatttcattcattcattattgaatataatagcttgcttagtacgttgtactcacccttgcttcaaccccctttttccagagttaaattgaagttcttgccgaagccaggagttcaatcatataagttagtcttatttcaacctagttctcaaatctagattagttagatggtttaagtctatagcaaaaccttagagttgagtcactctatagcttctgctgcaatagttagccacaatcttgtaaattcccctattattttatgtaataacaactcctttggaatcttgttcaaatgtatgcaatgaagatccagattgttgaagctgtatcaatctactgatccagggcttgatacagttaaacatgtcggtttctgaatcattagtcttgggacccgacaacggacaatataacgtctagagggataagaagattgtgaaggtttagcggggtggaagtgttactccgataaccgtgagtggtggcggagcggctaggatcacacagagcccgagagctaactgtgcagtgtgctgtagaggttgagggaatagtgaagctccgaccactatacgcatcaaggcgtggggtgccaggagcagcacttcgaccttaggtttggttttgccaggctttacaaccaacagtccaacgtcggggttagtagaccgcacgaacgtccctatggaaggcataaagttccaactggcggctttttagtggctaaagggtattttgggttaaaaagaaatatttgaaaaggcaaacataaattcaaacggtatttgaataaattaaaatattaaaatagcaaatttagtgtcaaaaggtaggatttgaatttagataaatttaggtccaagtttcattggaatcggatctacggtttaggagatatgggcttctaaatattggaatttgaactaaatctagaaaatatgaaatagtactgtactggggcccacctgtcagcctttcttttctttttcttttctttctctcctcctcttcttcttcctcccgtcatcttctcctcttcagttaggagccgagagagagggagagaaaagggcgagcggggcgccgggcttccagtggccaaagtgcggcgacgtcggcggcatattgtgttcccggtcgacgcgcactcggggaggttggtggctggtagagaggaaggttaaaacggccggaacggcgacaatacgagctcagtttcggccggtaaaagtggcggcggtggtggcttatctcggaggggaaaaggaaggggaaagtaggggaatggatttgcctcatcgaggcgaaggtagtggcgcgagggcttgggcggcagggctccggtgaaagagatcgaccagcggccggcattggggaagagagagaaggatagagctcgaggctcggatgtgtatggaggaaaggggcgacctcatcgtctatttataggccgcggaggtcggtttccaaagtcggtttggaggggagaagggagacatggctatggcgacggcgacgtgagaaagagaacgacggcgccggcttcgttctcccattggtcggcgacggcggcgcgtgcacgtggcggccgcagaggagttaggcggcgaggaaagaggtgcacggcacggcgtcggcttggcgtggtcggcaaggcggcagcggcggtggcatgattgtgggcggcggtgataaagccgcttacggcagttgcggcggcgtcgggcgcgcgcccacaaaggacgaaggggcggctgcctctgctcagctgggccgacatgggccaaggagggagatgggccgaagggagaaaagaggaattttcggcccaaactaaaacaatggatttctaaattttggaataggatttggatagtttgaatttgaaggaaaattgaatgagagagtttagaaaatataatttccaaaagaaatattcctccagttggtttgagtgcaatattttagagatggagtttatttaatgcactcaaatagaaattcaaaatattcaacaccataaataatatggctctagatttgaatatttttaggtatgtggagggaatatggagggagtagagtaaatagaattttagcccaaaatatgtggtatgaaatttagatatttagatatgggctaaatgaagttttgaatttggggtgcagggataaagtctattctcttagcacaagagcaatcattcacaatatttgttataatattattcttgtgccgagaaggaaatcaagccacaggaattaaatcagtggctagatcaaaaggaagattttggaaaggggactaaagataggtttggaatcaaaggataggtaaaggatgggtcgacaattaattccaataaaattggaattgcaaggatttggtttaggttcaagggtaaagttggagggtttcttggaccataattcatgaaaataaaaagagttttcaaactaaatttgaataaaggattttagttaaaacaaggttttaaaccaaatcaagaaatgcctcaatttaaccaaatatatatatatatttttaaatgaaaaacacaaaagagattaaataccagagaggttctgtgtgagttagttctaggaggtccctctaattatattgtcctaggtttaggatgttattaagaacataagaagcggcatgatgcaagattagaaaatgacacattttcaggatgttacaaggagctgcagcagtggtaaaaacactaatgaagcaaatgctgaagtattcagttcaattagcctttccatccacaaacaatatagcagagtatgaaggagttttgctagctatgagaatggccaaagcactaggggctcgacgtttaatgtcacgcccagaaatttagcccaaatttttagactattttgtgtattaaatccctgtccaggaccaaccagggtacacaaaacgacaagtaataaacagttccaaacgcaaataaagcgtaaaatacttacataagaggcacttagtcctcacaccgaaagagaacgacagcagcggaaaaaagcgatcctagcggggcttcagctccactccacagacaaaactcaactggggtctaagccttggtcctctaaattcgtcttcagctcagaagcactacacttctgaaaagggggaataatagtaaggctgagtacaaccaccgtactcagcaagccacaccaatgatgcagacgtgcaaggggatacaaggatgacttgtggctatttgcataaaggcggttgtaaaacattttattgagcaaaacagtaaaactgtagagtaattaaggtaatattaaatctccactgatcaacgctacaccatgttaaacaggcccaaccaacccacctgtactatagtgcattgagtcgatttattaaggtgggactaatcacggtgaatctagtcgaccgcccataaccgcgggcacggctattcgaatagttttactctggccagaggtgtacaactatacccacaagacacagtcccacgacacgtttccgtgtgccgacatgccaccacgacataccgtaaagaggccgtgttaggacccttcgcataaccccctctaaccgatcgccccacatctcagggttcgcccccgtccccagcaggcaacgggcagccctcctctcgtgccgcggtgaatccggaagccgatcaaccggacaacccagccgacccaactccatcacgcccaccctcgcctaggtacgttggctagaggaaagctacactacaagcccagccgttgcccacgctggcttgtggtaagcacgataaattcttccagggtttcccgcgaactggtccttaattgccatgggtgcgactagcaaaaccatgcacccacagcccaccattcagtcgcattttagttggataattacggccatgaagcatggccagatgtctcgagcacgcagctcattctgatactaaaaaggtctaatactgtaattatcccatcaactgagctagtggtaattaagcatggctaagcataaagttctagctaggtcacataagtaacatgagctagtcgatttattacccaatgttgacaaaggacagatatcaagtaaacatggcacaagcaaacaaataggtaatacccggatcccatgtaattagcaagacatgcaattttatttacaaaagataaacatttgtaaattaggatcaaaatgcttaaggggaatgtgtgacttgccttgcttcttcacaataatcttccgaactctgatcctcgtgaaagcgatcttccgaaacgacgggaactacacgctggcatgcaaaacgaggaaaaactctaatgaacaccaagcaaacagtacataaaaagtaaacaaacatgtagagctcaattttagatgaattttgcaagttgaacggctcaattcggagttcgaatgaattagatatgaattttagaagttttgagccatttaaatggatttctagaattattaacgaattattgcgcaattaaactcgatttatgatgtcaccgagagggaagggtggcgccgacaagcgggacccacccgtcggtgactcaagggcttcggcctaccgtggaccaagtccacggaggcacgggctagcgcaccacgtggcgcacacgtggcgacgacggagcaccgacatggcggccacgtgtgcggacacacgggcggcccggatggagaccgaggccgatccgacggcccagatcgatcgcggctgggaccaatgggaggcagcagccggctgtccgacacagccagcagcggcacgggcgcggagcgcggcgacggtggcctggccggacggccaccggccactgacggcgagcggcggcgcggcgagcggtggcacggtaagcggcagaagggagcggggaggagaggagggatgctcaccaaggcgacgacggcgagacggcaatggggaagccggcggcgggctcctcggggaggcaacggtgacggcggtccggcggcattccgcgagcgggaaacggcggccgacggtcgaggtacctagggaaggaaatgaaagggttaggaagggaagaggagatgcgaggtggcgtgaatcaccagccgaaagcgagaggaaaaaccggcgacctcacctcgcatggtgaataggactccgacgatgatctgcgaaggaggagcggcgaccgaggatctccttgtccttgcggagccgagggaggcgatggcacgggtcggcgtggacgggaccgccgccaaaagcgggccggaggtggtagccggtaggcggtggggttttggcgatggttagggaaagaaaggtgagggccggggtgcagtgtgaagcgacgacgccggtggtggcgacagcacagcgcggcgatggcgagagcggcggctagaggcggccggagctcgccggcgacggcggagagagggagcgatgcggggaaatggtttctaggcgtggggagctcggggaaaggggaaaaagggatgagggaagatgagtgggccattttatagcgcttgggaagggaaatcgtggccgggaggagcggaaacggccagcgaagtagggcgccaacgtggggtggtggaggggttaaccggcgccgattttcatggggagagtgggggaaatggtggagaacgtgtaggggaccgagtccacgctgttgaatgcaagctcgggagacgggaggtggcggatttggcggtggagtgggctgccatggcggcggttggggatggagctgaggttggggatggagctgacaggtggggtcgccgggcccacctgtcggcgagggagggagaagggaggctgggagagggagggagagagattttatttggttttctttttatttaattgattaattgaactttgtgactttaaaattacttctcgagctccgaaaattcacgggaaaatttcagagaatatttagggcacaaagaatattacaaaatattctcagccaatgatttttaaaggaaatttttaatttcctcattatttcacttgattaaattgctttaatttttatttaatttctagaaaatgcattatttaatgatttttaatcccgaacgaaaatcggggcattacatctaataatcaaaactgattcaaaattagtggctagtcatttttccaagacttttgaagcaaaagaggatacaatagctaagtacttggaagaggctaggttgaatgagagacattttttggggataacagtaaaagccataacaagggaggaaaagggagaagctgatggaactggcaaaagcagcaacagcaggccaactgctggaaaattctttctttgaggtggttgctcaaccaagtaatgaaaggaaagaggtgttgtgcatagaaaacaaggatgattggagagaaccaattctcaaatacctggttagtgcacaacttcctgaaaaagaagaagaagcaaggagaatacaattgatctcgcgaaagtataaagtggtggaaggacaactatataaaagtggagttattgcccctctgttgaactatgttacaagagaagaaggtatgaagatggtggagaatatacatgaagggttatgtggagctcatcaagcaccatgttcagtagcatcaaaagtaataagacaaggaatttattggccaacaataatgaaatatacagaaagatatataaagacatgcagagcatgccaaaagtttggtcccactttaaaagcaccaccaaaagaattacaaccaataccaccagtttggccattttataggtgcggaatagatatagtagttcctcttccaagagaaaaaggagatttgcgctttgtcattgtcgcaattgaatacttttcaaggtggattgaggcagaagcagtagcaaggataacttccgcagcagtacataagtttgtttggaagaacataatgtgccgatttggaatcccaagggaaatagtatgtgacaatgggaagcaattttagtcaggaaaattccaagacatgtgtaaaggactcaatttgcaaatcaactttgcctctgtaggacatcctcagacaaatggagctgtggaaagggcaaatggtaaaatcatggaagctatcaagaagaggttgaaaggatcagcaaagggaaaatggccagaggatttgctatcagtgctttgggccctaagaactacagtagtccgatcaaccggaatgaactcctttaggcatagacgcgagcggcggcggcagcgtggtgtggacacgcgcgcgggcgccagcagcgagctcgcaagggaggagagagagagagggagagagagagagagagagcctggaagctggctcgggagagaaggggaggggaggggagggttttcgcgctcaccttggagaacggaggggcggacgatgagcggacggcgacggcggtcccgggggcgtcctcgccggcgctcggggaggtcccgaccgacaccgagcggttgccagaggccgcagagcacggggtcgtggcgcggcggcgacggaggggtcggacacgtgtgggaggcaaggaaaccagagagagggggcccggggcgcctttttat

SEQ ID NO: 10473 - DNA, 26052 bp, Oryza sativa
agttcctctgtttttctactctgaaacttcagactactaagtgagggagtgtgagtgaatctgtgagattgatcttggcgttttgcggacaaaataaaatcgcaccgtagcgtttagcacgtgcatattagtgtttacctgatggcactctctgtatacccctgtggaattgtaaagcacgagaataaagaactgttgtctgaagatacaagtggtcgtctaaagttggggattagaagaaacaacaatggccagtgggaaattaacaagagtggattctaactggatgccaccttctgacaatggtcagaatggacatattgaaaatgagaattgtgttgtttcagcaagcaacggtgatgatgagaacggcaaaaatggaatctataatccagagccaggagaatttgatcaactaactagcaatgtctatgatcttgattcttctcccatggatgcacatttttctccagcacataaggtgactcagatgatgatactgttgtgttatcacctggtgctgtgaatttcagttcagcacatgacactggcaatgtatttccacccaacctaactaaagttttaggaacatgtggggaacaaacgataggagaatagatcctactactactagtacacccagtttcacgcggtccactcaggacccgtgaatctcgcgttcgacttgatggttctcccggatgacgtgatcattggcatcggctccagctttgcccagacgagcggcactactcccatcaatgtgtgcttggtgaggagcttccggagcttctttgcgtggcacttgagcttcttcttcatagtcattccatcctcagctgccggtaagggtagttccttcctatattcccacttgctcattgtggcaattccaagtagttcatgagcaatccttcggacactgtgctgacttccatggtgttttttctgcagatcgtcttgaagccgttgcatcgcgatcctcacttcctcctcatctttttccctcaatgattggaacagaaaattgtcgacgtattcaagaatgttgcttgccatcctccagtgccctgcacaaggaatgacttgaataattaccatcacatcactgattaactactactccagcaatcatataatgttgtactccacatacagtagtagagtgcagttgacaacaattaagttaattactactccatcaaacaacagacagctgcagactgattacactagtgctaacaacaacacatgatactagttagtagtagatggatgaaacaatcagcagtattaagcaaaacagtaacaaaataaacatggcatcgcacgaaatgaaatgagcaaacagaacaatcaacaacaaggatgaacatcatcaagtaataatcaatcaggcaaggactaataagatagacatagcatcccacgaaatgaaatgaacaaacagaacagtctgattcaacaagaaggatgaacatcatcaagtaaggagtagatcggaaggaacatattaccggcaaccaagtgagcaagcagatattgctccttgagttccttgaggtccttgggcttgggcttgggcttgttgggtacatcagctggagctagtggagctgttgctgttgctggtgacgacgggtgacggtacttgtcccgaatgttctgcacccttgaaatctcatgcatgatgtccagccgggctttttccttggtctccagcagatttggattgatcacgatgaagccaggtacagagtcgtcggcggaggcttgttcgatcttggataggatgagaggcgcctccgctggaggaaggtatggcacaatgaacactctaagaggctgatcgacaggagcaggagcaggagcatgattctccgcctgaacaagagccgccgccagcccggaggcgcttgaaacacgcacaatccatccggccttcaccacgatgttgtcgacggcgtcatggagcaccttcggctggccctcctgcagcacctccacggggagcccgagcctcctcgccgtcttgcaatccttattcagacgcgcctcggggcatgccattctcgcctgcacttgcaatttgtatttcaatcaatcacaaccagaccagaggtccaaagcagagcacatatgtaaaaataatcttgcaccttaacgagctgagaacacgttaattgcaagaacaagcgcgcagcgcgtggagagggaggcgaacgagatcaccatggaatcacggtgctcgtccccctacggcgcggccggcagggcacttcattcccccgtgccgtatcaatcagcaaaatcaaaacccgaccaacagggagcgatcgatctactactctactggagtggatgacaacaaggacaagcaagcgagaacgatctactactctactggagtggatgacaagcaagtgagaacgatctactactctactggagtggatgaacaagcaaacgagcgaacaaccaaggaggagcatgactcgctcgtctcgtcgaggtattaggcgaacggagatcacaataatggagatgaaatcgtctgcctccctctgcccgggcccggccatttcacatgtactactagtactagcgcatcggcaaaatcaaaccaaaacccgatcgatcgcaacacgtacgcaacaaaccaaaacccgatcgatcgcaacacgtacgcaacgcaagaatgaacaaaaacaaacgcacaactactctccaacctcagtcgtcacactcacatgcaccagcaattatctagaattacacgatgatccagagtaatccatccggcgcgcggtggaaaacgaacgagcatgactcgctcgtcgacttccaacttgcaagcacggagaggagagaggcgaaccgagatcaccatgaaattgcggtgctcgtccgccacttccgattcatcggcgaaaataaaccaaccagaaccactaaatcacccaaaacccgaaaaaaaatatccatctcccagagaagatatcagcacatacataagcagagcaggcaaacaccaccacaacacagctcgcactacatccaccaagaagatcgcagcgaggacacagattgaattgaagaagaagaagaagaagaagaagaagagaggaggagagggagagattttgttgctcacctttcggcgctctccaatcgcttgtcacggcgaggcgaggaggaaaaaggtgaatggaacactgtagcaacaagcaatctcctctcctctcgcggtatttatacactgctcacttctgtcacgtacgggtacggtgagactgacttgtggacccacccattccgatgcaccgtccgatctcacatcgacgcctctggaacctttcatagcccgcacttttcgtgtgccatggcaagtgctgtgacccaccccaccggacggtgttcgcccatgccattgggagtggaacccacccctagccagccatctcactctggtatttatataaaactacgtacaactactactactgtactcatttctccatttgtcacgtataaaacccaactgcatcactaaaaaaaaaaagccaggaaagagattaattagaaccaactttaggtacaacatttggtaatatgatgcatatcagttaactaaaaacatcaagtctaataaccataaaaatttgacatactggggcaatgtatattggtcatagaatcaaacctcaaggttattacacattatggtctatggaacatcgaatattaacaaaactctctaaacatgatttacagacctcaaccagatatgcaacggttaagggaatattatttagtccaaagcgaaaacatgagttaaggggtggtccaaagtgaaactttgggatctcttccatcccttcttgctcctccctgaactccggccagccaatacccaaagacgctgcacgcgctcgagctctgccagcactgagtggcttgagctcagcatccatgtgtgtacgaagtgtggacggacgaacatatacaaagaaaaaactatgatgcaagctcaagcctgggtgcttgccaaagaatgcatgccaatccaacgaaattcatgcaaataacccatcacaatcaaacctcaagagtcatataatagaggctaagacgctactgagcgaaacagctcaatctcaaaacaactatcttgtcaaaccatcaccctctcagaaaagcactccttcctaagcgcgttgcaaagcgtactggtgctcggcagctgactcgagtgcagcgcaacgccggtggagcttgagcatcagaggtgtcaacggatggagctcgtgccaccctagctgtgggtggagcttgagctcaagctaggccacagtgcagcacgggaggagcttaagggtggcagtgtgtgcatcctcgggagtttgagctcgaaactcaacaccagctagcagagctgagcgcattgcagcacttctggatcccagcagctagccagagtttaggaggagatgaaagagatgaatagtgggggtggttcaagatgcaaccaaatgaaatattatcaagtccaaagtgaaaacatagctcaatgggtgtcccaaattaaaaccttggtaagaaagtgtagcccaatgtgcaatttactcaagaaaaaaaaaatgcatagcaccgttcttcatgtaagcaacgccaaacaagaattataaaactggactaaggaaaaataaactgaaattcaatagtttcggaggcaatgatttcagaggtgctttgaattacacttaaggtacctgtccaactgagaaaattgagaaatgggaatcacctttttggcaccagaatattgcattatttttgtgatccaattggctaagaaccaagatcatctgcaatgacaagcactaaattatcagactataatcagggaagtagatcatttagtgcaccagctacacgttatgcattttttcctgttttgattccaagaatggtatgtgagatgtatgccattgccataacaaagtgctcttaaatgggccgtgatgtaagcaaaatattcagctagttaggattgattattcattcaaacctagggtccatcctaccactaaacataaacaaaacgcatccacgagcaaagaaagatttagtacaactccttgggacaaactccaatctattatgtcatcagcaattctcatgtaagcaagaaaataactttcagcgccattagatcagatggataaaactcttttttttattattttcctagtgacaacaccaattagaaaagccataatgtacacaaacctggagttgaatgaacagccagaaaaagaacagctacatttcatgatagaagtactggagtacatggctggagaagccacgatctcagtgagggctggtgggcaccgatcaacctcgatgatggctagctgcagaacaagttcaatggttcaatgatggttggctccagatcgagatagatggcaacgaccatggcactggagcaggctgtggccctggtggtgcaggggcctgtgcctcgagacccaatggagtaggtgtgaatttgcgacagcctcgcggcggagcagccagatccgcccggcctcagccacggctcatcggcagccaggtgtactgttgtgtaggaagtacgcaggccttgagggagtggaggggcgaaagacactgaccagagggtcccacattgtttttcaccatgttgccacattggcatgccacgtggacaaaagtgacaaatagttaagaaaccacctcttaagaacaaaaataataagtgcaaatctaagaagggcatttggacaattgccaaacctaatagtggcaaatagttaaatttcccagggatagggggagtagtgcgtgggatcaaaggggaggtggggtgtgagggcgtgaggccgtgaaggtgaggacgcgttgctatgcgatttggatgatctggatcattcgatctgacatagatgaatagaggctgttggatttgatgaataaagtatgtaacatgtaggacttcattggtgaactatagggtagatagttataactaccctataactacagacacgaccgcatatatttgtgcgacggagaggtttatataaatatacttgattcaatggctaacacccatataaaattatctaattttttacacttgaattttgtctaaaacttgttaaatagtcatctaattgtcttatgattctaaataaccgaaacttatcatcatcgggttttcaactttatagtatttaaacaccacaccagctaccaccccttactcctttgcctcccttttaatttacttaccaggggcctatcactacttctatgcatcctcattggtaacttcaaaaatcgagctataaaagatctagatgtcaatcaaatttatcacatattataccatataaatcagagcagccagaagaagctgaggtgagggagcagagagacctcctgaagatggagcaatatatggtcctgcaatccagctcaagaagaagaagtaagtgcccaaatatttcagtttctggaggagcagctggtgcttcagcacaaggaggagaaatattcaagtgcccaattccagtaagggggtgaagctacagttgcagcaagagaatcactcaaccttcacagcttcactagagccattaaacaggtaatcaagagattaaaatggaacagaaatcatatcatggcatgattgttgtgtgatgcatatgctagtatgtttaggagctgtgtgcatgcaataattatatccattaaacctgaacaataaactccattgctggcatgcaattgaatctgtgcatatactagtagtatgtgttgtgaattatatagtatatatatgcatccttgtaaaaataagtatgagcacttcagctataaccggaagaccaaaaccaggatttaaattggagcacagtatatacattcctagttcattaagcaaggaatagttttgacgagtaattgtcagcaagttagtatcattacaaaataaatagattcccagtaagataactctagtatagatcaaccatctaattacatagcaaacagcacgaggtatcttttacgtgatctaaaagtgcatttgatttaaggatttatatctatgtgtagtttcctttataaatcataagtcatcaaagaaccgcataataaatcttgagtggaagaataatggaattaattataacttgattgtttaaaatcttcggagctttatagaagttcggtgccatcactagttcagaattgtacacagtaaaacatatagaaacaatgcagttgttggtttcatcgtaaataaattaaattgagcctttagagttatggggcaatacagtaggtttttgtagcaaatcatttaatacaataaagcaaatgtttaggacagggcatcaaaataaaattataacatatagttatcagtttatcagtagttaaactcttcctttatcaaaattctaataaagtatttcataagttaacctattgttcagtaaatcatatagggtaataatcaggacataaagacagtagaaataaatcattcaaagaaatcagtcaccatctatttgtattcaagattagatttcatgggttataattctattatctatagtgcaggtttttgccatgattatcaaagtataaaaccatgtaattgttgcattattcaatataaatcttattttcaaatctgattttattactgtgtcactaatttgagaaattagataatttcaacatgcaaacatatatatgtggttctgatcattctagtgtgctactgattccggtatttcagttacttttatatgctagcatatataaggacttaatcatgttagtgtaactttttttattatcctttctaatttcatttcagtactgcacttgcatcagaattgtgagcattcatttatccattcatagcatataggcatcaaccaaataaatcactagaaccaacagagaccaccataagcacagcacaacatgaccaagttgagtattagtgctagtccataattatccccaatgcatgtcacggcacaacatcatacaagagagaacatcacaccagaacattgtcataagaatcagataaggaagggagagtttgagtggtcaccaatggggataggacgcagccgccggagttgcgcggtggttggcaccagtcatctccacggcagcagcggcaattggagaggcggggcgacggctagggttagagctaggacgagactgagagagagggaggatcaggggaagagagaaagaaagagaagaagagagggagaagcaggggagtagaggaaggaagcggtaccaggggcaggcagcaccggccatctcggcggcggcggcggcggcggcagggagtcgagcatccagggacaattggccaagggaatcagagaggagtagggctcgcaccagtagtgaaggcctggaaaccttcctagagtccatacgtcgccagagtttggccggcggcggcacctcgtgttgagcaacgggaaccgattcctggcagtagcggctgctggagggcgaccggagttggagtccggtagccggcgtgaggaagcgcggcggcgctagagcgtgacggagaggaggagaacgagagaaagaaacaaggtggactaggtgggctcttctgttaacctttgatatgtgggctgtacatggtatggtggtctgattttcgtccttgattcgatgcaacccgtgctccaacttactaaaacggtgcaaacaacatacctcagtagttttgtccccgattttatctgacatgactcttttaactaggtcttcgtccatgtggcattgacatggtgctcacgtggcaggtttgatcttaaaaaagtaaaggagcaacctcggccttcctactttatctccccatctcttcaccggatgacaaagagggagaggcggggaggccggcgaggcgccctcctctctcccgccggccgccgccgtgccgctcctctcccccgtcgccacgccacacggcgttcatctctggtgccgagctcatgcgctccatggcggacaccgacctccgcacgctggatctctctgtgtgcagcagcctctccctctccaccggcacagcgctccctccgaacgcccttttctccgcccgcagacggctgtcagatgccatccaggagaagaagcaataaaagacaaaaaaaaaagaaagaaaaagagaatgattgataatgttttcatcgtacagtacatacttcatctcatattctttttccaaattcaaaataaaataaatctgcaaatagaatatatcaatttttaaaagaatgttaaggtgtatagctctataagatatacttctttacacatttttttccaaattcaaaatataataaatttacaaatagaacacatcatttacaaagaatattagaagagtaagagaaaagaaaaaaaataaaaaaaggcagcggtgactggtgaacttcagacatacaagagctgagcaagcagcattttttctttattagaaaaaatacccgtgcgttgcaacgggtaaaaatgtttttggattgctatacaatgtactctttggttttgtgttaaaaactcattttcttccttccttttcagtctcggcctagcccactacccctctacttagcctgtgtcgaaacaagatttcggcaataataaaaggggtggctatcaagctagaaaagtggatgggtttggagacaaagaattttatacaggttcaggccttcttattcaagaagtaataccctactcctgtccggggatgattccgccgtgtgtgttattgattgtataaactgggaaaaagaatcgtgccccgagaggcacacggaccctccttatataggggaaggagtccgctttacatagtacagtccatatccctaacggaatatgtaattacaaataaaatacaatcgtaaccgactaagatctcaggtatttccttgacatacaagttaaaaactaacccgagtcctcataaagatattatatctatatttggtaccgtatatccgattaaattataactgtcatgtagatatggggtatccataatctccacagtagcccccgagacctttgcagtcgacgaaatagccatctcagaacaaaaaacaataatccgagtgcttcaattcaacctgctccagcctgccgagtgctaaaatcaaagactgtgaagggcgaaaataaaacatggtgcatcgagtagatgcacctaattaggtgtagcccccgactatgtggttagttgaaaaactaaacatgtagtcaagaaccaagtggttttatagcgaagcacgccgcgtggtagtcagtaaaatacccagccgactgcttctcaacttgaacatatcaaggataaaaaatacaaaaagggccgagtgataaacactcaaaaggtccaaaaatagacatatttgataggaatccgagtaagaaactcttaaaatgatccaccaagcatgataaaaggaatcatggtaattcacgagtttaatagcctaggctatgactcttaccataaccaagataagcatataacatgctaaaagaatgactattaataaaccagtcatcttaaatcgacccaaacagcttttgcagcctaagaaagcttacaaaaacggtataacacctttctgtcgggcacctttttatgtgcatcataataattccaaagaattattgaatcgcgttaaaaaggattttagcagcatcgagccacatcattgtgaggacaaattgccaaagcaaaaagcgcctaagtccctagggatcacaacgggccacgctgattataatattgggctgaagtactgtacaggcctaggcccattagtactcccgataccctaacaaagcaccaaagtccaagcgtcgcttcgtcttccccgccgagactctcgacatttccccactcctcgctacagtagcaaaccgcaccgtcggagctagggttcatcgatctgctccaatccatcctcaaaaacttcacgaaatttctccccgcgtccactgctccgattcctcatccttttccagccatatctcggaccaaattaaaccatccagttcacattcatggcggaagaaagagaaagcttcgagagtcagtgggcgccctccgatgtgacggaagataatctgaaggagatggtggcacacggcgttcttccgacgaaggagatcatcgggtggcgaccggcattcggcgaagcattcccaacccccaatacgcatgaaatcgtggtatttgctcatttcttctgtggcggtttctcccttctaacctcaagatttttccggggaattctaaatttctatggaatcaacttgcatcatctgaatccaaactccatagtgcatattgccaattttattcatgcctgcgaagcttttctgggcattaggcctcattttgccttgttccgccgcatcttcttcctcaagccccagccaaacaagagcaaaccatgtgttgttgggggggctggtttccaactcaggggaaccttaagccaaaaatacttctctatgcctttcaaaacctcaaacaaaggctggcacacaaattggttttatgttcaaaaccctgagcctgctctccccgagtactcctgtcttcctacagtttatcgggatacttggaactcactgccaatgggagatgaagctgcgcaagcagtggaactgatggagaggatgataaagctaaaagaacaaggccttcaaggagaacagatcacccagcactttatcaagtgtcggttagctccaatcaaagagagatctcgcacagcctttgagtttgacggcaaacatgacccaaatcgtgaagatcctgactctcttgacttcaaggtcatgaaggaaaagatgtataagatcttctcaaatgctatcgttgtcagctattcacacttgctgccagtcgtaccgttcaatgcattcaatcctcctccaccggtatgtattcaaacgttccaaccttccacaaaatacggtcttatctgtttgttgaatcagttaacaataaaggatatcacgcccaggaatttgctttgatgaagtcggatcccccaatcgctcaacaccaatcacctcgccgccaaactggtcagggaagaggaggaccaaaaattcggtctgaaacccaaccaagtgcttctgatccaatcggccagtcagattctcgcaagaggaagctagttttaagtgacgacgaaggcgatgataccggaaagctcagagataaaggagcgaccggaagacctccgaagccaactaatctgaagaagaaaacctccagtcgtcctgtaccaaaaattagaaagtcttccaggtacaaatcatataacaaccttccttgtattaatattctctcatcatgaaaataacaccgatagcaaaacttgtaggaaaccatccgacatagatccttctaagaaagactctgacccgactaatatggaagcagattcctcaaaagaaaccgagccgactgcaaaagatcacccgagtgataatccgcaggccagcgacaatgtaaaacccagcaacgaacccacgaccgcaagccagtcggccgaagctggagtcggagttaaccaggagcccccgactggaaaccagtcggatgcagggccaagccaaaaaattcccgaggttgaagctcaaacaaacagtcctcccggaaaggatgctggcaatgactcagaaaccagatctcccgtgaagacacaagagtccactcgtccccgaccgggaatcatcataggtaaacacactatctgaaatcatttcgatccaacagactttatttgatcgcctcatctttattcatggatacactagggccaatgattggtgatgaagaagagatcctccggatacaagcagctgaggattcgcgccctcccatcctggtcaagtggtgggatgacaacatgcagcctcaaggaattgtaataaataagcaaaaagaagatgaagaagtatgcttgctgaaaaaggcgatcagccaagccacccgcattgtaaatgtaagctctttggcgcctgatctcaaccatctcgtttgccatttagtccaggcgctaattaaactgtcttgcagaggattcatcttaggaacgaagctaaaacggcaaccttagagaggttagtccctcatctcgggaccctcgaagcctccaggaatcagctgcaggagacaaaagagcttgccaggaagaatgaacatgatctgagggatcggattgctgagctccaggaatccaattttgaactgagcggctcatcaaaaggtacacacaaactctgcccaactaacttatgttgttatctttgtaatcttgattaaccagagtcaatgtagtgcaagctgccaagatatctcaactggagaagcagattcaaactctggaaaatgataaggcagaactggcaagacagagggactcagctttaaaggaggttgaaggtaccaataatcaatacctcaaaagccattatcttctatatgctgattcgttaatgtgaatctgttgatgcagaccgcaagatcaagtcccaggcacagtttgatgtcttagttgacaagatcaataggcttgaaggggccagggataaagtcactaatgctgctactccactcatccaagccatgttcttcaataacgccggtccgagtacacttgatgctgccgaaatcttcaacaagctgagagtcgctccggatacttacttcaagaacatcaaagaagctggaagtatgggagcaagtctggcgttggcgatgaccaaatccctttatccaagagttgacattgatgccattgatggctttgcaaacgggacgagcgaagaagctgctcttgacctcatcaatgatgcgataaaagccgctgacaagattgctgctgacgtggttgagagattccaagatgtcgaccttcggccgactgggtctgataattctgatgatgaaaaaactgatactgattgatataacaatgattttgatgattaatgatgatggaggtttaatttgtacaatactgatgaatttatgctatgcttggtgttccatacttagcttctgatttcttaaaagcctttgtcaagccttattgagcctaaaacccgcaaaaactattaaaaaccttcagtcctcattgactaagtcgaaagaccaagcaggacaatgataaatcaagtaagcaaattgaattgataaaaatcacactccattattatcatggtagccccccaactgaaaacttcaaggaaaagcttgaagttagcagtcaaagaggaaagatacaaacgaaatgcctaagcataaaatcgacgaaggtgttcaatattccaagaattgttgataagagtaccatcttcgcgctttagtcgataagaacctggccgagtgacttcagcaattatgaacggtccttcccacaagggagataatttatgccgatcctgtgtggtttgaattttcctcagaaccaggtcgccgactaaaaaggctcgcgatcgaacattccgattatgataacggtgcaacccttgcaaataccgagtcgactgaattaaagctgcttcacgggcttcttctagtcgattgatgtcgtctactcggccctcttcatagcgctcctcgttgaagttctgaaatcgtagtgattcaaattccacttcactcggcaacattgcttctacaccataaaccaaaaagaacggtgactggccggtagcccgactgggagtagtgcgtaaagaccaaagtacggacggcagctgatctacccacttgccagcatagggacgtagtcggttgaaaactcgtgcttttatcccttgaagtaccatgccattggcgcgctcaacttgtccattactcatggggtgtgccacggaggcataacaaattttaatgccgaagtcttcacaaaagtctttaaatgctccgccagtgaattgagtgccattatcggtgatgatccgattaggtaccccaaaccgatgcacaatgttaatgaaaaaatctctagctttatctgctgtgatcgtgatgaccggtttagcctcaatccacttggagaatttgtcgatagccacaaagatatgcgtgtaactgccgactgcccttttaaacgggccgaccatatcaagcccccagaccgcaaacggccaggacaacgggatggtttgcaactcttgggctggcagatgaatttgtctggcaaaaaattgacaaccttcgcatgtccgcacaatcttgtcagcatcagacacagctgtaggccagaaaaaaccttgccggtaagctttgccgacaatggtccgtgcagcagcatgattaccacaaataccagaatgtatatccttcaacaattgtctcccttcttccaaagacacacagtgctgcagtattcctgatggacttttcttgtacagctcagtctcatgaataatgtaaagtctgctgcgcttggaaatccgctcggcttcatttttgtcctgagggagttcttgtttggtcaaaaattttatgagaggttctctccagtcggctttaattatgcttacgcctcgggtattcgtggcttcaattgcttcttttctgggcacggttggttcataaagatgctcgacgaacacatcagaaggggctgcttcccgttttgaaccaaaattggccagtctgtcggctgcctcattgttatgtcggaggacatgggtgagctcaagtccatcgaatttatcttccaacttgcgcacctcttgtcgataagcagtcatattatcatctagacaagaccactctttcatgacttgattaacaaccaactgagagtctccacggacgattagtcggcgaatgcctagagagattgcaatccttaatccatggagtagcgcctcgtattccgccacgttatgggacgcagaaaaatgcatccacaatacgtagctcagtctttctccagtcgggaaaattaagacgaccccagctctagtgcctgtaagcttctttgacccatcaaaatgcatagtccaatattccatcttttcctctggcatgtcttcttgacactcggtccactcggcaaggaaatcagctaaagcttgtgacttgatcgaagttcgtggcttgaacgatatgtccaaagacatcaattctaaggcccacttcgcgatccgtccgtttgcctcgcggttatgaagtatatccccgagtggaaacgatgtgaccaccgtgaccgagtgactttgaaagtagtgagataatttcctgacggtaattaagacaccatataataacttttgaacctgaggatatctcgtcttggagtaggccaaaacctcgcttacgaagtagattggtcgttggactttttgaacatggccttcctcttcacgttcgacaaccaggaccgtgctcacaaccttagaggttgccgacacgtataacagcagcggttcttgcggatgtggcgaggccaaaactggtggagtagtgagaagtttcttgaagtcttcaaaggctttttgtgcttcgggaccccactggaaattgtcagtcttcttcagcagcttgaaaaagggcatcccccgctcgccgagtcgtgaaacggaccgactgagcgccgccatgcaaccagtcagcttttggacgtctttgtgggagcttggtggtttcatgttgaggatggcgttgattttctccgggttggcctgtatgcctctttgagataccataaatccgagcaacttccctgacggtactccgaagatgcacttttcagggtttagtttcatcctgaaagcacgaatgcttgcaaaagtttcttctaaatccgtgatcaggtcatccttctgcttggtcttgacgactacatcatcaacataagcttcaacgttgcgaccgatctgagttgaaaaacatctttgaatcatgcattgataggttgctcctgcgttcttcaatccaaagggcatggtgatgtagcagtaggccccaaagggcgttatgaacgaggtcttcaagcagtcggattctttcagtcggatctgatgatatcccaaatagcagtctaaaaaactgagtagctcgcagccggccgttgagtcaaccacctggtcaatgcgaggtaacccgaaaggatctttagggcaagacttgttgaggtcggtgtaatcgacacacatgcgccattgtccggtcttcttccgaaccagaactgggttagccagccagtcgggatgaaggacttccttgatgaagcccgctgctaatagcttggttaattcctccttgatcgcgtccctcctgtcctgtgcaaaacggcggagttgttgcttgatgggtttggcgtcttccttaacatgtaaagagtgctcaatcacctctctaggaatacccggcatatcggatggtttccatgcaaagatatctttattattttgaagaaaggtgatgagcgcgctttcctatttacaatctaactcagcgcctattacagcagtcttatcaggatcggagggatctaagggaatctttttcgtcttagcatcgctttcttcggtcttcgtcagcttggttgcaggcacttctccctcgcttgccgtggtcgcagccagtcagatctcttcgcgagcaagagtgatctcgtgggtttgggccatctcgcaactttctttgtcacatgtgacggcttgcttgatgtcgctccatagtgatatgacccctcgaggaccaggcatcttcatcatcatgtaggtgtagtgtgggacggccatgaatttggctagagccagtcatccgagtatagcatggtatgctgtctcgaaatcaacaacttcgaaacaaacgttttctgtgcgaaaattctcccgagtgccgaaggtaaccggaagagtgatctggccgagtggtgtggctgataatcctgggataacaccgtggaagggtgcattacttggctttaattccgtgcgaggaatctgcatatcgtccagggtcttagcgaaaaggatgttgaatgcactgccaccatcgatgagagttcttcggagcttgatattgcgaaccactgggtctagtaccagggggtaccgccccaggtggaccactcggtcgggatgatccgagcggtcgaacttgattgctatctctgaccaccgaaggtattggggcgtgttgggctgaaccgcattgatctcacgttctgttaacttctgctttctcttagactcataagccagaggtccgccgaagatgtgattgagttctttgcgatggtcttgaaaaccagtcggggcatcgtcttcatcatctttcttctttgatgtgccttgatctccgtctgagggcttacgtgcattcttgacgtattgctccgcaaattgtttgtagatgaagcagtctttggccacgtggttggagttgggatgatgcggacattgggagttcattatcttgtcgaatgtgttgacgcgggaacgttgtcgggaagacggagaggttgtcaccacaagttcttcgggcttacgcttgcgatctttgtggttgttacttccactccctcctgcggtcggcgtatccttctttggcttccaagtggtgcccgactgcttggacgccgtgatagcatcttcggctttggcatactcattggctttttcaaacatctgcttgaccgtcttgggaggtttgcgtccgaacttgccgactaggtcctcgtggcgaatgcctttagtaaaggaggcaatgatgacgtcgtcggtgatgtcggagatcttgttgcgttgctcagagaagcgtcgaatgtaatctcgaagagactctccagacttctgaatgatgttgtagagatcgaagtgtgtaccaggccgttcaaaagtgccttggaagttggctatgaagtggtcgcgtagctctgcccatgatccgatcgtgccgcggggtagctcgtggagccatgaccgggcagaatccgctagggccacaggtagataattcgccatggctttgctgtctcctcctgctgcgctgattgcgagaccatagacggtgagccaagactgagggttggtggtgccgtcatatttctcgattccagtcggcttaaagccagctggccaatccactcgatgcaaatcacttgtgaaggcagcaactccgtccacatcgtcgtcgtagcgatccggtgaatgatggcctcttgctgcgcggtgctggttgatggtgtcgcgaagatcgatggggcgccttcgatgtggggagtatggtcgttcaactcgacgctccctatatcgttcgggaggcgaacgaacagaccgttcatcatgtcccctgcttctgcgactagatccggcgccggcaatgctgaggcttggctggtgatagtcttgagatcgaagatgagggactcggctaccaatcggggtgcaggtgcttgcggagttggctgggaccgaggcagcgattatagtcttcgtctggttcaagattttgacaacatgatcagcttggttaagtgcgtcttccttgaggagggtgtcgaggagagtgattgctgcaaccgcgttctgctgggggtgcgaaagaccgctgttccatcgatgtcttgttgctcaatgagctctctcgctcgtcgccctgattccaaggcgcgttgccgtcgatcttcagcctcctttgcaatccgttcgcgatcttgttgctcacgctgtagtcgttctcgcccctgtcactgtcgctcttcctccagtcggcgacgttcagcttcttgccgtgcgcaatcttggtccgcttctcgggctcggcgctgttcctccgtttcgttgtcagccatgaatacgccgaagaagaggggcgtgtagttatcctcgaagctgtcgtcgaagttgtcgaggtcgctgtggtcgtagtggtagccgaagtcatcgtagttgaggacctcggttggttgagaaccgacgccgggggagctgaggtagccatccaactcttctgtcgagactgtcctaagaggttggagtataacgccaacctccctggatctagattggatcggggccgaagccggagctcgcctagatcttcgagtgggagatgtcttggctgtgaagacagcagccaaatcatcaggaagtttcatcaggattgagggataggacccgtcgtcttgatctggtcgcggtggagtagattgggtctcgtccgagtggtttgaagccgactcgggagagatgatcttggagtacgcctcggccgagttcggaataccgaacggtgcggggacctgatctcttcccgactggttcgaatccaagtcaaggagagagatcttgccgaagtcgttggtgatgaagttgaggctgccgaaccggaacgcctgcctgggaggaaggcgaagtcgtcgatgccggagacagaacccatcgcacttagtcggcaaaaacttgacgctacccctacctggcgcgccaactgtcgaaacaagatttcggcaataataaaagggggtggctatcaagctaggaaagtggatgggtttggagacaaagaattttatacaggttcaggccttcttattcaagaagtaataccctactcctgtccggggatgattccgccgagtgtgttattaattgtataaactgggaaaaagaatcgtgccccgagaggcacacggaccctccttatataggggaaggagtccgctttacaaagtacagtccatatccctaacggaatatgtaattacaaataaaatacaatcgtaaccgactaagatctcaggtatttccttgacatacaagttaaaaactaacccgagtcctcataaagatattctatatatatttggtaccgtatatccgactaaattataactgtcatgtagatatggggtatccataatctccacagcctgcttctctttaacctagcacaaaaatagaactataggcctaacttgcacagtcggctgccatcttcaacctccggaagacagtcccgtgtagtactatgccagaaccgatcctcccattaaatccggtcaaatttttctcgatctctcaaaattggttgagggcttttgattcactcaatctcctcttttcatttttattaaaattggagtgaatccacaaaactgtgggatataaacggtgacttttaaatagatattgaatctggtgaattaaagcggaactgaaaagataaattatatggaaaatgatgatggagtagtggagaattgatttttacaatagattggaggagaaaaagcgtgaggaggttgatagatgtggcggtggtggcatagtgctagggttcagcccgacgacggaaaaaaccgagtagattaaaaaaagaattttaaccatgtgcgcacacccttcagcttgcaaaagaatacgaataaaaaatagggacgaaaaaaatgaataaaaggaaaaagacgatggcaaaataaccggaaagaacattgaaaaaaaagccggatggaagaaaaaagagaagtggaaaaaaaaagctggataaaagagacggacaaataccaatcggtttctccgcacgactattttttttttttggagtcggcgatttttttattttttaggtcgacctttttgttttttactcaacattttttgccactttttttgtttccggtacgaatcggacttttttttccatgtttttctttcgcgttttttgtgcgcgttttcttttcccgcctgagtttttcgcctttttaaaattatggatttggaggagtagagattaaaaccgaaataaaaaaattaaaaccgacttaaacacgaatgacttatgaaggtaccaacaaaaatattttaaatttttataataactagaaaatatgcccgtgttgcaacgggtgaatgttattttaatgttactattgatatacggttcagatagaatgaaattcaccgtgggaatttgtttggatattttttttagaaaatcatgagttcaactttcatctcaaattagcatgtaagtttttttttaaagaaatttcttatacaattttttttgtatttccaaaagcaaacggacttaaaatccgactcaaacatggacctgtatttaaaaaaaagacttaaaaaccgactcaaataaggatgacgtaccaaaatactggcaaaaatatcttcaatttttataatagtagagatagagaagacaaataagttttgtagaatgatgggtctgtttgttaccaaataaaatttttcacgctgtcacatcaaatatttaaacatatgcatatagtattaaatgtagaaaaaaaatcaattacacaatttgccaagaaattgcgagacaaattttttaagcctaattacaccatgattagacaacgtagtgttacattaaacatttgctaatgacgaattaattaggttcaataaatttatctcgcagtttcctgacgaaatctgtaattttgtttttattattacactacatttaatacttggagtgtatgtcaaatatccgggggaaattgttttttccaactaaacaaaccctttgtgaaaatttcggggcaatgcgggggtgaccttgtggttggggtggggagcattggaagcggcggcggtgaccccatccatcccggacgacgacggcgccgatccctcccggcctcctccccgtcagccgccaccaagatttggatccgagtctcgcgaggaggggaaccaagccggattagtagtaggagtagtatatttcttcttcttatagatatggacggactgggacggggttgagcagcaaagcaatggacacagcaggcgccgccgcccaccaccgcaggtagcttgaccttctccccttccgaatcctctcttagatttgtaggaaatctcaaacctaccgtttcctctgaaattaacagcgacataatcttcttcttcttttaccgtttcccctgaaattaacagcgacataatcttcttcttcttcttttactcaagtttctggtggcacctgcattattacgtcattgcaaaagctgcttcttctggataacagtcaccctcttctctaatgaaaatttagaatactttttgcttggatggctggcgagaatttatcttaccatctgtcatgactaaataacaagtgggattgtaactagactatactggtgtttatcaccactaatgccagtgtttgaactcattctcaggaaaattattttattctcattttgtccaagacaaattttgttcacttcattgaacgcatgcatattctagttgtaaacttgggaacgttctagttttcactcagataggaattaggagctatttatccttttcttttcactgtcctttgataacaagttaacaacccatagatcatcccttaccttttcctcattttttttccctgtttggttacaaatgaacagaaatactaactgcgatagcgaactcttaccattgcacttcagctgttcagtgtttacgtaataagtttaagaattatattgataacatctaatctctggaatgcatcatctccaaagattcatagctagacaacttattgtttattatcattgctaaaggaatttcttgcactcttgcatatgcgccatcctgaaccattgctcattgtttctagtcttcataggtagtagcatgccagccagaagagcacacatggaggatgggatctgtccagtaaacaaaaggaggagattggcgctcagcccatgtgctgaagtatataacagcaagcggataagatcacaatgggttgattttcaatctctccctgaggtatgtacgttaaacttaggatcaactctactaaatgtgctttagggactgcctgatgttttgtccacactcatcaccaggacattctgtcaaggataatgtcaaaactaacattgaagcaagctgttcagatgagcatggtatcgagtgtgttcagaagagcttggattttccatcctgatcttctttttggcactgaagaattgtttggaacttctgatcgacagttgagagcgctgagcaccaatgggtttattgacacaatcaattttatcttgaggaaacacagtggtctaggagtgagtgattttggtgtgaagtttgagctgtggaaggagcatgcacgtgacattgatggatgggtttcctttgctattgcatcgaaagcaagggttctcgtcctgaacttttctccatatataggattgcgagaaaacagttacagctttccatgtcatcttttcaatgacagaaatggatcccactttaaggttcttcaacttgatactgttacttttggcccaactcctgacttttgtggctttgctaatcttacaatgcttactttgaagcatgtgcttgtattggacaacttccagtacttcttaccgaaatgccctgccctagaatggttggaaatcctaatgtgctcccagctacataatttgcatgtttctgaaccattgccgcggctggaatttttgcgtgtacaaggttgtgcgattaacaagattgagctccatgcccccaaactcaccacatttgagtatagaggttgttttaaagtgattattgcacttcacaaatgcttgaagcttaagactgcaagcattgcgtctcatattgaggacaaccttgagtatgttttcactgggcttccaaatggattacctcatgttgagagactacatgtgaaagtgtttgtgaggactcaggtaccttaatcccaatgcataccctccaaaatcttcaatcaagtatgtgtgtgggtgtgtgtgtgtgtgtatttgtttcagaatttccttggcgtctttcagatacctggatttacacagccccctcttaaatttatcaatttaaggcatctgatcatgaggataacctttggaagtgctaaacgttttggaaaaaacgcagttctgcagctagcatatcttttggaagctgctcctttgttagtggaccttcatttggatgtgagttattatgccatctgcaccttcatcctgtttgtagttttaaatactctgtaatctcatttttatacttaactcctgtctaatgtgcccacacttgctttatatgtctatttaattttaagtattgccttgagtcaaaattttgatactggaactgtgggggcaggccagcctattagaccacataaatctcaaagtggccatgagctgaaacacagcaacataatactactagctagtatgcgactattggcacaaaacacataataattcatactctatactattctaaaagagggcaatgccggtggtagtgaatttaccacccaccaactctattatatattgttgtactttaatattaatattacaaaatagccctatatattggttctatcttatttcaaatctaaaataaaatttcttccaaacaatattatcatgcggatataattcatatttattttagctagttatcttgaattccattgaaggtttgtacaagatatgtacttaaatcaataacaatccatagttttaccttgttgagtatcttgattgtgaagtggctttaaggagcaatcttgcttggtagttaattatagagtaaatttcagaagactgcacttttattgactaaactatcactttgctgcaacctttgcgacacttttcaaaaaactgcaacattagcattgaaaattatcacatagctgcatttttttcaggattccctgtaactgacattccgggcccacatgtcatacatatatgctcgagagagggaggaacggagcggcacgtcagcatgccacctcatggctttttttactggagcgatgccatgtcagtgcgtgttcgggcggaaaaaatcgaggtccagctgcaccatttggctcggtcaagggcacaggcc

SEQ ID NO: 10474 - DNA, 3635 bp, Oryza sativa
cccggaatgtcagtaacagggaatcccgaaaaaaatgcagctatgtgataatttctaacgctaatgttgcagttttctaaaaagtggcgcaaaggttgcagcaaagtgatagtttagtcaataaaagtgcagttttctgaaatttactcttaattatatgcacttgctttagcttgtggggggctattgcatatctgccactagctagtgaagattttgtgcacttggttgtcatgctattgatttgtttgtattgacagaaggtgacatataattttgtgtgcagatgacgtgtgcagatatttgtgaggacccccctgctagggacgtgattatacatcgcccctactacaatctcaagagagcttgcatgaccggatttaatggtaatggaggtcaaattgccctagtaagatttatcctcaggaatgcagtaaaattggagaaaatgactatagttccaaaagggagaagaacgggcaaaatgatgggagaatacgaattaagccttagaatgatcaggaaaaaaattgttccaaaagacaagaacggtgtactcgtaattttgtagtaattctcaagttatgtatgtactattataggaagggctggacttacatgcccttgtactttttcagaaacaataataatagtgcatctttttataattttatttatgtgatggagcatttgcttagtatactaccgcagtagaagctagtgatggacgacttcgatctagatggtgatgtggaattttgctacttgggcatacttgcaggtagggtgcatgttgttgctccagtagatcacctccttgaatttagttttttttcttttaaaaaaagtcgttctataatttcaagacatttaacatagcaacctgcagatagtacaagccacaaaggccacaaaaaacaacaatcacaggtaacaaaataattatataaaaaattgaagatcgatcgtgttcttttcacgtacgctagttggtgtggttgcctcgtgattgacgattgagcttgaccaacaaggcagaacacagaccatgcaaccgaccatttaaatagatagccagccagtaacatgtactcctctgaccgtcccataaaaaacgaatctagaatcagatgtgatattctagtacgattaatctaaatatatatatatatctatgtatgtatatgtgtccagatttgtagtattaagatgtgtcacatttggtaactagattgattttttatgagacggaggaagtactacttttttactaatcgatacataaatatacattagttcgtctcacgttcaattagctaaccacctaaaactcaaggtaggctaaacacagtggcggaactgagagggggggggtgggggctggcaggggccatggcccctcccaataaaaagaatttttttattactcctatatatggtgcccaggtccaacaggccaccgtatgtcccaattcagttcggctggcccatagcagcgatttcaatacagtgaagactcatgccgtgaagtttaaatgaacatgactggctcgtagcagcgatttcaatacagtgaagactcgtgccgtgaagtttaaatgaacatgtaagtatattgcccacttttgcaaactattcgcttttatgtattgccaatgcatgaaaaaaagagaggagaaattaccaattttttgaactgtcaaaagccagctggccccctttgatttttttgtccagctccgccactggctaaacatgaagtagtaaacaagtcgattgataagattagtcaggccttaggtctagtatataaaaccccactcattggccagggaagcggtagaccaagcaacggtgatttgttaaatatgtttcaaaggtaaccgataggtttttcaactcgattttggcaccattccatccatttccaccaccactaaaaaaattgatgaataaattctccattcaatttgtgccttcttctcctaagaaaaatccctggaaaagaaaaaaaaaagaagaaaaagacatggctataaaaaaatattttgctcttccaaaatatggagcaacatgaaaaaaaaagaaagaaaatagccatgccccctctacaattatgaagcataaaattgaagaaggtatatacaaaggagaaacattttctttatttttcattctttccacatatcatacactttccacccaaaaatgtgcaatatttgatccaagagtatgatcgactatctttttgagtccatatatttggttttgcaatatatatgatgcaggtgtgttccgaattattcctactaaactccacatacacatcctttagaatagggaataatttcggcaaaatatgccttggtgaggatccaccgatgttgcaaaaaatttgagtgatcgagggcaagtcattttgaggagaaaaagctgattttcaaaaatttataaaaccccaaaagtctgatatagattatgaggaggactaaattcacggctattccatttaccaatcacccaagatggtaagatagccaccgctgaagttcacatgtatgagaatagttatgaataatttatgtgcttgtattatatcttggagaaatttattttgaactttagctctaacctttactcagggacgagcaaagagataagtgtgggggggttttgttggcggctattaaatgccaattctatgtcgccaatacctacataaacagaaagaataaaaatccaacatagtgattaggtttgattctaacatattctacgagtgttggtgtatatgtgcatacaggtaataaaccgctgaagttgggatgaaaatcggacctaagtggtaaaccgctgaagttgggatgaaaatcagacctaagtggaggtgaaatcctatccatacaacaagtgggccaaaaactacacaaaacatcaacaaatgggccttccactcgaagaaatagataagggaggctgaggaggagcaacaggctaaaaagtgggcctgttgggctagaccactcccgcagccatctgatttggggtttggcagggacagtccagatgattccctgatggcgtttggatgatagaatggatatttcgccttctcccaaccgtcatacctgccctacataaagacttcacctcttcacttcactcacacactccaagcttgagctgaattataagagactctattgtactttattatactatattagggagagagtagagtagaagaagtcggaggagttccgaagttgtcggtaatcctcttcttacttcttttgctatgttaattactctgattataatagaaatatcttttgagtaatttagttatgcttggtgagaattatcacttggttagttcctaatcagcgtgcgggatcatcgttcactataatcaagtaaaatatagtgattgctttagtttgtagctaacattaaagtaagttattaattacttagacgcggtgtctaggtagttgattttcggtgtttactccgtatcacacaataggtgtgtggtgagtgtagaggtggtgacagccctcaagatcacttaagtcctccctgtccgggtacgtagtagagcgatatctgggagcagcgagctggccagtacc

SEQ ID NO: 10475 - DNA, 758 bp, Oryza sativa
atcattgcccctagtgtcgtgaggttgggcatttggtgaatgattgccccggtggtaagcctcctaagacatgcatgtttgattctcattatatgcttaggaaggctcatgatggtagcattgttcctagatatgtgggttcccctatactcggtggtaaaaagaatgacatttgggtgcccaaagctttggtctctaacctccaaggacccaaataagtttgggtacctaaaagagcttgatcttcttttgtaggtgaactaccacaccggtgggagccattgggtgcttgatagtggatgcactcaacacatgaccggtgatagggctatgttcaccacatttgaggtaggaaggaatgaacaagagaaagtgacatttggagacaatagcaaaggaaaggtaattgggttaggtaaaattgctatctccaatgatttgtcaattgataatgtctctcttgttaaatctctaaatttcaatttgctttcggttgctcaaatttgtgatcttagcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttggctttggcatagaaggctagcccatgttggcatgaatcaattgagcaaattttcaaaacgtgatctagttatgggcttgaa

SEQ ID NO: 10476 - DNA, 419 bp, Oryza sativa
gtgatcttcgatgagattccacgtgtgcgcaaaccctctgccgagatcaatgtcctggagctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgt

SEQ ID NO: 10477 - DNA, 16253 bp, Oryza sativa
  unsure (1)..(16253): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaaatggatgtgaaaagtgcttttctgaatggagttattgaggaagaggtctatgtcaaacaacctcctggttttgaaaatctaaaatttccaaatcatgtgttcaaacttgataaagctctttatggtttaaaacaagctcccagagcctggtatgaaagattgaaaacctttttgcttcaaaatggttttgaaatgggggcagttgataaaactctttactcttcatagtggcattgattttcttcttgtcgagatatatgttgatgacatcatatttggtggctcctctcatgcacttgttgcccagttttctgatgtgatgagcagggaattcgaaatgagcatgatgggagagctgactttcttccttggacttcaaattaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagtatgattggctccctcctctacttgactgcgtcaaggccggacatccacttctctgtgtgcctgtgcgcgaggttccaggctttttcaagaacatcacatcgccaagcagtcaagcgcatctttcgctacatcaagtctacacttgagtacggtatttggtactcctgctcttctgcctttcagttcgagctttttcagatgctgaatttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtttttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgttttatacactcttcaattgagctttgcttgttatctcttggtcatcactatgctatgcatgtatcactcttatgctagtttgatctcttgtctagctttcatttgcttaagtagcttgtgtgatcatgttatgctgttcaagcttgttgaaacctgcttaaattgactattcatttgaacttaatcaatgtgcaatgcttgctctagaagtttgtttaaattgaagtatccctctcatactcatgccatgtttacattctttttgcaataactgtcagtacatgcttatgaatgctcatgcttatgcgtccatactttgtatcaatcatgctttacaagctttatctctgtttttgtccgggctactgagtgcgtttacgcatgagtagtgccgaagatagcactgagacagcctgtaatctgaactctagctggaaaacttgattgaggtcagacggcagtgtttggcacaaccatcacttgctgactgataagatcaggtggaccgtcgtgattgtgctattgtctttaaagaaattaaaaaaaaatcttaaatataaaagtcatgagaaaagattaaaaactcatgttctatgctttgttatcatgttgatactctttatgaactgggcattagcacattagcatgggttcattgctttgattatgtaaatcttgcatgattatgagctggtttgcttccttttaagcttcttctagaaatagctttgcacactaaatcactaattcacttgaaaactttttgcttgctggcgatactaacttgatatccatgacatgtttcatacttcttatgcacatgcttagctaggcttgagcacatgcttgtatctgtgtgatccatgtctaccttttgatgcctttagataactctcaaagctctcaaaacactaaaatttgtaagtttcatctcatttttatcttgcatttttgtctcttttgatcttgatggcatcattgacaaagggggagagaaatttgcacttattaaaacttgctttagatcttggtgaaagggggagtttggcacatagggggagcattcttgcatttgcattcgcatcccttttcttcttgtcacttcacttggtcttgatttttcacgatttcaaaatgaccaaagttcgacgtttgcaaaatggtttactttgtgaatcaaaaatcaaattttcaaaatttttgcttgggattgtcaatgttcccatcaagggggagattgtgaaaccatgtgtggttatagttcttttgtgatgggaaattgacaagtactggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacgaacaccgtgtgaggaggtcttcgcaacggacttcgcaaggtcaagtgcaagtgccgggttcgcgaacagaatggagaatggaagaggagcttgtatacatgcactggcatgtgcatatgcaagcatggacagtggtgcttcggttgtgcatgcgtgcacatggccgaatgccatgcacgggggcaagacatgcatgtgtgcatgaggagcttgctagcccattggtgcatgtgagctgtgattggttggcagggaggccaagccaatccagcccttcctcgtggctcaagatgatggatggatcagcaggcagggaggccaggccgagcaggcccaagacaagacgacggcccacggcattggcaccatgcgcgggcaagcgcgggagatcgcgcgaggcacgcgcgcgcagtggacacgcggcggcaaggaattcggcgctgtttcaagtggctcggaggcgggagttgtactgggacccacgcgcgatttcgcgagcatgcgcgggagcagctcggcgggacgcgtggaggctttggactggatgcgcgcaggtgagcgtgggatccacgcggtggagcgcgcgctctcgcgtgctgaggcgtgacgtggcggctcgtcactggtttggagagggagcacgcggatcagtgcggcgtggagagtttggatcaacgatgtggcaagcatccaggaggcttccttcggttctaaggaagaatgggtggaccagatccattctgagttagggtttcgccctaggggtatttgagacaatgtcttaggggtcttagcctataaatagagagatggatgcaagggtggaggttgcttctttggcaatccttttgagatgctcggtgagagagtttcagtgtgagtttggagtgagtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctcttcctcacctctcttctagtttcgggaattcattttctcttcctcctctagtttcgggaattccttctctcttctttttctctcttcttttctagatccggcttctctaatagccgcggttctagtaaggattttgagaaatccggcttgatgagtattttcgggggcaagatttgaattgctatattcagaatcctcaccggatttgctatgatcatgctccaattttttggttttatactcgaaggcatcaggctctcgagtgcttgtcctgtttgtttcttagacttgagttcctggtgcctccatttcctacaccgattagtactaaaataccctccatgtctttctactaccgttatatatatggccaagacctttttaagatactgcatcgcatctctatttatagggatagagttcttttacgatacaccatactagtttgtaaagacccaccatgcagggtcttatggccataaggtacagtagtatatgggaaatctagacgttcatttgtacaggtaaacccaccatgccgtccttccctgccgcacgttggtttgcgaagaacccttaagaattatgtagggattactggttgtatgtacatccctagttggtagattactcactaagaattatgcatggatgtatggtgtgttgcgtgagttgtgttttgggtactatttctgcacaaggtttgggaactacgtagttggtgtcccgtagcataatgtgtactacctccgtttcagcttataagacgctttgactttggtcaagtttgactaagtttataaaaaaatatattttcaacccaagataaatttattatgaaaatatattcaattattattgatttaatgaaactaatttggtattataaatattcttatatttgtttataaacttagtcaaacttaaagtggtttgactttgacctaagtcaaaacgtcttataacctgaaacagatggagtacttctcaagagaagcaatgttctctttctgtatagaaaaaacaaaataatacctattcaacatacaacagttttgggtgaaaagcttttaaaaataattatagtataattgaagtgtaatctgcatgcgaccccggctagcacaacataggtcaggagtttgaccctgcctcgcttgcgagctgtgtaaaaactattttccctctcgcatgaatcatgaggcaatccgacggtcacttataaaaaaaaaaagggaacattttttagcaattcccaaaaaagcacacatagagtgtttacaatctattagattaactatagataaattggagctagtagttggctatactattaaacttgctctaggaatcttgtggtggcaggtatgcatttccagtgcctcgtcttcctacaaacctactagtttattgtctagcttacatcgagagccaaacctacaacaaattctcatgcattggccagcctcttctagcaattcagctgacagcttcagttctctaacgatactaaaaggagctttttgttcctagctaattaggccaacaccatgcacaagcatgaagaccttgttatatagtatcacattgagtatttaagttagggccaggtatgtgcactacatacatgttcttgatctgatgacataagtatgcataatcaatacagcccaatgcatgtaagagtaaggctaataatacagccgacctgttggctataaggttctttgcagccttctcttagcctatctatataatagttagctctttataattaatacagggcccacttgtctctttcacagatttttttggttcttgtgtctaagccggctgtaagtttacagcccgtttctcctctctctcctctcttttctcctccacctcagcatttagccagcttatagcctactattatacttgctctaaggtggatagaattattacatggacatgctgctaccaatatccactcatcattcatgtctgttaatttaccacctgatagcatatagtatatagcaacccttttacatacgtaaagcattacaacgttagagatggggctagatactggtggagaaaggggctttactcctggttcgtaaccccccttagtcccgatttttaaaccgagactaccaatccgggactaaagatagaaaagatcactatctttagtcccgggtgaaaaaaccgggactaaagatagagataaggtcagtggaggaagaggtgaagagataaggttgcccgtctcctcctcctcgatctcgcagatggcagatgcctcgtactctccgccacgatcttttgttccggttggtattaccaaccgggacttttttgttcccggttggtaacactaactgggactaaaaatagatctttttttccggttggtgttaccaaccgggactaaaaatagatcaccaaccgggactaaagattaaaaagcagctctaaacttttgaaccgggactaaagataatctttaatcccggtttttattgcaaccgggactattgtggattttggctaaccgagcaaagatagtttctccaccagtgagataatggcttgaatcactgagttagggttgatggcttgatgcgtttcttatatttgatagattttggtcgatatgttctgatgctcaaaggtgttggcttgcggaaaatgtgagtacattaactagcgtttaactgaaccagcaaagcctgcttctggctcttctaacattttctggcacactgtgatgtgagtatatatatatttgcacatctgtatttctggatatttcgataaaaaaaaagacgagatttggagggagagacgtccctccaaatattatttaagaagaaattatgagcgtgttggggattgaacattggaccttgagattgaaatcacccacccgttgccactgcattatcaattacatctctttatgttttgctactgaacatagaactggtttctgtataaatttcagatccacggcagtatttgttttctgacatacacggtctagagttgaattcaattggatccatttatttgaaatcagtcctaagttttcctagaagtcttaacagctttaaaagatcatgtcaccaattttttcccctactattcttaacatttcttcatagcgccttggcgatacataattgttatcaaattcagagataccattaaatttgattcagagaaactattttatttgctgtagatatgtcaaagcgtgatgtgagacatcactcatccaattataagtcctccgtccgagcacaatgggagataccaaataacatatgaaaatgcagaaaactaaaccaccttgccgccttgttcattctcctctttaccttttctttgctcgtttgcactaaaatgtgtattgttgggaaaaacgtatttaagctcccctattgccttcactcgttgtaaaacacggacatttagctagcatataaaagaattgacatccactactacgaaacaaacttacgctggtagtcaaaattaatttttgcagacggccaaacaattggccagagaaaatatgcgatcttcataggcggagatttgacaaaaataaaattgattttcacatgcggctaggttgagctgaactcctatgcaaattgattttcttatgcggcaaggtttagccaaccactaaaaaagatgattttttggcaaaaaaaaaagaaaagaaaagaagaaacaaatcgccaaatcttcttttttgcctgcaatttttccaaaaccacaaatttcttaaactctggaccagggaaatcgccaactaaatttgaaaatgaacttccttaaaaaaaattgaaaatgaacatgaacatcatcagtggcaacagagcatcaacatcagcagatcactcagaacaagactgcaaacatcaacaggggtctcatcgttatggtagcactcattgctcctgttgtaaagatatttaattatttgccactcttacaagtggtagtttagaatttattagacctatatgccatagacatatgaagttccacatatcgtacactgcgagtgacaaaattttgattgtcacaaattaaaagtgataaatagttaaatgccctgttctaatagtaaccctagtcgcaggaagacgaatgaagctagcacaatgcggctgccaagggtggagacaacgtgggggcggggaggtctttagacccccctacctcctaatagatcattagagtccccataatacccccttagattaattctaatccatatatttatagatgagagactaatatagattttgtttgaggttgttagaaggcttaaaaggctaagaagtcccaataattcctaacccaaccctaaatctatcttagttgcttttagtcattttggtttagcctctgctataattttaacctgcctccgccactggcggctgctagagaaggaattaaatttgaaagtatactatttatttatttttttcataaatatccgagatgtaaaatttttagcataaatatatcgtcgtcgctgattgaaagagcgaaatcgaaacgatatcgctaacccgttaagcgaaaatgacgacaacgtgacactttgtcacggtctcgcagaatcatggcgcgattccgccggatccgccacggtatcgcaacagtaggtcgcgagaccggcggtctcgcttcatcaccttgcgagatggcctgatatgactcatgatcagtggacgattaacgggtgattaacgattaattaattactaataatgttagttaaaggagtaatagtaattaattaattgctaattacactaattaatttattgatagcgagagtacgcgggttaggtaagcgaagtcgcggtgcgagaccgagcggtttcacgcacacctcgcgcgacgtcgtgcatagtaacgcacgattttacgctttcatttcacgacaatggtatatttctgtaaatatttttctaaatgagcgtatttatacaaaaccaatgaaaaagaggtatattttcaaatttagcgaaaggacagatctgttagaggttacatgggattgcttttaccactattccacacagtcactgcaacttgggaactaatgcttccagttaagagaaacatggcaggtggcaatgtggcatgcagaaatctgtgcagtggacagtccacctcgataccgtgactccccatggtagaatcctcaccagatttgctataagcacgctccaaatttttggttttctattcgatggcactaggatttcgagtgcgcagcctgattgtttcttagacttgagttcctggtgcctccatttcttataggtacgctgattagtgctgaaatatatattctccatgtctttctaataccgttatatgatcgagaccttttaagatattccattgtatctctgtagtggtaacacctttgataaatcctagccattgattatttatgtgctttctaattaaaatacatgtggcccattcaaataataaatgacagcaaacacaaaaggaacaggaacagtgggcaacagcatgcggccggcaagtttggtgtacaatccattttatattttatatattaagttttttttactgtgcaacagcttggttgggtactaaatcaggtccgttcataggccacgatctaatgacggcaattgaccggtaccaccaggtaccgttaactctgttatgcggtaccaaccaaaggaaagaaggtgggaggataaaatcgtattttcgtgatgtaaatgagccattgtcatcttatgcactttcttttcagtcgaggattcgaaactcaaaccctagttttgtaatgtcaaatcgctgaggtgcccaaagccggaggtgagcaatcgatggctgcataggggtttgtgctcctggagacccttatagtggcagtggtggcggcgatggtgctcttggagcccctcgttgcaggaggagtggtgctccaggagttttccgtagagacggcgacggcactcccggagttgtccgcaacgatggcggttaccccatcgtcgacgtccgtggtagtggagagtttgggtagtagtcagcgatgcggtgagcgtgtgagggggaaaacgattgtggtggtgtcaaacttggggtgcgatggaggaatatcgcgcgttggggtagaagattgcatgagacttacttacttctcacccgattataccctcccagattccatgcccatattaagttcggtacctaggggtaaagacttcctcaaatgtacaaaattattgcccactatacttgggtttcatcattcttgtcatcttgtgggaaccatgcgcgcatgcattaaatggataaacttaaggacacttctttgaatgttacttatttatagtggatctaaagtctatgtgcaataaaaaatacctatgttgtttgtcacgagaacttaaaacaatggcgtttgcaattaacccatgatctgtcgtgcccgtttatgacaactgtaaatcttacctgaatattcatttcttaaaaaactatccgatgtgttcatctgtttttcttgttggatgaccgaattatagtaactatttttttatggaaattacagcgggtgttgacaccagcctaaacttttattaataatggtaaaagcatttacatgagaagggttacatgggaaaggggggggtgctgaaattatgggttaattacagagagattcagcgaccaagtatggagctgttgtttgcaatcaagagaccacaattcaatttggggttaataaatattaaactggacaacatgttcgattagaagtcatctagagaccacaattcaatttggaggacctcagttggagagtacatttgagcattaggtgaaactgcagctagggcactcagctcctccgcggcctaccatgagtgtgagttccgcatactgaaatcagctttccgctggaacgatacggcagacatcgccggcgatgcagccatcgtggagtttttggctttgtcttggaaggaatgagcacttggaaacctgatttctgtctagatttgagttcctggtgcctctcctttccctacaccaattaatagtgttataccatccatgttttgcacttttgctactaccgttgtagaacatgagcttgccgagatgtgttatttatccctaggatatatgtagcggagatatgcatttacgcgtatgctatattatggcattctaacatttcgtacaagaagatttggtatattgtctaatgctaacaccaactttttagggtggtttaaaaatgattggtaatgaatagaagttgattttgttttgcatttcaaatatatggtcctattcataaaaggtgggcaaactaatacgtccaagtagtgaaagtttgcgagagtgtcaatttagtaacttgtgatggtttcataatgagtgttaaagagatcattttctctagttttgcacacatactaaaatcatattcatgtgcatttggtgacatctggattcattgtattggaagcttttggagactgtgatttgaaaatttgtcgctagagatgccgtgagtaacacaactacacacaagcaagtgatcaggatgtggttcgctgtcttaggctctgagccacacattagtcacattgagtggccatctagacctcaccagccgcttcgccgtccaacattggccattgaaggctagccaaaagtagaacttgcaattcgctggtgcctaggttcgccatagttgcttccagtggtggaaggtttgcaacccaagtagtaagaaattaagcctcgtatgtcaggccggcatagtactgaaggtcacttgtccagcgccagatcagtcagatcctctttgctttggctgaggatcaccgcttcgactagcgaccagacatggagatattgagaaatccatcgtttagatatacggagtatcaagttacaacattaggtaatgtattgtttggttatcatacttgtgaaggagatgcatgaccatcttgccatgaggatcagcaatacttaaattttagttccctttgcctccctttcctattgcacttcatcagttcaccgtgaaatacaagacattggttatactagcagagctacaatgctcatgagctcaccctgctgctgtctttcccttgtactggacattttggcacacgttgtgcgccctaccagatagcaactgtgtgtaataattaaacccaaacaaatcaattcattttatttaatttgtgtgtcaaaataaaaatgtgtcgaaagtaactatacaaaattaatatcccataggcaaaaaaaataagtatcaagtatatagagcacaccagattgcttaaaatatttttgctagtcactaagcaaagaaaaactttaatctattggaagttccaatttccagataaatttgtaggggaagacattatttacttttaaagcattataacgagagcgggcagtgaagatacagattttacaaatggggacaatttcgttcgtgcccctacttttatcttcagtattgattctgctcccgttttttagggttttcgtttttaccctcgtttttttaaaaacgaaacgacatattgcccctactttggatggacaaattaatgatgatgagtatttgataaaaggacatttatacccttacttcatttcttgttgcacattcactagtacacaaaagatttttccgtgtggaggctccgctcgtctgcacccaggtgtctgcgaaaatctatattttcgtgtgctagcggcccaaccttacgggataatccatctttccgtgcggtcgggttaagtggatcacatgggataatcgaattaccctgtgcaatcaaattatactgctcgcacgcaaaaaaaaggaataaataaataaaatcgaaaaccctaaccctaaccatagaatcgcccgctgctgccgctcatggtcaccgtcgtcctcgcgtcgtcactgtggtcgcgccgccaccgctcccgtcgttgtcgtcgtggtcatgccatcaccactcccggctgccaccgctcatggtcgctgtcatcctcgtcgtcgccgacgtcgtgctgctgccgctccagtcgtcgtgccgccgccgctcccatcgtcgtcgccgtggtcgccaccgccgctcctgagcccgtcgctcttggctgctgccgctcctgagcccacctccgccgcgaccgtctgccgtcgccgctcttgggcgcctccttctcctcgtcgtcgtcggtgcgacacggatccggccggtcgcccgcgcgcgcctcttgctctgcgagccgggtgcctcccgtgccctgtgtgcttggtggggaggggaggagctagaggagaggagaggaaaggcagagagagagatgagtgattgagggagaataaaagggaaaaaggaagagagaagatgaaaaatgtgaagtgagtgagagggaaaagagggagtgctatttgttggcaactttttttggccagaagacaattacgatcgggacacctaaacgccttgtggtgataaggagtcgccattcacccgatctagccaaacggccaaatcaagatgggttttgtagaaaacgactaaacctactagcgaagccgatttagagattaaaatcagcctctaggctgatttagatcaatatgaggataactactcgtcttgtgggcaaacggaaggtttatgggacaaacctacaaagaggtaatcgcattctcgcagcgacggcggacgatttacggcgcaaactgacgaagatggactaaaactagaagaaagtagaaaacatggctaaaagtaaagataaaagaacaattcgattgtgttcgggggagagagagatctcaatcgaaccggacttgtcccttaaataggggttggtcttgcctcctacaagtcatcctccacgtccaactcgagatagaaaccaatagaaacccgaaacataccttcccaagcaaggaaacccgagacctgatgaaaacagactcaggctcgcactcttccagtctgaccagccacacaccaccggtcagaccggccatcaagcaacggtctaagcagccaacatacggcggtcaaacaggccttgtggaggaaaatgacgatttttccaaatattggcaataattccttaatttgaacctaggtgtcaaatttgggtgtaaacagtattttcgcgtgcggtactgcggtccacttaagaggcctgcacgcaaaaattaattttcgcgtgcgggcctcttaagagtccgcatgtgaaaataggagcccaatttttacagacgcacacgaaaacggcccttctgggaaaattggagctccttgtccaggaaaatattttgtgtactggtgatttctccctcattttgtacatatagcatggaacttgagtttttttttgaaggttcaaatataagaatttggaccgaatgtcaataatattgaataaatttggacagattcaaaatgaatcatgaggcaatccgatggtcacttatgaaaaaaaaaaccagggaacgttttctagcaattcggaaaaacgcacacatagagtgtttacattggggaattggttgcacatccaatctaaataaatcgataaaaaattccaaattaataacgccctcatgaatgacaaagaagcaacatctcgctcctggcacaatgtttcatgaatgtcggataaaaaacagatttgctgtcaaccacattgtagaaaacagcgccaaagttgtcgagaatatgtaagtagtcccaggaacaaacattggtgtacgacctcctctgcttcgacgttgcttcgtgtaatcttgcacattgtatgaatcctctggtggcaggtatgcattcctagtgcctcctcttcatacaaacctactactttattgtctaggttacatcaagagccaaacctacaactaattctcatcattggccagcctcttatagcaatttagctgatgctatagcttgttgtgcaaaggtcgggattctattccattacctaaaaaggagcaattcaactgacaacttcagttctctaatgatactaaaaggagctttttgttcctgactttaggccaacaccatgcacaagcatgacgaccttcttatatagtatcacattgagtatttaagtttgggccaggtatgtacactacatgttcttgatctgatgacatagtatgcataatcaattaaaagcacatgtaaagtggatagagttattacatggagatgctgctaccaatatacactcatcattcatgtccgttaatttaccaccttatagcataccaacccttagagcacccgtaatggtaaagtaatgtgctatctataaaacatgtacatctcagcaatagactagattaatagtataccacctcaatagtatatctacacatgggtatctatagctctctaatccattgcctcgtttttctctatagactatttccaggttagtagatagctttgctctctctcttcatttaatctctttcaagtaggaaaatatgctgacatgaatctcttgtagagagcctatagataactattgtgggtgcccttagcatacttaaagtagtactacagcgttggagatggggctagagaattaatggtttgaatcaccgagtttttttttttttgagaagatgcatctcacactcaattaatcttgattgtaattcttacagccacaattgaagtaatactccgtacaatcttgagcaactgaaagccaggtagaaaaactactcaaagacattcctgcctgagctaatctatgagcaattttattcactgatctcctaacccgaacgacactaaagctattgaaaggactcagcttcaatttcagatcttgtaccagatccataaatcgatctactaacttccttctgagcaaccatcctcgttacttccaaagaaccaggctcaataattaaggtagatactcccaactaatgcaagatcagccgatcctgctacaagctagtaattccaaggtggtagcggcctgaatacttgggatgatactgtgctactgccggcataaaacctcactgtcatttcgcatgaccacctcactgct

SEQ ID NO: 10478 - DNA, 9405 bp, Oryza sativa
cagcagtccatcacttgtgataacaacctttaaatgctccggttttatggcccttattgcaattgcaagaaacacggtgagcaagacatgacagtcgtgtgaattataaccagataccgagaaatctttcatggaaactagtcgactgttgtttgatgagaaacctatgggcactctgacatcacggagtgacttgcaaaatgacttcttctcctcagatgtcagtgtgaaacaggctggtggaagatatactttgccattcttctctccttcttgagggtgtaactcttcctgattcccatctcgactaggtgatggggctagagaattaatggtttgaatcaccgagtttttttttttttgagaagatgcatctcacactcaattaatcttgattgtaattcttacagccacaattgaagtaatactccgtacaatcttgagcaactgaaagccaggtagaaaaactactcaaagacattcctgcctgagctaatctatgagcaattttattcactgatctcctaacccgaacgacactaaagctattgaaaggactcagcttcaatttcagatcttgtaccagatccataaatcgatctactaacttccttctgagcaaccatcctcgttacttccaaagaaccagtctcaataattagtttagatactcccaactaatgcaagatcagccatcctgctacaagctagtaattccaaggtggtagcgtcctgaatacttgggatgatactgtgctactgccgccataaaacctccactgtcatttcgcatgaccacctccactgctctaaacttgtgtgccatcacaaaagcccaatcagtatttgccttcacccagctgatcggtggtcttcgccaagtttgtgctgaattgtgaacagggccattgttcctggatggcaagttccatggccaaaccattctggatcaatctccagcaatgtaccttcattttatttggaacacttcattttattctggagtctcttgttacggtgagtctggtgaaggcttgtcgggacggctcgatgtgagcggcaaaaaaggatcaactcaagtcttggtacacgaaggttcgagcaagtaacagattcggattggcgtggcatattcgccaaggtggagtttgttagagtttgtgtcgaatatatgtacgtagtcggttacagtttaggacttggagttgtactaggtgtaggactagagtatgagtcggactctatcctaggatctcttataaatagaggtgcgtgtctgttgtaaccgcatggcgacataccatagcgagagtgagcggctgccggcggcgaccggccgtatgtcgttgtaactctgatacgctgtatatgctggatcggggaggagcacccgtaatcagtgccctggagatgtaggcctcggctgaactccgttatcaaatatcgtgcctcggtgtcgtcatcatatttggatctcctatggcgttttcttccgcgtttagctaccgatgtcgatttcggggctggtttttataacaagtggtatcagagcctgcgggagatccaagatagaggtacgaaagaggtgctccacaccgcgacgactacacaggatatccacggacggacatggacgcaaggtggagcacggtggcgatcaacggaatttgatcaatggaatcggacacttcagacagcggtctgaactgttcgatggctgtaatcaacaaggagatgaccagacgtggtgctcgggttgatggcggccgaagcgattggcgatccaattggtgggtcggacacttcgagcgggtggctcggactttctggtgagctactctcaacagggagacgtggggccccacgctcgggttgattgaagctggaggtgatcggcgttctcagtcggtgggtcgaacactctgggcggggtggcccgggcctttcgatgagctgcgttcaacagggagatggctagacatagcactcgggtcgtttggcggctaggaagacggcatgtgatttgtcggcttcggctcacgactagattgatgggtgatcaatcggaagtcggggcgggttgcgggctcgaggtggagcagcaacagtggcgacgaacttcgggcggcaggaacacggcttggtgtagtcgtcgtataggtgccgacgagattcgacgcggaccggctccggtgtttggagggggcaatgacggcaactgctacagaaggaccggcgctcagggagaagcgtgcggtatggctgcggcagcaaagtcgtgaggctcgacacgcacaatagcagggcgcacaacagaccaagctgggtagcagagtctaacagggacttgggtttggcttggttttcttcaacacaagaagcaaggtgcataggaagtatcgtgtagctggctgcatgtacatgggaacttgagccaaaattggagagacggtcaacatgcatagattattggaggaaagcatgcatgttgcatgcatgcaggatcaaatcaagcatgtgttggtgttgcaatccaaaagggagctcaggagtccggataggatgcagggacacggtacgtgtatgcatggataccgaaaaaattagcaggttgagaggaggagtccgtggtagagttgtattcgtaattgaactttggcggctcatgacatctcaacggctggaggctcggtgaagcttgaggttgaagggaggcgcgggtgctatatatgtgtaggaagactggttgatatatataatcagggtaaatcaatttccccggcaacagcgggtgaaaatcgttgagggcgtcaacgggttgtctggcagtacaggatatatccaggatctgcgggaattgcatgatagggatatatgaaatctgcgtcactgaaggagaagagtaaacgctatagtggtaatttcttcagatgattcaaagcaacggtgattttctcaaactattaggaattcagtctacggatgcgggaaagcgtggatgttggatttattagctcggttcataagaggacaaggaagaaaaggttctcttcaagtttggtgagtttgatttatctatttggtgatgacatcggttatctggccatggattagatcaagtcaaatttaaaacggtagatggaggtgaacatggtcttcgggaagtctatgatgtgacagctaggaaggatccaatttcacttggcaagacgactgtggtgatatgagagaaggtggagcactgttgcaggtggagtcaagaggaagaaattacagggatagcgggagtctcttgttacggtgagtctggtgaagacttatcggggcggctcggcgtgagcggtaaaaaaggatcaactcaagtcttggtacacgaaggttcgagcaagtaacatattcggattggcgtggcatattcgccaaggtggagtttgttagagtttgtgtcgaatatgtgtacgtagtcggttacagtttaggatttggagttgtactatgtgtaggactagagtatgagtcggactcaatcctaggatctctcataaatagaggagcgtgcctgttgtaaccgcatggcgacatagcatagcgagagtgagcggctgccggcggcgaccggccgtgagtcgttgtaactctgatacgctgtatatgctggattggggaggagcacccgtaatcagtgccctggagatgtaggcctcggctgaactccgttatcaaatatcgtgcctcggtgtcgtcatcatatttggatctcctatggcgttttcttccgcgtttagctaccgatgtcgatttcggagctggtttttataacagttgattacaggttgacgcctactggcctactgcgattgcgctctgctgcatatgacaggagcatttcaccaaaaacacccaagactttgtgaattgctaggcaacaaaatcttctccatcatgttcaggtaacggtatattaagcacatcggtggtgtcacactcaaacgaaaaaacagaaactctatcattgtcccattgttttgtgcttgatataaatagttttgatactgtctggtcgcccaccggctccttaaaacctagcggtctctaggagcccacccatgggatcaaattatctcttttaattttgattgatttaccatcggtaatatgccataacaggcccttgctcagcagctctctaccaaaaataatgcttctccacatatacaaagccttccttggacatgtagcttccagaaaggagcaatttttaaaatagagagcctttaatactttggaacacagacactctggacatgtcaaaatcctccacccctgcctagcaagcattgcttgattaaaaatcttgaaatcccgaaaccctatgcctccactctttgatttacataatctttgccaagaaatctatttagtcttcttcttccctgctgtcgcccccactagaaattcctgacaatggtggttaataatttggagcacaaaccttttggcaatctctcatggagtaggttggaactgctaataggactgattttttttacacatcttttcctgcattcgataaaccctgccctttaaaacctgaaacttttgtccacatcctctctctgctattcttgaaggcacccaatttgctgatctcatggtggaccatctgatggctcagcaataagaagacccaggtcttctttagatatagcataaacaaaaaaggggcgtctaaggaatttattttgacaaacagtcaatcacagcttgtctatgaagcattcggtgacatggtaatatttgacagtatatgttgtgtgaactggtacaatattccatttgtaccttttgttgaagctaaccatcattgcaacacaattatttttgggtgtggtattttgtcaaatgagacaatttcttcatatgtttggctgtggcaaactcttttggaggcaatgcaccaaaaacatcgaaagtcattgatcactgacggggatgcatcaacggcgaaggcaattatgaaggttatgcccaatactgataatagattgtgtagttggcacattgaggagaatatgaaacgtcaccttcgttggcaaaagcttgcatacttcaagaaattcctttatgataatatagatgctgatgagtttgacagaagttggattgagtataaagacaagtatagattcactgaaaatgacttatgagctgcatgacatacgaattaaggaagaagtagtccgtagcatatatgaaaaggaaacacttccttggaatgcggagcaaccaacaaagcgagtctttaaactcaaggctgcataggcatcttgatcgaaagatgtcgctagtccatttggttgagaactatgaattttgcttatcacgtatccgtaggaatgaagccaagctggatgcgagagcctcacagtctgtcccattcactagtctacaatatgtgctaacccattagagaaaagtgtggtacacatttacacaccgaccatgttcaagaaggtttgggctgagataaggaagctatataagtgggaaattgtcaatgtgacatgacaagatggagctggtgtgtttactgttgcatcaaaaaacaataatgctctacaggttcatgtggtgtgtaattttgaagagcaatcgacgagtagtgccaattgccattaccaaaagatggagtatgacattatcccgtgctcacgtatttttaccagttcttaaatttcttggtttcagtactgttccccgttattgtgttatgatcaggtacacaatggaagggaaagaaacatttgagtcaaatagaagtatcaacactcgtgtgtggtctgagcaaatggattgctacagtggcctgaaaaacataagtagacttgctttatttatagcctctagatcaactgagcatgcataaaaggtaagagagtttttttcggagtattatggatgaagattcagtgaaccctgataaagagtggccgtttggtcctttgccagcgcacttttctacttttcagctagtaactaaccatacaggaagagagtcctttatcctgaagtgattacatctaaaggtgctccctcatagaagatattgaggccaatcagtgattgcagacaggataaatacatggtttatgttttcataataaattttgccacaatagaagatacttggttccttttgagattaccaacgaagttatctgtaaaattatgggataagttttggtaaaaaagaaagaatggttgacgatgatggcttgaggatacgccatagggaaagctgattatgttattaacctcaggcgatccttccaaatttcaggtgaggccaaccgctgtaataaaaataaagataatgttgtttctccgtgagtgctagggtgggatcatgtttggcttggggctgtttggttcccagccacactttaccattacttgccaacaaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaaccaaacacacccaatcccttgttgttggcacttccttcctcagccagacagacctcatgcttgaaaatcaaacactcaaatggggtcttactagtgttcctccctattttatccctggttgttcttatccatcattgaaatgattagccactgctaaaaattgaactcccaatgcctctctctcctattgtattgctatttccagagtggttatttccatgatctcttggccgatcggtttgtttcttctcctagagttttgtgaattgcgttcctttcgtaacatggaattgaagactcctgctatttattgatagtgtagtcgtggagtggcgggtatgctggcattaactgacaatctgtgtgagacaccaactcatatatgaaatgcagtagattagaatttgtttggtgcattacctaaaattctagaaaacataccaaagtcttctccagagtttttttgggtctctaggaaggtgtgtaaatactggattttatctatgccagtgtaaaaatcacctacatttcttggcaatttttttctataacaatcttttcttttaaaaacatcgtcttaccataaatctggttttacatattgtaatctcgcgcatcgcaacaatcttgtggtggcaggtttgcattcctcgtgcctcctcttcctactgaacggctcctacatggagagtgaaaatctgccgattctcattggcctggctcctcttcctactgaacgtacggttcctacatcgagagtgaaaacatatcactgtactaagtttggatgtgtgcattcgttgtgtggatgtagaggccgggttttaatccatcatcttaaaagaaatgtgagaaaaaccagagtttggaggttaagttaaagcttagtacattggactggagttgaatttccatgtgcaaggagatgcacttgctaggagtatattacagtggcgtctggctttgcatgtagacgtagatatccccatggttccatcatgatctctcagcagttcaaaaacattcagttgaagtgtccaagatgacacgcggtgctctttcctattttatgacgagtggaacatgtttaacggtaaatgcagaacaaataatttaaaaaatataagggtgctagtgaaataacactatagaccaagactaaataatacattaagagtatagatggttcatatatgttttatcatggtgtcattacgagatcaaaactaccggtatgagcttattggtttttccatatcgtcgtgcattaagttcaacttgtttacatgggaaaaaatgttgggtataattgccatttcttgcaaatcaacgaatagataattttggaagctatattagtacaatggtgtagaactaaaaatccacaagcaatcaagctagtgtacatgtaattggcatttggcatacatgaggcctgctaatgggaaggaatccaatccgaatccaacccaccccatctcttttatgcacagctgaccaaaccaacccaatccatttcaccacttcaaactccaacccccacaagatttgggaccaaaccaacccaatccattctcctgaaatgggtcttaatccatttccaatccagggctcaaaccaaagcgcgtgcagtgcaggcttcatctcaagccacagaggtgtttgcgtccatggacatggccacagcgccctcctcgaggcataagaacgaacgggggagaggatgaaggtggagacgtctgtttttctgaactgagttggatgttggctattgactggagtagaatccaattgaatccttggactcaatccattcttgccccaccgttttagttttgcatccaaaaccaaaccgctccaaaccaattagtctatgcactaatcaatcactagtccattgcccccaatccaaagctaaccaaactaaaatccaatccattttatccatttcaatccaatctattggcaggcctaaatgatagcttttattagctaattgggaatccctcctatcactctctaggtgtttacactactacgtaacacattttcccggacgggaatatccatttttccgtgcggtcatttggcccgcctgcacacccctgtctgtgaaaatcagtattttcgcgtgcgggcggaaggaccgcatgggataatcgattatcccgtgcggtcatactgaaccaccgcacggaataaaaaataccaaaaaaaaaaaagaaaaatcgccgtccgcccgctggccgccgcaactcgtcgtcgacatcgtcgtgcccaccgccgcccctcaccgccacgggggacggccgccgccgccggatccgggcgcgtgggggctggttgctgtcggccctcgccgccgcgcccgctcgccaccgccgcctcgccgtgaccgcccagtcgtcgcctcgcgaaagtagggagaggagagccctccctcctcatcgtcgtcatcgtcctcgagcggggaagccctccctcctcgtcgttgttgttgtggtcgccaccgccgctcccgcctcgtcgtcatcgtcgtcgtcgccctcgagcggggaagggtgggagagggacgctgccgccggatccgggcggggacggccgctgctgccggatccgtgcggggacggccgcgagccacccgtcgttgcctgcccgcccgcccgccggatccggcggctacgtgctcccgtcgcccccggggaggggaggggaggggaggggacacctt

SEQ ID NO: 10479 - DNA, 43202 bp, Oryza sativa
  unsure (1)..(43202): unsure at all n locations
ccagccgccgcctccccacgtccgcccgtcgctgccgagctcaccgccgtcccgcctgtgggctgtggagaaggaggcagctgaagaagaaggtgagagaaagagagaggaaaatgagtggaggagaaggaaggtgagaagataagggagagagagaggagagaaggggccacggggagagagacggaaattttgaataggatgggagggacggctatttttcggtgcgggtggattaggaggcccgcacatgaaaatagggttattttcgcgtgcgggcctgttaagtcacccgcacacaaaaattgattttcgtgtgcgggcgacgctcccaccatttttccatgcggtctgacttacggacccacatggaaacaaaacgggggtggcgtccagcgtaatcaatcctgtagcagtgttatcactaatattcaagattttttccgggtggactcgcacaaacacaatgagcaagagcataggaagattttggcgatgcagctatcacagctcacgacatttttcttctcctcttattaacttaagccaagcatgcaagtgcatatttatacaacgacaacgcactcacatgaataccggataacttgctccactaagctcatgcatgcacaggatcctatacaagctagtagagctgaccatgtaaaatgctactcccctgtttcatattataagtcattttgattttgatcaaattcaaactactttaagtttgactaagtttataaataaatatagtaatatttacaataccaaattagctttattaaatcaataattgaatatattttcataatatatttgtcttgagttgaaaatgttactacttttttctataaatttagtcaaacttgaagctatttggctttgactaaagtcaaaacaatttataagctgaaatggaggggggaactaacttgcatgcaagctaacaaactctaaacgtgcttgcgtgcacatgcagccactaatcactagcttggtcccatgaaaatgcttcctttttgcacgtggctgatattggcgccactctccagccgcttcgcacgacccggctgcattccggcggatgaggcttcgctgacatatgggctgatgggtatggggcacatctgagacccatgtccctctaacttaaagttagaggagctcctttctatttcggtcaagcctatgtatttgtacgtatcacacgtattgccgggtacttcttctgaagccacacactgctacagtgctaagacctatacaaccactttctacgtgcaaatgaacaaaatatatatgcatagtattaatgacaagattatttctaagagtgcagccggccgggtgcctgcttctgcagttttgcttgcctcgggccacttctggatgactgcatgcgtacaactttgttgcagggctgcagaagagccccaagttcccatgatcaaccaaggagctatagagggtggccgagccctctctgcccctctgctgcatccgtgtctctggcagcactaacatacactctcttgcaacgaatagtttatctccaagttagaccaaaactcccgacaccttcttttcctaccaaggatagagagaaaaaaatataacccaagctaaagtcattaacaattaagcatggaatgtctgtgtgtgtgtgtgtgcatcctaattgatgcgtaagccgggagttccatggtcaattacctaaaaagaactatgcatggaactttgccaatgagaataacatttatatgcatacaagtaaattaagaatggtgtccccagtgtaacaactcgtctacctcgatctggtttcaacaaaaaagcaagttcttttaattagatgtttggtccagaactacacatggaaacttttgtaggatcgaatcacaagaactaaaccaaccagagggggggtgaatggttgatatacctaaaaatccaaactattagcagaaataaaagttaccctcaaattcgatgtagatcggtctgaccgaggttgatccgccggtttgaccgagctcatgccgccggtctgaccggtgttgatccgccggtccaaccgcctgaagattgcctgccgcgtgtgaagtcgccgccggtctgaccgcctctccttcgtcggtttgaccgccgcctgccgccggtctgaccgccggtatgtcgccggttggaccgccgaacccgatgaaacacaaatcgaagaactcttaaagtagatgacaactttatttcttctctttgtgtttacaaagtgcaccaacagtactccttacaaaaatctcgactaaactcgaaaccctaactaaactagcaactcaattgctctcaaaagcgatacaaaagcgataccgggaagcctcacgctccccctctatttatacatgaggtaggcagcctaaagccacgaaccaaactcatactaagagtcctaaacaccttaggaaaacctctagtacaagaaacaaactttacataaccaatcataccaaatttagactccttccaaattcgactccgcatcccatacgcacacaatacctccatcgtatgtcatatgaaatcttcaccaaccatgtgcatcaactatagccatagtatcccgcatgatatctgaccaccacggacatcgtcttaccaccaagccgactcccggtccatcaccgcaaatactctcccgagacatcgagtcacctacacatgaaacaaacaaagaaatcatattccgagaccaagctgacggagcgtggggctcctcaccgggagaccgcgcaggcccccctttgccggttcggccgggggcgctgagtgaggttcttcgctctcgatctgaggaaagtcagcgggagaggaagtgcacaagacacgggcgacgtagacaggttcgggccgctgagaagcgtaacaccctactcctgtgttctggtggatctgtgcgtgaaggaatacagagaaccggagagcgagagtgagttcaggcactcgcccccctttcccagagtcccaaccccctttctcctaggcctgggcctcctttttatctggtcaggggtcaccacatgggcctctagctgcctaagaagggaaacatgctttttacaatgagggctagtctacggccggaaatgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccaggcacacgccgcgaccggtcacggaccggataagcgtgcgctgcgccgcattaaatgcggcgtggcgcgttcgtccaacctgctataaatgcggtaggtgagccccgctgtgctcacctaacccacacatgtggcgccaaaaccacagggggtcggggcgcctcagccctcggggccgaaacgggggcgccccagccctcggggccgaaacaggagcggcccgacccctcaggaagacagagggaggggtggccacgtcaccctcgggcccgacccccccgagggggtcaggccacgtgggtgaccgcggctacccaagcctctagtcacgatacccccggccccatgtcaccgacacaagctatctccaacttgactcattgttagcaaacaacagtattacatacgtatagtatccatctagaagccataaccatgaaacaatcacggatatccaaagaaacaacccgaaaccgaaaccgacatagcgtcggccggtcagaaaattgattatctccaaaaccacttcgacgataatctccaaatctcaaaacctataatcacaaataccaattgttcatcacaaaataagaatcaaaacacactttgatcttacaactttttcgatgggggcatttggttctgatttttcttaagataatggatagaaatctgggctctactataatgtgcactcttacaaacaccccacaaatgacaagagcaacattcttgataagttgatgaataacatacacggtgaacatttttttaatgtctggctaatgttacattggaagcaccacataatttggtagttacttttagttgttgtattgggaagaaatgttgtatattacaacaagaacgaactaccactgcattaccttcttctcctgtacagattttgaatgtcgcatagaacaagaggggagaaccacacacaccatgatcgatatctgtggtgtcagctacgttttcagataacagctgcaggacgccatcaagttgtgctaccgatagtatcaactgatcgtacaactatctctacatcatctctgttgcttcttgtaatctcatggattgcaagaaccttgtgtcgacatgcttgatttccaggtgtctctccttcctactaaagtaattcactgtcgagtgaaaacctaccattctcatatggcctatcacttctggtttgtagcttcagtactgataatttaaggagacttttgtttctggcttggctctataccatgcagaaacatactttattatttatcattgagttagtggtgtgcatttcacatgttcttgacctgatggaataagtatatataatctattatagaaaaaatgcatatgtgttgcaacgggtgaaggctattttaatcttattattattgtacggtttagctaagatgaaattcactgtgggaaattcgcttggatattctttttacaaaatcatgagctgcaattaggggtctgatcgtctcaagttagcatgcaagttttttaaagagatttcttatatgactccttctgtatttctcaaaatgaacaaaattaaaaaccgactcaaacatggatatatatttcgaaaagcgattgaacttaaaaaacgattcaaacacggatgacgtaccaaaagtaccggcaaaaacatattcaatttttataatagtagagaaatgcatttgtatggtgggcagagttattattatggaaacggtgctcctactatataagaggcatcctcaatgtttgcagtacagtgtaatcttaaggtgggccctataaatagtgaaccattgttaaagccataccccaaatgctatggttagaatttagctataagatgggctcacatagaatggaaaaaagaattgtttcattccttgttcatgaagtgaatgagagggaaaaaaatactttctttttgcttgtggtacggtagaccttaagcataaggtgcactctaaggtaatgctactttccacaatttatatggctcaatttacaagtgcagtcgttgtcttaagatcacttttttcatacattatggttgctcaaccaaccgatgacatagcatccccttacgtaaggtagtacgactacggcatcagtgatggggctagaggacaattttctattcacatagctcaaattattaaaagaattgcaaactaatatctgtttttgcagcattttctttatgagaatcattagaaatatatatataatttttccttcaaaagtggatctctagtccccgtgttataaaaaaaaccatgatgttttcgaaccagagaatgatgaacaatggtgtactcagttaacccttggctttccagtctgttattcctattttaccacaattggaaacctggacgctcactttttaagaaactgtgaaatgcatttatctgttttcatctcttgatgaccaaactgtgtacgtaacagctatcacattccacaggtcccatgcaacgactgcaaccagtgaagctaggagaacatgttagatgggcatgcagcaagctgtgcagcgagcggccttgagtgtgggtgtggttagaagagatcaatgtgttgatgccgcctcgatgccacaatgcccggctggtgatggaaccctctccatggtgctataaccctgcgcaaaatttccatttttccactgaaaaggagcatggtttggaacatgccctttatctgtcgcctagccttgagttcctggtgcctccctttcctataccgattagtgtgctaaagtattgcccatgttttaccgctagcgttacacactaataactatatatattgatagagcattgttccggtccaacatattgtaaatggagatactggtaacttgaaggaccaatctaaatcgggccgttcattcttaatgggtaagattgaaaaccaagccagagcaaccctagcacgctaagtccagctcgtgatgctccttctctccgaccgtgtctccgccgccgtgctctccaaaaccacgagcaagtccaagcccagcatggggatggagatcgaggagcccgaggcggtacagcccatcaccatagaggtcctgcccgccacgtcatgtttgtcaccggctcattgaagctgttattctgtcttgttcccttaatcccctcttcaatccgccttccgattcggaaaaaaataccatggcgaggcacgcggatgcactgccatcacagtactgcggtagctgaaggggttcacatgtggccaataaatcggcgacggccgtcgtcgacgtgctcgaatccgtcagcgagattgggggaagggtcgcgcgggaggcgtatgtcactggtgagcttgggggaagtgatgcacgaacgctcgttggctccctccgcctgctagtccgtccatcactggcgagagtcctcgatgcgacatctttaggagagagaaaagacaggaggaagataaagaaagatatatgcgaattaactaaatacccttacttttttagtacctctctgtcttatacgaaatcacgtgggcagtatcactaggtataactctttctcacccgttggatcagatgaaattgatggctctgattacattacaggtaccgaggtaccttctagatagtaaaaaaatatagcaaacaatgtattccacagtaccatcatacatgctttcaacactcggatgcgcacctcttcagctattcatggtagcaatttaagtgctcgctaactgaatatggattcgcaaaagtgcctgaaaagttcagtgcttactgaagatcacagagagacgcttgggagacaataacatggaccagggctcgattgtgaccttagcacgggccctattatatgggccggaatggaaatttcatataggaataagtctattttgccttccccaactcatgttcctgcttgaatcgcatcactcaacatgctgaagaagtatagaacacaccaatctcccaatgcttcccaagcttacatcaagtatgatgataaaaaaaaaaaacaacaactctttggacttcggtttcagagcatggtcaagtaaaaccaaaggaagaaagaagcaaactgagaaatataagcactgtattcatgatctctgacaacaaagattcagtatagcaaatgagcacctgcaagtatttaacctcatctatacggttgcactctacgactctactttgtgcgttaattggagtgtgaagagtacaaaaatagggtaagataaactcattgagtgaaagtttgatactgccttgtacaaatcatatatgaaacaatcctctgaacaattttgcactaaattgctcgagatattcgtatactactctctgtatatggatacaaatcaatttactgaagcttgtcagatagttttgaagtgtcttgactactttgatcaagcctcatgattcaagagttccaagctatcaatacatcaagcagattgatggacaaattatagcaccgtatataatatagcccgataaaaatatttccaattctttctaattcaataggcagctagcattgtactttgactccttgtggctcttcattgattcattcatggatagagggaagacacgtcgcattctttggaagtgagtagcacataacagaggcacacttgtatggttgtatgtttcttccaagctgctcaaagactacgagatcaaataatgcaacaatgctaatcagaattcacaacgaaatttgaccatatacgtgcactttgcctattgtatccttatctgtttttcgaaaagtaatcctatcaaacaattcataatttggttgtttgattaattcgcctaaatacattgggttctccagaaagccatgctactgagtattccctctgttccaaaataaataaacttcgtacagtacgtgacacatcctagtatgatgaatctagacagtatactcccttcgtcttaaaataaatcaaccatatgatgtgtctagatttgttgtaatatatgtcacatcctgtggttgatttattttgtgacggaggaagtagcatattagtactatattagttacggagcttggaatccctgtaaaagcccaatacatgtccaaattacaggcccgtaattcttttccgaactaggctaaaaatggtgcttggatggactgtgtcagactaaaattacagctgtattcagcccattccattagattataagtgtggcctggtagaaaattaagtgctcgctaattctatcttctacatagttggtaaccaaaaaagaatttatttctataaagtaaaatatgcaagaagccacatcatcaacaattttaagccatcggatcgcattagtatagagttatcatctgttggatcaagaaactactcatccatttttaggttgcttgctgggccggacgtttgcttgcgggttgaggcagaggggaggagaagagaggacagcgggctggcttggttgtgggctgaagaagaaaatggactggcaatagcccagagagaaatgatgatttttatttaaataaatgttgaaatgatgtttattttatcaaaattagcaattaagctctggaaattccaacaaattttcaaagagtgttattaattatggttaatttaataaaaattaaatccaaccatagcattttatttcttacacttactttacttgtaaattaatttaattatacacctacctacttaaaaaatacttcctccgtttcatattataagactttctagcattgtccatatttatatagatgttaatgaatctagatatatatgtgtatagatttattaacatctatatgaatatgggcaatgctagaaagtcttataatatgaaacggaaggagtacccaaatacttcagaaaatttatatttcaatgaattatataatgtaaatctttcttaacttttcctcaaatttatcgtcttttcttcccgttgcaacgcacgggcactttttctagtaaaacaaaaatacagatagtgttggcatgggccagaatggagaaatgtgaacaccttggacctaggcgatggtggtggcctgatgccactgcctgctaggagagatcaatgcagaagaaatggagaggccggtgacagggcgatgattctcccgtggacaggctgcaatctgcaaaggcaccggaaacaaacggccggccacttgagtggaggcagagatttcccttaaatatccaaacatttctgaaaataatgattttttttgtaagttacattagttgatcccagcttagtagatttctgcctctaccctgccatatttgtgttgcatcgcaagcaagcggtttttttcctttgcttgttccacttctaatttattttttcttcgaaaatttatactagcatgtgaaaaataaattagaagacaggtttttatacagttcgtgggattgctcacacttttttttaaggaattagcggcaagagatctgctgattatattaggagaaaaagttctgatagttctgacacatatagtagctgataattcacctccagtcatgaggtgagattaggaagaatacaaaaagtagattacatattgctcacacttttttagataatgatattcctcacacttgtatccctatctaaatccaacatatgttggacagtgatgcaagagcagaaacagtttggtggcttgcaagaataatctgactggcttgaatgtcagttcccttggcctccccttcctagttctcattgctcttcaccatgaattgagaagacaatcgtcactccttactactcctagcagctaggatattctcattcttcggcggcatttccgacatatatgtggccggatacgaagatgttcttatcatttatcagtgaagcacaaacagggtgatggtaaatatgaactagctaaggaaatatataagctgagctctcaagatttacagtagctcagattaatctcgtcatgcatagtcaaaaattaattggcttccatctttgacgtgataaagcatccagccaattgccgtatcatgatttggaacatagagttaattagtcactacatgttaatgtaaaaccagaatgaatgcatggacgtaaaggggtcagtttaattgatttatgaacaatatcaactgatcaaaccacaaaccacggatgtctttggtatggccaaagcattgctagatcccaaggctgaattttgcagaagagctggtatcctgagacgatgttggacttcttttttttttttttggaaccaccaacttttcatggtcatggacgttaacagtatggttggtaataaaccaaaacaacagctgatttggtttgtaaaggtggcaaactagtgcttccaaattaaagtcacaagacggtggttttatgaagttcataaatatatagtagctattcacacattattaatttggtaattgacaaacagttgctagctctcagtggatgtttcttgtggtaactgcaattaatctagtatgtacctgttcgaatacactgaatttataattagctaatggttattgatcaaggtgcaggatccaattccaatctgatgcaggcttcgcaagtaggtttgcaactatatcaacctcccattgtattgtatcggctatacttcaacgaccatagtctctcctcgaacgctatcatagatcgtcaaatacagcaaaacggtactgctctactggaataagttgcacttgcttttttgctccttacgcagcttgtcgtcttgttgtaaatgatatagcaacttgaacatgaattcctgaggcctccatttcctagtggatcaaatatctgaaacgactaatatatatataactgattactaatcttttttcatgtaatatatgtaaaatgaaaatgtatttgattattttataatgaacaattggcatatatatgatattattggttttgatatttgcaaattattggtgatatggttttggagatgtgtgattttcagatgatgaaaaagattgagttgctctgacggtcatggtcagacaagcaggactggactgatcagaccggcgttatgcgagcggtcaaaccggccagcccgactgatcagaccggcgttatgcgagcggtcaaaccggccagcccgacggtgaccagctgaattctaatacaaagacacacaaacaaacatgaacacaagtgacctagagaaggccagaattctaatacaaagacgcacaaaccgtttgtatacccccaacagacaccatggaacttagacgtgcattctcggtgtctccctttcctattggatcctattgaacatcaccatattactgaacgaacaatctctcgagaaattgctacacatacaactggcatgtacgacttgtgaccaactagtacttagttgtttcttgtcctggcccacatgtagagatgctgctcgtatggagagaattgattggcagacatgaggccggaccggataggggtcagacgatgtggtcggatgtatagcagtactcaatctctcgcatgctgctgtggatcacactgtacttgatgagtgctagtgaattttaacaagactgtttagctatccaactctatagcaaggaagcaaagatagtgactattattctatcaagtatgcaatggcttgtaacaattaatattgtaggtgaacggtacatgagcaattaatagaggtatcatgcagtttcaaggcttcatatgaaaagtaattacctcatccttgttggaacacacaacgatgtggttcatgtaaaacgaaggtgcttgcaatgctgcgaaatcctctttggctggtgtacttttccaccaagcatagaagtttaaggagaactgtaggtcggtggctacctaaggaaactccgattcgatccgccccccgttagaacagtgacaccatggatcactggctgcaatagccatcatgggaaggaagctggatttgcgcagcaaaaggttatagcacaaggtaatgcagtgctgggtttaacatatcctagagagagatgcatgcgcatcttgcaggaatgtgctatattactcgagtttcagttccctttgcctccctttcccattgcactttgctgtgaagacaagacaatggttagtaattaacagccacaattctcattcggttactatatatatgcgggcaagtatatactagctatagtataaatatatatgctgagatctccaagctttatgctagctcggattagtttggtcatgtgcagtcaaagtcggacttgtttgagacgttccacacatacacttgactgactgcaaatgtgtacacttttagttactgctagctagttgtagactcatggttactgaaagacatatataatgccaatattggaggagataacaaactgtaccaaagttgtagcctttagaatttagacatgtttgattgcaatacttgattggatataaaaggttgtttgactatgcacacctaactcacttatgttgcagtctcctctttttttttgtaaaaaatatatttctgaagtacacctctctgatcttataatggaaaaaaagtagtcttccactcgtcatggtggaaaaattcttaagctcttgctatttaaaagtgatttaaaaatggtgctttgcagataatcaataattgaaaagcactactagaaaaattatttttgcaggtggccaaatgctttgcctgctatttaaggcccgtgaaaatcatcaatttttgtagatggattttcatctatgtgtaaaaatcgattttcgcaagtgtccaccctaagagccccacgaaaatctccttttttaggctgcacagttaagtgcccacgaagacgaggtattgctttccaaggccttgtggtgacggatccatgctcccaaggcccagtggcagcagatccgccgccctcgacaccactgccaatgatgcacgagggagagatgaagattgtgtcgatagaaccaccattattgccccttcatcgccgttgccgacccaccgccactgaggtctaccagcaccacgcaacccacgaccttaccggatcctagcccgtaagcctcgctgtccgcgtgccaagccaccacctgggccccgttgctgccctaggtccgccgctagatcttgctactgcagctcgatctccacctccagatctgtccattgtagccttggctgtgccatttcctgagttctgccacttgggccccgtagctcctccttgttgttgctgagccgccaccactcctttgtcttgtcgttgagacatcgtcgccaccacgcatgggttctttaccacaagaagagcggtgggagtgttgagagaggagtgggggactaagagggaggacagtgatgaatgcgtgatacaggacataggagaggaatgagggagagggataatgttgaatcgatggggacagagattttaatcggtgtaggcaataggtcgtggatttttgcagcagcctttggttcttcatcctttcgcatattctttgtgctaatgttttttcatcttggcaagagatggagaagcttattttgatatttggagataaaaaaatataaaagatatttcccccgtttcaaaatatacgacgctattgactttttaagcataatgtttgatcatttgttttattaaaaaaatagtataaatatgtaagagtataagttaagattatattttttatttgatgataaaacaaatcagaatgaaataaatgaaatttatataaattttttaaataagacgaatggtcaaacattattcgaaaagtcaatagcgtcatatattttgaaatagagggaataaatctatggcccctgcacggatgcacccaggcaaaattgtagaacaaatgaaaccaaaagggaaaaaaagagaaattaaaggacctggattcattcccaatatgactgcccacctacctgtatatgctagtcccttatgccatccccaacactgcatgtcatctagtgtccatagcattaactatattgcaacagaagcaaaaatctaatgtggcaagagagttaatcaggagaaagctaaaaagatcacgaaatcatttctcatgcaagaaaccatctctacaccaaaaccaagaatataggtgaataaaaggaaagagaagagagatgattggatgggaatttaatttaaaggccatcctcaacccagaatatatatatatatatatatatatatatatatatatatattctgggttgaggatggccttagatcaatgtaactataggatcgcagatcgttacttgggttgttgaaggttggcttatgaaaattttacttaatacacgccaattttgatcaacatgtttagtcatccgattccctctttttttcagcacttttttattgcagaaattacaaaaagtccacattaccaccccttataggatggaatggagttgacgtatgtgcacaagtgcagcccatgctacaatgggctggaacactacatcaataatgatgttgccgacatcaaatagtcagccggtgacttgggcgtaggatcctggtgcctcctgttcccaattatatagttggcaatgaatattgaccctatctgccacttgtcttttatatccctcatctgtttaatttcttgaaaaaatacagtcaagcaatgaactttgtaattgatgaattggccttgatacatttgggtttgggttttcctttgcgaagaccatgtctagcgagtcggcatattagtatgtataattatttacctgaatcaaagcgtatagtaggtgatggtaggggcgcaaaaatatgtagtagtgggagggacacggattttctacacctaggtgtaacatcacctatatatgcttggcacataagtagtcgtagaaaaatgtggaaaatgtggttagattggttgtgatgctagaagtataaataccaatattcatggttaaatatgatctgcctttcaataaaggaaaagaacaaagtttgacactagagtgtgtggacaaaaattgctatgttttgacgacatctcttgttcatggtcagatcaaagacgtacttgtcccagagtatttgtactggtatgcacacatggcagtgatggaagcccagatttaagccgttgatttgcattgaagactttgtttcagaccacttagctttggcaaatgacaaatataatcttgaacaaccgagacatacaagtatattcatcttctactttaactacaaagattatcaggagagagtatatttagcacaggacacagcatatatgcgcagttgaacattcagccagctcaatgaatgcaatagtggcttggtcactacaagaactaatgctatgaagcattgagccaatgcattcgatcattggacgtgccattttacctacaagaactaatgctatgaagcattgagccaatgcacgaactcgaacagcagctatagcagagatcgttgatgagctggctaaaatcgcactggaagcgcacacggcgggccaaatttgctgaggcccgcatgctgaacgaacggctagataattcgttaaaatggtgggaacaatgcaggttggactgctagcaagctatgaccagagtagatgaagatatttcattatatgccacaactaatatttgtaaagctagctccggtactctttacttatagtattatactataagtagaaataatctagaccatccgtttctaagggcatattagtactttattagttcagtgattagtgataagtttgacatttaattagtcttattttaccatgggtcgctgacagattgctctttcagggcttgttcactttaatgtcattttcaaacatacaatttttttttgataaaattgctaaaattttggctacgtttagtttgttgccaaattttagtaagtactccctccgtttcataatgtaaaactttctagcattgctagaaagattgcggcaaaatttgctacaggacaccgaaaaattgcggcctttgctatgagacacccgaagatcgtgaatcttttcgtggacactgtaaaaaagtggtaattagctactgaatactcctcccattattttattatttctagtcaaagtggtaagtaccaaaatgcccctgctctctttcttttcttttccccttcttcttcctcgcgcttgctgctgagctgagcagaggcacaacgcgcgcggcaaacgcgacggcggggcggcggcggtggcgcatcaccggggttcaccaccgacggcgatgacgcacggcagcattccggcgcacggtgcccgggaagaactcgcctttgccgcccagcgaccggtgtccagcggcacgttcacgctgtagtgcttgccaacgccctcacggatttcgttgatggtgccggtgcccgggagcggaggcgcgagtagctgagcatgcagtggagcatggtggcgcgtaccactgcctgtcgacgaccgcgcacgccacctcgctccaccccccggtctggccgccgcgccgccgcaccacccaccggagcgcctcgcagaacggcacaggcggcgttgagtgccagcatctgctcgaccaggtcggcgcggggtcagtgactgcatcggggaggagctcgtgcatgggcggcgcgtggcgtcggtataaaaaagggaagcgagcaggaaaacgtcacggtggacgcgggtttcgtgttaattgagatgcgccaaaatgcgttgtttacaaatatatcacaaaatctaaaccgagagggctctcgatttagtgttaaagagcgacgtaattatttgtgagagaaggtccaatgcgctactaatacatgagagaaggtcctgtgctactagtacaactacgtgacaaagggtccagttgttactagtgcacacaatgcatgtctatttttttttctttttatacaattttctctcaaattacttatccaatctgcaatctgattacactattacgttcgttgcaattaaatatttacaacaagattttacatgattatattacgatgaaaaaatatttatatttataaattacttttattatatacgtaagttacttttatcatatatatatatatgttacttttagatttgactaaattacttctatacattcataatgatctaagttgattatttttattattgtttttagttaattctatattttgtggactttataaatttctctacactttacttacgaatttactctacatagtttcttatttcagctcactcacaatataattatttctactaaagagagttactcccccgtttcataatataagttattttagcattgcccatatttatatagatgttaatgaatctagatatagttctaaattaaagttactttcctttttattataagttacttctgtaatatatatgtaaattacttttaacctttactaaatttacttttatatgtctaagaagtaacttagtgaaatctaaaagtaatttagacatatcataaaagtaaattgtgatttttcattaaaatataatcatgtgagatcttgttgtaaagatttaattgttacgaacacaacggtgtaatcggattataaatcggattagtaatttaaaagaaacttctctaagaagaaaaaaaacatagatattgagtgtactactagctattttttggaaataagggtgtctctctttagcactatcagctagcactctcgctgtagttgtgtcccaaatatatatgcatgcgggcgctggttcaggatcctaattacaagggattagattaatcatatcttctatctatctgaaccaacaaaccatccgtgcatatatccatatatgagatgacaagataattctagtttatctaacagtcggggggagttgaaggtggtgtggacgacgttgacggcgaggccgcgcgcggtcgtggaggagctcggcgagctggagcatcagggcgatgtggctgcggaacgggaacgagaacatcacgacgcggcggcggcgagctccggaggcgctgtcaacgagcgcgagcgacgcgggcgggcaccatgacatgagagaaagaagaagaacagataaaaagagattgacaagtgagcccatgggtaaacttgtctttaactaaagtttctctctccgtttccatcggaaataataaaataatacagccgctgtccgccagctaattaccatattttttgagtgttcatgagcaaatacacgatcttcgggtgtctcacagcaaatgccgcaatcttttggtgtcctttagcgcaaattttgcctattcatatagatgttaatggattcagacacacatatatgtctatattcattaacatctatatgaatataggcaatggtaaaaagatttacattataaaacagaggaagtacatatgaaatcttgctaaaatttggcaaccttaccaaaattttagtaaccttactaaaatttagtaatgacagaacttggtaaggttgaaaatggtagcaaagtgaacaacccctcagatttcctaaaagaaggaaaaaaaacttactcgcttagatacgaggagggttacttgattctttaggttgtgtttgggaaggagggactttagtccctctcacaaattttagttcctatggaggaactaaaatttttatgagagggactccttcctaaacaccaccttagttgagcaacggtggcagagaagaacaacaaaacgttacttgtttttactggatttactcacagaaaaggcagaaacattggcaagaaaaggcagagaagtaaataaaatcagagaagttcataatgcgctgtaatttgttatttgttttgtaccaagattaacctgaatctactgtaaaaatataaaactaagagaagtgcggttctacatagaccaagcaggagttcagtcaggataaatcaaaaaaggatgaacacgtgagtggtgcggctatgagttcagtcattgacgacgacgccagcggctctggcgccaaaaaaaaatcatttctgggataagttttttcagtagtctaaattttataaaatgatcaaattgtaaaaaatccagttgtaggaggtcggtccaggtcaccggagctctccccgacgccgccagatcctgccgccggagctcggtcccccgcatcctagatcgatcctgcactgcgaatggcatccgcagcaatggttgatgtctctgcacctggcacacagtctcgatatgccgtgtacctcagcgccgctgacaccacgccttgttctcccgcgtatccaccgtcgctggcttcaccagcttgcaagctagcgaggagaatgtgttttactaggtaaatgtcgggacagcacatagcatgaacctcctctgttccagcagctaagcgtgctgagcctgtcataccgaagaggttagcaggtatcaatctcccaatgcttcccaagcttatatgtatattccccacaagggcaaagaatataaaagaaaatttgattcttggctcatgagagcttggtggaggaagaagcatgggattttgttccagataaagaagtggaaagcagagtaaaataagcagatggtgatatatatatatatatatatatatatatatatatatatatatatatatacatatcctcgtatctctcttggtgtgttcgtatatctggaaaaaaaaccattcagatacagtttagaaagtgagcacgtgcaagtatttaaattttacttggttgtattctacaactctgctttctctcttggagtgggaaaagaaatgaaaaacataacaggaaaaaacatggtcaagctcattgactgaaagtctgaaatttgattgtataatgttgcattaaattgcatgagatactctctgtatatgccgattgctgaaacttgccagattagtcaactacctcaagcctgattagtcaggagctccaagttatatatatcgagcagatcaataacaacatcatatatataacctgctaaaaaaaattccatttcattctttccaataaaaatattacatttccttgcaattaaatctggttgttcttgacttgtgggtcttcattaatattcgtgcaggaaaaggaaatgccaactccaattgctgataactcctactgtacagtataaatattatactgtagttctcactaattaatcctagtatatatacttatgagttcaaaaagaaaatcctaatatacatatcaattccttaatctcaaaacatcctcgccgccagctaccccgctataaaccatatgtgcttccctttttcaaaaaataaatgaaatatttttgcctgcctcaattgaaatcaatttggggccaacaccttcacagattgctacaacttttttggagagagagtagccacatccaagagccgtcattgtctttgcctgtttctaacttgctaacttccagatcggctaatccaaatgcagctcggacccaatatcctggtgcctcctcttcctaatcagagtttacaatcgccttttttttaatgttctcgtatggttttttttcaagaattaattatgtcgagcaattcatgacttggttatcaatgaaatcaatgaattggcctaaatacaagatggtttgttttcttcccaaaaagccatggctgccgagtagcatgccggtactatataggagtatttatctaggacacaagagcacgagtggcgagcgagtgcaaataattgtgagatgagttttgtgccttcatggtcatgcatgactcacaagcatcaattgtccaatgtccaccaaccatctgagcaccttgctgttaactcacctgttggcattatgttttaacagtgcaggtgcatcaattcattcagggtaattctaaatttactacgggactaggcgactaactatacatttgtcgtcaaattttaacttaaaattttttatagatataaatatagtacaattctgatgtagttaaattgtaacttccatataactagagtgtataacttgtacgtagctttccaaaaccccttgatgacatgctatttccatgagaatggagataatggtaccgaatctcctcacatgtgtttgggttttaatttttttactacctcctttacataaattttaaagcaaatcgaatgattcaaaattatattatagttacatacgagttatcatataattacatagcgattgtactatatttacgtctcaacaaatatatagcaaaatcgtttactattgacaagtactcggttttacaaagcctttttcttccctttttgccatctccatgagccttcctttagtgcgccaagttaaccccattcaaaaggtactatttagcctaggaagtgcttcctatagactaggggtaaagtagattgatcatttttcaatagtaaaactggaattttcacatacactactagaaaaagcatttttgcagacatgggattttttttccaggtgaacatgactctcggagctaaatggccgcctacaaaatataaaccgggttgaaactcactgtccgcctgcaaaaatctatagacacgatggaaatggtatttttatatcctgcgaaaataccgtgcggaaatttatatccacacaggcggaaaaatatccttgaaaaaaaaccctttgttaatcttatgtgatccacctgcggaaattggcgtgaatataaatagacacgacatggaagcaagaatttttctaagtctcagctctcagctctcctctccctctaccctctcttccttagctccatcagcgaccggtggtggcggggtcggcagcggcaacggcgaggcatggggtcggcgacggcgacgctcggggacggtggcatccacacccggcacggctcccttctcctccctcctagatccggccgaaggggggagggggaggaggggtggcggtggctacccctggaggtggcggcggtggcggttcccgtttctcctagatccgacctaagggaggccaggggagggcgatggcggcggcggcagtacccctccctcccagatccggacggagggaggccgggggagggcggtggcggtggtggtggtggcggcggtagcagtacccctccctcccagatccggacagagggagaaagagggtggtggcggtggcggcgctcctgcatatttcccgtaaccctagatcggtcggaggtgggtaggtttgctggtggggtggcgcctttgtcgagtaacttcagttacatgcatgaacttcagtgaaccaacttgtatcgatacccatggtatagctatccaagcttgcaataatgataggcctacaacctacttcgtgcagcgatgattattgtctccaaggatcatcctaaaatttaatgggccgcaaggtgttaagtttcaacctatttatgaaaaaaggagttacaccctgatgatagcaagaaacagtggagcacgagtggcgacaacataatatgcacaggtggcatggcagttatagtgatagcggggtggtgtgactgcggtaggttggactagctcctacctttttatgatacagttagctgagtcatattgggccgatagatggatggatgggccatttcaggccttattcagtgggatttgttagtattaatcttgactagtaggcgtcatatactcttgcacgtgttgtgtatgggcagcaacgtgatgtgtttgcatggtagactagctaatttgttagtacataattagttagtgtgtgtgtgttttgtatggattagttggagcgatttctcagggttgttagctgcaacaaaggatagcgggcgtctcatgcggaccgtggagcacgacatgcagtagttagtggctgtgcatgtatggatcgtgcgagcgtatatgtgcgtgagactcggccagcaggacgttgctcggccttgggccttataagctccatgtaaattctgtgtttgtgtgagttgggaagaaacagaagaaaggcgcacatcgctgaaactgcttgcgtgtgtccactacagcgcgtgtctttgttttgtatgtttagtgcgagtgtgattcttgtgtgtgtgcgctcgcgtgagtttgctgctccgtgagttcttcgcatccttggccaaaagctaacaggattcactcaggggctggaagagtttgagctccttctcaagactgtcttagtacggtcttctctgcgcctgtactgcaagcaacttgagcacatcgcctctgattcggagtaggactgccaccgcatcttttgcaaggagggtagcgcatctgtgatccgctgttatctggtctgttccaactttgttgttgacatcacgatcagattgtatgacactaacttggacacatgttcccggccggtgcccccttttcctgatcagagtttgcaaatgaaacttggccatcgtattgcatttggcacttcctatcctcatctgtttttcaaacaggagctaatgctagctgccatacaattgacttggttgtccataaattggcctaaatacaagatggtatttatataaaacaacatcctgtgtgaatgcaaatacaatgtgccggagtttgtaaccatgcatgacgcacaggaataatctgtgcaccaaccatctgaggaagatgccatttacttacttctgggttttttttagaactcatgcattctttttataacaagaaactaaggtttagaaacgagggcttttatggtgcttgaaaggtatttcaagtacctcctctggtataaactttctaccgttcatccttgaagggtaatttaggaatagaaaaacataagcatggatagtttggtaattatttttagctgtgacctttagaactctactaggttttctgtgcactactagagaaagagaaaggggctttactcccggttgggaaccccctatacttccggttatataatcgggaccacgaatccgggacaaaagatacccatctttattcccaggtaaaataaccggagtaaaaatccataccaccgagacttaaaatggagccaggctagatccggttgctgtttttttttctttttctcattgtttttaacattgaatattgatttcattccattcccaaatcatctccaaattgatcatcacatcacagatcaaaatgatcctctccaaatcctcaaattgatcatctccaaatacatcacaaattcttaaaaaaattacatcacaaatacatcatatattcacatcacacataagtcaaatacatctcagatccgaatcacaaattctcaaaaaaaatctaacatgcgttgcccgcctgctgcgccgccctccacgccacgcggttgcctctgcgccaggccaccaccaccctcgtgccgcgctaggccgccgtcgccttcgcccgtgtcatgccggctccgccgcttcgctattgcctctgcaaggaaagtgtggataagagcaagaaaagaggagaggataagagagagaggagagggagagaggaggaggatggggagaaaaactttgcgatagagcatttgaggataagtcatagggattatatacgacgggttgaattttagtcccagtaggtattactaaccgggattaaagatctaaataatctttacttccggttggtactaccaaccgggactaaagttgtgatctttactccctgttggtagtaccacccaggactaaagattctgggccccctgacaggcctctgacatgtgataaaccgggactaaagatgattttttgtcctagttggtaacaccaactgggactaaagataattttttttaaccgggactaaaaataatatttagtctggttctattgtgtaaatcagccgacccagtaaagatcacttctccagtagtggtccgtccctgtaatttgttccatatccataggttgttcttgttgctaactgaataatccataactaatctcttgtttcctttactgattctcatctaaaattggattattgaaaatatcatactattatcttcgattaatctatagacataagaagcagtggccttcccttcaaccattcgttgtaaccattcattatttacgacagtttttttttgacttggcattatttacgacagttgatcgaggagcaattgttgccttcaaccaaatttactgaacatcctgatcaacagccgccatgacagataattaccttcccattgagccatccaaggttcatatcgctcatgtctgctctctcgatctgtctgtgtatcggctctcacaacggcatcagatgattacgcatccaaaaattactgatataaccttttacttaatgtattaagttaatacatagcccacatatttagtacctttctctatgtaccttctgttatacaccgtcagattgtatgtaatcaatggctgccatgccttccaagcaccctagaagatctctttagaaacatagggcatgagttatgcttacatctctcttgggaaaaagttcttttttttttacaggatagcctgacagttggtagatgtgagaaatatctgaacagtcaaaatccatttgattttggctagaggattgcctagcaactttagccaaagtgtctgccaccttgttcatttccctagaaatccgttgtattttgatctcccttccctgcaaaatagcatgaattttggacagagttgggtctcaaagaccagtgccttggagtaaatgcatggagtatctgcttctttgttgctgcagcaagaacatctattcagccagtggctctgcagctagtcaccattcccaattcgcacctcgcaagacaggggccaaggaagaaatccactccaggaaggagaagcagtgcggttgccggcagagccttccagttggcttgtggctgtggcaaagcaatgccctatcgctccgtatgtataacttgaatttcagttccctttgcctccaattcctgttgcacttcaccggttcaaaccatgaatacaagacaatagtgatattttgagaaagggcatggttaattactagcagctaaaatttttatcataccgctggctttgctacatatgtgtagcctagatggtcaggaacacacatttgtatcatttgtcactggagcacagacaagtcatcaactatatactgtatacctagctagatgtcctctccaagctttatagggggggggggggggggtttcaaattaatctcgtcatacttggtcatagactctgagactcataattcaatattcagttattttttcattatagaaaaccaaaattattgcacttggcagtctgaccaaaccaaaaatattattttcccttggcagtctgacttgtattactctgtcatgacattcactttactgattgcaaaaaataattaagcggtttatttatttttagacaatgaaataaattccaacctttgctcgagtagctacagccaattattaaaaaaatatgttcaacgacgagcacaaaccactaagtccaaactagcataataaaaagaagcgatgcacaaactaatgaccattaacactagacaaagatcccgtaattacggtatcctacttgtaaatcttaatccgtagttggcaaaattttacacaactgttgcctctaggtaacaacatgcagtatacataagtttgttgtcctcatcacacatttatggttgtgctgcttaaaactagagccaacacgttgccctgaaaagtactacctttgtcctataaaatttgaaattctagctaatttaggacaaattaggaggatagataaatgaccgcaataaccttatttaatgaacctcatatatgcatacattccatatcgaaaattgattaaaaggaattttgagataattaaccccacataattagcattcttaaattacttgttggatcccacgtgattagaaatacattttttttggacaaagcctcaaagctagaatttcaatttttatgggacggaggtagtacctgcgagatttatatggtgatttgttaaaaaccaaatcatttctactaaatcatagagcccaacattagcagatgctactacaaggataagtttcttagtttttacatcaatacccacaagccaatttccaaagatatgaaatatactatgtggagtatttagaccaaaagaaatttgtatcgatctccagagattcacatgcttgttgtggccaatttgaaacttaaatacttaatacttttgttactctaatatgtttatgtcacttcagaatagatgctgaagccacagagttgttggaaaaactaaatgagaaggagacctgtagagttcatgctcaagaccatgcaaaaattatagaaaggacttctgctgcaaaccgttgaggtgttacttctattgaattgtattcaaattgagtaattgatttgttttgctcattaattttaccaatgagatgttcacatagactttctcgacttagctcagtcatttacatacagtctcatgcacatataagattgttcaggcttaatttcaattattttatttgcagctttgttgatcctagtcttattaagcaaatgctgagttgctgaccatgatagttcacgaatctgaacacaacattttagtacgaaggaagtagatatcctaaaaagaaaaaaaattctttcacacatcctaacaacaacaagattagtgcaataccatctaatcctcctgccatgtcttcctttacaatctgctcaggaattggaaacatgttcatctttcgtgctgcttcaaactcaaatgaggattccaggctcaaatgttcaatccgtcacagctactaacccagctccatgggtagccttggacgacaacgccaccaaggttagatcattcatgctgcgagagaaaacacacatttttcactactgcatcaacatgattgcgtgtacgtacagaatcggatcgaggtgttactgcgtgtgtctcgattgatttctcatgtctcccaatagctcgtgttccttgcatttgattcggtccatgtattaaaaaagaaaaaataataagaaaaaattgttctttttggtcgcattttgatctatacgtgaaaataaactaaaattattatttccggtcacgttttgatctgtacgtggaaaaaaaagttgaccgttttcttaatgattttaatacggtatcgattaattgttctctcacgtgtgagcctggcctgccgcgtgcaactactatggaaggccatttgagacattttttatcactgtttgtttttctatagaattcacgtcgtcctttttctgtttttatgttctcgagaaatatacacacgcttagatttttctgtttctcgcgtatgttctttatcgtgaaaataatgtttacttttataaaaaaataaactgtacacgttaaaaggtgaaacggttgattttcgacctatagtgtttgggacttttttcccccagatcatagttttcataaaatattttagaaagaaaattatgaaccactattttagttttgacaaatggacacatatgatattaaaaaacatttatatatgtatgtataaatgatttatttattatgtagaaaaacatatttgtttaaaaaatataaaacctttatgccatgttaagtaaaagtataaaatttaatgtgtcattttatacataattttttaaaaaatccaaacaagtaaagtaaattttgagatttatcaaaattaattagtttaaatatattttcttttggatttgaatatttgaaagatcaattatttagtatatttagagttgtttttaacatatcatgtgtaacaaaaatataattttggctcaggaggtattaatgatcctattccatgacataagaaagcaaggtttctttctttatttctttgttttggattttctttgtataatagtttcagatttactgtatattctagagttataggagtagtactgagtagcgtggtatatttaaagaaggaaaataaatgcaaattcgttgttttagatttattttttgcttaacaattttgggtttactatatactctagttataaaagtagtaccgagtaggcgtggtatatttatagaaggcaaatgagtagaagttcgtgtgattggaaaaggaagatagttttggaaacctctagaatccatatgtgatatttttctctagatttttcctcacatatgattgttaggttttttttctctagtataaatttatgatttccttcaaaataagaggtaccacgtgtaccaattgaaagctagcaaaagagccagttttagattattagataggacgtgctaatgagcgttattgggctaggtcgctaggaggacagatcttgggttttctttcttttggctcttttttttcgccacgtggccacttctagtcacctctactaagccacatattttctctaccattataaaagttgaagtttatctcactttggaacgttcgactcctacatggtgttcgcctcttcccattcctatatacgtgcatcgtcttccatcacctccgttcgttgtcgccctttgcgattctgaaaccggacggtattgtaacgttatgatggcaatgtctccgcgaagtttcccatgtcccattgcatgtccgacgtcttctccagtactcccacttccccaacaaccaccctcactcctatccaatcgatcgaacccacgagcttagtatagggagatcactaccatagtagagctgatttcatgtcgaacccggtaaacataaacacggggtaccgcatcttgacaaaggggaaggtggcgtgcacacaaccctgccgggtgggggcaatgatgaccatccctctttcctttcacattgtcttcccactcagtcatttactggtcatactttctcttcctctttaccttttttacagccagagaaagtgcatgtgcgttgcaacggaaagaaaaactaatttgaaattgtaccaccatgcataaataaataatattcggtcacaacgaattgtgacgccgacttgtgtagctggctattacatcacccatcacccgatcatagaaattgttagtttcacgcttcatgattgaaaaaaaatcctaaattagaatcacatcactttatgatagggaaaataatgacacgaaatcataacccactttggtccaagcaaggatattaggattttacttttcctccttgatttcagcccgacactaagcctggcagacactccggccggtgagagatgacacgctcctccctcgtcggcggctccatcgtcgtgtggccaggaaccatggctccgcacatccccttgcggctgtcgcgaccgagaaaatttgcattttcctgaacgctagtatattaatctccgtcctagaaaaagctagggtacaccacacaaacatgatataaaagacacatctttattatatcgataatacttacattattacaaaggcgcttcaggcctgacaataaaaaaaaataaaaaaataaacagcagcggactagcgggcctacggctccatcttcacaggcgctcaactggggtataagccagggctccacctaagacttcttctccaaagcttctcttactgaaggggggaaagatagagcaagaatgagtacaaccacagtactcagcaagccacaccggcagatgcatgattaatgcaagagggtacaaggggaaataatataggggttaagctttgtagaaaacagcatttaaaagtcacttagttgcccaaagctattttataaagacgatcctagagctacacaatattattaatcaaggccgtgaacccacacgaacctgccttaacccaaggcctacgatgattcagaccgaacttgcaacccgacctgggccccagctcgtcccaagccaatcaggccaaccattccacattttagttgttaaacaagttttaagaattaaaccactaacttaggtacattgctaggcttgcccaaatccgagggcgcggctattcgaatagattgtactctgatcagaggtgtacatctttacccacaagacacatctttactccgcattccatggccgtggaacccgtcgtaaaggatgtgacataacccctttacccatcctagccgtgacaaaagcaccgacccaacctcgcctacggccggaatcccgagacaggtaggtaagattgagcccctagcagcaggacaccggccctgtgccatgacatctcgactaccgagccgcagcccgtgtagccttcatttgccctagagatgtccatctagccccgacttcgtccatctccatctgtgtactcttgccaggactagactgagcaccgggttaagccttacccattagacatgtggttagtacggtagtgctttgcaacagaggcccgaagactggtccttatagtggccgaggtgctactagcagaacaatgcacctcgagcccagcctaaaaccattttgagagttttgaatagagggggggaggtgtgtgttcaattccatcacaagccaaccattccacagtgtccaaatgatatgagaactcccacagtctaaagttataaaaccacctagtgttgcctaattaatcagcgaagcatctatctaaattcatactagtggaaccattaatagagtacccactagttggggttttgtttatcctagggtggagaaggtaataataacaatagcaataataataaggtcataacaaaggtaaataggcatagctaaataaaacaatgataacgcgggaatttaagtaaagcggtaatgcaataatttaaattaaaataattttataaactaggattcaatatgctcaagagtgatgcgacttgcctttctcagagagaacggccttccgaaccttcggcgatcaccgcgaaccacgcttcgagaaccttcagaacgacagaagctacgcgaagtacacaagcaaagttacaagcctataaagaagcaataaaaatacataaaaaaataagcacatggttctttagattataacaaacattaagagacttgaacgggtcgattcgggattcgtatgaccaagacatggtcattcgaagtttaatgctgtcacgtggagatttacggattattgtaattaggttttgcaattataaaacatgtgtaagcgcttgcctggaaaagacaggaaggctgcgcttgttgacatgcggaccccacatgtcaacctaagggaccacggtacaccgagtacacagagacggtccacgggtcgacggaagcggaccccgtgtgtcaaccgaggcgagtggccgacaaacggactccactagacaccacgcggactacacacgtggacaccacgtggctaccgagcgggcacacaaacacggtcaccacacgcacccacgaacgactaccgacaccggtacacgggcaccggggtcgacaaccgcacaacgggcgcggggcgacaccgaaaggacgaggacgggggcagcgagaggaggcacccttaccaccacgcaacgaggcgtgggaacaacgacgacgaacgggcgcggcggagacggcttggggacgacggaggcgaacggcgagggaacgacttcggcggcgatccttggacgaaggcgagacgcggccagcacaacgcttgacgacgcggagccaaggacgaagacgacgacggggctgcagcaaccttgacgaaaggcgggcgacgaacagcacggcttgacggagggacgaacaccacgactaccgggaatgacgggaggacgacgatgggaaccggcgaggaggcgacgatgaacgccggcgggttcagctgaaggggaggcgaagccaaagacgacatcgccggctcgccgctgtgatgccggaggtggtggtggcgcggccgacggcgcacgggtggaggaagggccgaccggggaaattccgacgaggcggatggagaggccagcgcggcacggcggtgttccggcgaaattcgggcaacgtggtggcctggccggggaagaggatggcgctgttgtgccgggagaggaggcgacgacgacagccgacgcactggcgaggtggcacaggcggctggggcggtacagtgccggcaacgccaccaaacgtcgacgaggacaccgatccggcgagtttccggcgaggatacggggaggccggggaggaggatggcgtcgcagtgccggggaaggcgatggcgacatcagacgccgcacgggcgaggcggcacaggcggctggagggtggctggcaccgaggaaagagaaggaggaggcggggagaggtggtgtggccacgggggagctcgggaaggggctaaaacgatagaacggagcgagggggttccattttataggatggtggagggagccgggcatgggagaggtgggaacggcggcagaaaagttggccggcggccatggaaagcggccaagattggcgcgggcgttccgggtgattaaaagcacgaatcaagaggtaattaagggggaaagagaggggagggaaaggggattaattccccctaatcaattttggaattagtcatttgaatcgagcggatttgagggagaagaaactagggttcacgggagagagagaggagctgtgcgggaggaggacgacgacccgggtggtggggcccacgcaggcgcgccgtcagcgcgcgtgcgacgcgcgtgcgcacggctggctcggctcggcctggtttgggccgggcggctgggccgagagggaaggagggaggggaggggcagcccagaaggaggaggagaggagggagtgggccgggaggggaagggtaggcccaagagaaggagggagagaaagagagggagagaaagagagggaaaaagggaggactttggccgcgggccgggagagagtgggaggacttcggacttggcccaaaggaggaaggaggatttatttttatgttttctttttagtaaactctgataattgtttttgttgcttaataatattttcggtgctctgaaaattcaagtaaaatttgagggctctttttagaccacgggaatttaacaaaaaatctccggacaacattcgaatttttcttgtacgtattttagtgtttgccaatttcttttcgaattttaattaattctattatttcttttagagaatgatttttatttcaggatgaatttatcacgggcatgacagcggcttctgtctgctgaaaaaaatttagaaatatacattttttccgtggaatttgtaagaaagtactgaacatgagaagatttgtgaaaatataccaccgtcgcggtttggtttagcgagagcgcggcgtcgcacgcgggatgcgtgagaacgagagcggtatcgctgtttagataagcgaggacgaagtgccggccgtctcgcggcttggagtaacgagagcgtcagcactctcgcagtatgcgttagcgagtgcgatggggcccagcgttgctaccagtttcctggcgccgaaacgtgagagcggcggcggtctcgcgcctgggaagtgcgagagcgagcgggtgccgcgggtctaggaaagcagcgacgggacgcgcagtcttgcacgaaggtaatgcgagagcgccgggcggtctcgcgcggtgggaatgcgatagcgccacacggcggtctcgcggagtgggaatgcgatagtgcacagcacaggctcgccactgcgccgaacacgagcgatgtgacagcgctgtcgcttgtctgatttgcgagaccgcgctttgctttccaaattagccagacggaaacagtaatgtactgattattaagttaattacttgtatatttgcatgaattaacaacatgtgataatagcattagtttttaaggctcattagtaaatatatatgagaaaccttctgtatatgtactacaaatagaacttccattatttaaactttgttatatcaaataaaaaatcacattagctacaaattaattgtaacatacaattagtacaaattaattgtaacttaaaattactacaaattaattgtaactttaatttaattttttaccgtataaaataattatgtctatctaatttttaaacccgaactgactctaagtcatataacagaaactacctccattatcattatcctacttaataataatatactatacattattaatattttatatttattaacttcatatttttatatttattgtttgccctaaggaccatgtagctttgcttcacggaagaggctgttgtcttgttcgaaatataaaatttaccggtctcgcaattctaacaaacgagatcgccggtcccatgcacgctgtcgcattgctaatgtgcgataccgtgtcggactaagcgccaaccagaaaatcaccatgggacccactccacagttgctcttgctctatgaaagcgcggtaccgagtccactctcgcgcttcaggtgtgcgagaccgcgggtcccacgcacatctcccgctcgccagtaatgccacaccacgggccccacaacactacggctctcgcgcgttgaaaaagcgataccgattccggtctcgcgagggcaatcagtgagaccgatgggcccattcctgctctgtctcccaaatcgcaagaccggattgggtcatctctacgtggcgctctcgctcaacggaaaaacgataccgatgcggtatcgcttacccaataagtgataccggagctgacgtcacgcttttgcttattgatattgcgataccgtgtcgatttcgctcagtcccgttgcgaacctcggtatcgcgctttcctcccgcgatttcgatagtatatttgtgcaaatcgatcggcatcaggtatatttatgaaaaaaatattcatgaacagtatattttcaaaattttttctctgtctgccgtccacttcccgaggtgtgcatcggagggccggcgcactggctgacggcgaaggcatcccacctccctaagacagccaccgcagtggcgtcccgagtcgacgacaacgacgtcactgaggtcatcttaacaggaccatgatcgattggtgctgtaacttaatttgttccttcatgcaggtatactccctccgtactcataattaaagtgagtcgtttagaataatatttaagtcaaatcttgggaaaatgtaaaaattatatgaacagatttgtcttgaaaaatactttcataaaagtatacatatataactttttaataaatatttttatagaaacaagaagtcaaagttatgttttagagaccgtgttgctgtccaaaacgacttcctttactagtacggagggagtatacatctgtatgaaaacttgctctctttttgtttggatatataaattccatgttatacccagttttagctgacatgacactgtgttagggtgaacccacatgtgagcagccggtctacctactcctctctcctcttgctctctattcgccatccctcccaggcttctcactaggtgacggtgggtggtgagcaacagggagaagagtgatagctgacaggacaggagctaggtggtagcacgtcaccgagttggaccagtcgccgaactggaaggtgacggatggcaaacaagaatgggcggcaggcttttggggtggaccatctcaccctcctcccccttcccctcccacggcaccttcggttccccatctctcctaggaaacaagcggcggccaaaaagagaggagcaaagcgcccctctttgccatgactcatcatctttgccgcctttgggtggatcattagtgcaaagacaaatggtggttcgtcgacatggtgagcggtgccatccgcgcgaaccaacgctcttctatgcccaacaaccactagttcacctcctctatgtccacatgccgacaggcaacgtagccaccggtgcctcctcggcgcaaagggtagagatggctgtctgccacctaggtggaagccgacgactagggtaaggatcactgcaacgggagctcgccttcgacgcctcttcccatgggaactacgtctccattgctgcttcaagacaacggtgggcgtcacaccggcttatgccgcaccctcgccttcctctgtgctcgagcccacgcttcggcctcgttggctccccgtctagacaatctttcctgatgtctagggatgggtaattcaatggttttgacatcctttaagtaacctatacaacattcgaattctttagtagtgtattcctctattatcgatctctataggtgagcacgattccgtacatagccattcataatagacatgtagcgctcgtatcccatatttgatgtaagtataaaggaccaagttcaataatctgagagacaatctaaacaattagatgcactatcatattgaaaaataatggagcaaaatacatctcaagctggcatacggtctctttcacaaatttctacaatggccccaactccaaagtatcaaataatttctgtgaaattcaatttaaaaagtaacatatatttgtgatcaccaccttaatctaaggtggtttgattgcccttatagtattagggagaaagacctgttagcatcacatgacagtcatgaaagttgtatctggatatggtcaaatctttcatcaagactagcttcctaatgtttgatgagaaaccagtagacaatatcaccgcatgtaaccatttgcataatgcattcttctcttctgatgttgtaaatggcaggaggagctcaatctttgcatcaggtagttccttaggttgaagttctattcttatagccaatttcgttacagtctatctttcgtcttaccatgttaatctttactactataattcatgaacctgtttccgcagaattttggtacgtcatccatgttcgtcttaccatgttaatctctactactataattctgcatgggtccaaactttcctgaataagacaatattttccaaccttttcttcactattgttgtttgagcctcctcgattctactaactgagctgacttagcttgatgcattgatcactgtagcacgtaccatcctcctgatgctttccaagctcaaatccaccatcatgagaaacaaaatcaattctaggtaattctttgttttggagaattgtgatgcatgcctactatgactgtaatagaatggaaaaggcacaaatggtgagacatatatatatatatatatatatatatatatatatatatatatatatatatatatatatatatatatatatatatatatatatatatatatatatatatatatatatatatctatctcacacacacacacacacacatacacacatacacatacacacacacacacacacacacacaccccccccctctctctatctctcacccacacatacatatacacctatatatacctatatatatanaaaaatataataaaattttaatcttcccacacatatatacacccccctcatacacatacacacacacccatacatcattcctcatatacatatatatataatatatacacaactttacacatatacacatatatttattctcctcattnctctaccatatactacatatatatatatatatatatatatatatatatatatatatatatatatatatattatatttttttatattgtcacttcaaatacgccatctagttacattatggcatagaagtgttccactcccgaagatccttgaattcgtcacttgtcactagggcaccctttgggtcaaagaaatctcctttcacatgacagcactcatggtggatgaagtggcacagatcacgctggacatttgtgatgcctgtatcgtcaaagcttgttcgacgttttaatcttggcaactgcatgcattgaagataaacaatatattagtatcataaatatgtgaagctgtctagtacatagtacagggacttacatcctctgcgttaaccctgtacctcttattaaccctaaggaattcgcacgggtaatacccgcaaaggaccgttcctcgcggttgcttgtgacacttcaggacatatcatagaaaaaaatagttaaaatttgcaattagtgaaacaattggaatacattaagtgagtggagtattaccggccaataggtacgtactagtagcttctcccttgttcgggtctgttctccacccttgaacttgtagtattggtacgcactgtacggatgtcgtacgtttcacattaagaaggatatttatttataatacattcatataaaaatgcaagagtcataatcacttactactgtaagattgttagaaattctttgtatgactggtgtctgttatcgagagggtccaagactaccacagttccgtctttaaggtagatgagtaaacagatataatgatcgctacatattaacaatatcatagttagttagtaccagctaaaataagacatatgtgtagaagataaatgtaccgaacttacttaaaattataagtggctatgactactctcttatttggaaagtgcaagaaggcttgtccaatatactgtgcgacaataatcaatttctccttgtgcaagcccttcttgtattcagctatctcttttggagtcttgcccttcagctggtctgaccctggtgctagcctcacggtatgctgtggttgacagatccgagttggatccaagaagccgataggttcttttttcttcttagcatccatgtattgcatcctacagaagaagtttgttagtaacaatcacatggatttgtattgtacatatttttcatataattaattaaaactcatactcacatgcacaaaacaccgacatagttgacgtccatcttatcccgacgatatatggcgtggagatctgagaaatctagccatacgtaaccttcggcgccgaagcaatctaccggtgatcgagctgttatatttcccaaccctttcttgctgacctccatgtagaaggtatgtaaccttctcatctcccatggtccttcatttagtgcccaatccggtaagagtgctttcccatgttcgtacttttccgggcaatcatcagttgccaagtttgttggcccggctagttcagtggccttctggggggtcatcatctctgagtttggcacgttccttaccacctctgaagacggttaccatgaacttctctttgttctcatctttggacttgaagtcgtggctcctaagcactctaggcacctcagaactggtagtggccttctcagggacaatggtctcttgcacctcggcgtcttttgtaggaaaagggtcttcaaatatttctggctctgtagtttgtccctcaggtaagtataggtctcgcaaccaatctatgaagagatgcttgtgttctttcattatccactcggtggtgtgacccttattgttagctcgtagtagttcgatatgttgatcgatgtagggctcaacgatagcaaactgatgaagtacgctgaagtgagcttcttgaaatgatttgtgatcatgggcgatgaatctcttctttcctatcgttcccctgccactctatctgccctcgtgtcggggcacaggtactccaattgcatatccatctttgagctaatcgatacagcactcgacaacctcttcagtactataaccctcaaccattgatccctctggatgtgtacgatttcggacgtaacccttcaaaaccgccatgtaacgctcgtatgaccacatttgatggaggtacaatgggccaagcacaaccatttgcgggactatgtgaacaatgaggtgctccatcatatcaaaaaatgacggagggaaacacatctcaagttggcactgtgtctcatgtgcgaatgtatggagattttctaactcttcgagactaatgaccttctgtgacactgcgttgaaaaagtagcacaaccttgtgataacaacctttaaatgctccggttttatggcccttattgcaattgcaagaaacacggtgagcaagacatgacagtcgtgtgaattataaccagataccgagaaatctttcatggaaactagtcgactgttgtttgatgagaaacctatgggcactctgacatcacggagtgacttgcaaaatgacttcttctcctcagatgtcagtgtgaaacaggctggtggaagatatactttgccattcttctctccttcttgagggtgtaactcttccctgattcccatctcgactaggttcatccttgattgcagaccatctttagtcttcttcggcatgtccaacaatgtttcaactatattgtcaaacacattcttctccagatgcatgatgtctatggcatgccgaacctccagatctttccagtacgggaggtacttaaagaatatagaatgcttcttgaatgggggagggagtttatcatctggcttcgaactatcatcttgcttcttactatcctctggtttcgtagtcttctcgggtttcttgcactttgtcccctttgatagtttcttagtcacttttccaaactcgcaaacaattttctgtcattgcacacactttttcccccgatgtaggttttggtgtaggatcagtctcttcagttccatcgaactctgccttcatcttgtggtacttgtgatttgtgcgtaggaaccgccggtgccgcatgtacacaagcttgttggaacccgggagatacctatagtacgttccattcgagcagatcacacatcctgttttacctttaatttgatctaaaactgaaaacattgctggataatcgttaatggtcacgaagatgatggccttcactgtgaagtattctcttaagtactcgtcccacactttcaatccctctttccataaatcagccatatcttccaacaatggttcaagaaatacgtcaatatcaataccagactgacggggtccctgtatgaggatacagagtagtacgtattttcacttttgacaaagccaggtaggaagattatatatggtgagaagcactggccaagtaatatgtgagctgctcatgtctctaaaaggattaactccatcagtactcagggcaaatctaatgttccgtgggtctttagcaaactctctatactgagcatcaaagtttatccactgacgagcatctgtcgggtgtcgaatcatcccatccttcttgcgcccttcttcatgccagcgcattagttccgcatctcgcggatttgagtatatccgtttaatgcggtctttgacaggaaggtaccacatcacaagtgtcagacggttctaggcccgtattgctattcgatttgtaccagctagcatcgcatgttggacattcatctaaacaagcatactctttcctgtacagtatgcagtgattaacgcacgcatgaatcttttccacaccaagtgaaaggggacatatgagtttcttcgcttgatatgtgctggatggtagtgagttaggcatcgggagcattttctgcagaagttctaacagacagtcgaaactggtatcagactatcaatgtctcgcctttaacctcataagttcaagaactgaccgtagtgttgtgaactcactgtcacagcccttcgactcatcatatga

SEQ ID NO: 10480 - DNA, 18721 bp, Oryza sativa
  unsure (1)..(18721): unsure at all n locations
cgaaggttcgccttccaaaatttacaatgcatcatacgtcagattaaaaataatcttgtctcccgaaattcgtggctaattctcttttaacctcattcatttttccaatatgagaacttaactttgagtcttggacgtgaattaaagcagatagcacaaactgaaattaactacatcttgtcttgtacatgttgtatgagttagtctgagccggtgcaaccaccattcttctttgttgttcgctgtctatgttctttgcaagctcgtagctaattggggttttttaaggagattaataagattttaatgaactactggttggtaccgacttttaagaatttaaaaaagctgtattttcagcttctaatttctctttcattttctaaattctacaactagattgaacttgaagaagctgcaactgatagaagctcctccaaacaaaccttaagaattagcccaaacttgatcgccgttgagccaacacgtcttcagtcttacctgctatggatgcatgagacgccttcactctcgatgctggtgccacgatgtactgtttgctttgtttcgtgcctttgcttctgttgtcttggtcatcctgggagcttcctcagagcctcagagtagggggaacctgccggctccagtagatagggcagccacaatatgtgttgctggtttcatcttccattctacgggcttgggggttcgtactcgacttaccagaaaatacagcacttaccactctcctgatgcttcccaatcttgcattcaacttaagagaaaaaaatgttggtttcacatcaagggcaagtagaatgagcgctgattgggaagcatcaggagagtaaaaaatgtatagtcccaatgcatttatggtctctgtgacaaaacgatccagttctttttttctgaaaaataataagtctagcaagtgtgaaaaaggtggtaaataaattgagtgatttaaatcacatctagcttgcgtattagagcatgaaaaggaaaaaaatgtggtaaatagattaagtgacttaaatcacgtgtaaaatctattggattgttgaactaatagctagtgctggttccacaactggcactaaacttcgtacactaggagtgggggttatcattattagtgctggtttcaagtcgaatacttcctccgtcccaaaataagtgcaatcatggttttctgcgtctaactttgactgttcgtcttatttgaattttttttaaaaaaaatcaaaaacataagtcacgagtaaagtactattcatgttttatcatctcataaaaataaaaatgctaattataaaaaaatttgaaataagacggacgatcaaagttaggtgcgaaaactcatggctgtacttattttaggacggaggtagtacatataacttgttatggccaaggattcaaactggagacctctccttagctagcatcaccttaaactagctcacctacaaatcagtttactataaaaaaacgattttcctgtacagggacccatttatattgcagatgaaccatgactagtcgcgtttgggaaaataagcttattttcgcgtgcggtccatttaagaggaccgcacggaaactgagcctattttcacgggcggacctattaaaagtgccgcacgcaaaaataccgactccctctttccctcttacccactttaaattttcccctctttctctcctttcctcgctatgtctttttcttctctcctctcctctttcctcttcccagtcatcagtcaagcggcctcacccatctgcaccctcttctctcctcccgacggcagcggtgggcgtaggcgatggcggcggtggaggagcaggatccggcgggcggtggccaacccctgcacggatccggcggtggtgaccgtccctgcatggatccggcggccggccggccaccctccccccgcgggatccggctccctcccctcctcttcattctctccccagatccggcgaaggggaggggtgtcggcaacggtggcactcggcagcagcggcggcgtggcggcggtggaggcgtaggatccggcgggcggcggccaacccctgcacggatccgacacagacgacagtccccgcacggatccggcggttggccatccccacacggatccgacgcccagctgccctctcccctgtgggatatgactcccttccnttcacctcccttccctccccagatcaggctaagggaaggggcgtcgncgncggtncgnccggagcccggaggggagcatgtaggccggcgagagggcagatccagcggaggccggcacggaggccaccgctgccgccgacaagggcgggagcggtgtcctcggccgatgacgacgacgacgaggaggcagcagcgccgccgccggattctaggtttttcatttgttttgaaatttttttttccggatttttgtttttacgtacggatgatataagcatctgcacgcggaaatcgtgatttttgcatacccctgggtgcgtgcgggtcgctcacccgcacgcgaaaatctttctcgtagtagtggttctgatagcaaatagatatttttccttttgagttttgcccaacagatatttgaattgtggagtattatgtttgaaagatctcaaatgaaaaggttgtcaacaacaaaatcatcatgtcgatagctataattttcatataaaatttgtctcaatccaagtttgtttgaaaatattaagtttacattcaaaatcggtactaatatagccagggtcatcattgctaatttgtagctagaaccgacacatgcgagacactcattcattagtgctagtttatagctagaactggcactgataattaacacggactcgaattcgaaaatttttacaaccaaaaattcttattagtaccggttctataaactaataggcactaatgtgtgggatactagttgtggcttgttatacatattgacgttgattacccccccataatcagtgccaattaagcactagaactacttacgtcgtcatcggtgccggttcttccttggagaagtttcacttggataacctgaaaagtgatgctccggaataggggaaataggaaaagtttcacggcaaacgaatcttccctatcaaattttatttattacacgatcaagccactatgaatggcatccctagcaatcaaaagcgaattctgatatagcacgattaaatttgttcatttttatgatataatcgtttccacaccgttcaaattccagtgctggttactggcttgactaccaactcaagtgttctatccgttctcatcatggatcaatgaatggctcttaacactggattttcggtgcctcccttccctactatgccgtgtactatgtccaccctagtactattgatattctagtgtttgctcgtaacaaaattggatctttggtattgatgctgacgattaatttttttaagacagatagttctgaccattaggtgatctttggagcccagccctgattctcctgctgtggagcgttggaagggccttttgcactcaagctcctggatttgcatagaattttttagctagtcagacatgtctcactgggattcaccctggacagctctagtgctctactgcactcgaagaacatagctccctttctcgccgtcttgctgtaactgaccagataccttcaacatgtgttcctgatacctccatttcctagcagatcgatataatcccttaaatgtttcacgtaacatagctcgttagtcccgctcaccttaaaatacttcgagtaataattccttaatagaatatttgattattggtcgtgttgatgtactcgattttttttatattggcatggacagaaaagccctccattatagatgctgaccgctttaggctgcgttccccggcacgtaaaacgaagcatgtattattgcataattaatctgagggctctagcccaagggatacggttgcaacagaatattttaagttactctcccttttcctttcctctgtccacgtgtgctttctctcccttttcctttcctctgtccacgtgtgctttcctagtacctggtacctgatacatggtaccggtcggtatctggtacctggtacctttgataccaactaggtatcgaccgatacctgatgcccggtacccaagataccgggtggtacctaggtatcagaccttggtaccaaggtatcaagcctgatacttgtgcggtatcagagggtaccgtcaaaaagaggaggatacgtgggggagggagcgccgcaacggcggaggatggcatcgaggaggcacggcgaggtgaaggacgtgtgctcccctagtacctggtaccttaggtaccgggttggtacctgctacctggtacctttggtaccgactaggtatcgaccgatacctgatgcccggtacctaaggtaccgggtggtaccaaggtatcaagcctgatacttgtggggtatcagagggcactgtcaaaaagaggaggagacgtgggggatggagggctgcaacggtggaggatggcgttgagaaggcacgacgaggtgaggggcgaggcccgagccagagagcgcgagaagtctcgaggaggagccgaggtggatgttgacggccatacctgttgcaggtcgatgtgggctgccggcgtccatcccggaggcgcaaaagtggcaggctgcagcggggacgacggtgacgccgaggctgaggacgagtacgaggacgaggggagctcctgcttctgccctccccggggcgacgactccccggcacacacccgaccgacgagggtggcgagccagcgcaacgaggggaggcgagctcgagggcgaccccgccgtgggttggctgacctcgccaacgcagtgccgtcatcgtcctcctcggcagccggagatgacgacgatgaccccttcctcccggccggcttcgtctccgctcggccttcttcagagagagagagagagagggggggggagagggagagggagggctgcaattctgtgtgatttgggggaggagagtgaggtaggaggagaggattcggatgattttggggagaggagtgaggtaggaggagaggatcctgtcttcatgggataccgtggtgtaggttttctgttaattaaatattaactattttttgaaaaaagattaatatgtttttttaaaatagttttgtacagaaatttttttttaaaaaaaacactgtttagaagtttgaaaagcatgcgcacggaaaacgagaaaggtgaattgtgaaaactgggggaagaacacagcgtccatggtgtgtggggtgcggttaaagcccatcacggatgaccgtcctccatggtgtgctccatcatcggcagccggcaatttgcatagagtgccacaatctccaagtctgagaaaatggattatatttgttgcttttttttcttttgtttcatgattttgaatgaaattttggtccaattcaaaatttagtttgaaaccctttgacaaatttctccaagatttcactatctcggacctggacgttttgtttttagaacaatagtgttatctagggttaaaaattccaaaatttcggttctatcagaccacccccccgtatggtattattgcagccggttttctttttttacgaatttggcaatatttttgttcaaatttaaccaaattttgttcaaaattcaaataatttcggtatatcggcgccaccaatacaaatgccgaaaaaaaaatattgaacccggtgttatccacggtgaacagaatgatctttttaatttcagcaaataaccagcttgtgcaaccgcaattctctcttgggcagccgtcgtgggatcagacctcacacagtcacattgtcgcacacatggaacgacacctcttctgctcaaattggtgcttgggacatcccgaaacacatgaaaactctgatgcagtgtctcgtttttcgcctctcactgtcactgggttggccagcagcctgcgcgctgctacgggtcatggaaatctgatggctccgacaggtaagattggtgccatccctcgacagattcgtgagctcattttgggcatggcactcgagaccccgccttgagtccccactctgaccaaattctgttgacaaatgggaagggagagcacatagcaatctcccaatgcttcccatgcttacattcagcacgaccaaaagagaagaaaaaaaaggaatacttggtttatgagaattgtgagatgtgaataaagtattgtaatctagaacgaatggcaggaatggtgagatgcctataggtatcatattcgcatacatatgtgtatatataactcaatgtgtttatgatatctaacccaaaatattcggtccagtaaatgaccaccttgaaagctgcaaatattcaaccacttgtactttctgcactttataactatattttgtgtattggagtgtggaaaagaaaaggcataagagacatgggcccattaactgagacactcaaactaagcgtttgtgtaagtcacaaaagagcatagggtactactctgtttacatggagaatgaattactgaagattttgtcaaacagttatgcatatcaaattgattgacaacaacagaaccaaacacatcctgagaacaaatatttccagttccatctaatccagatcttggcttcttgttgtgtcttatttcgtggaggaagggaaagaccccaaatccaagtgctgagacctctcatgtactgctatcatgtagggagtagcatacaatttacagatactgttgtaaaacaagaaggaaaaatttattgtaccttcctcttcctgtcatactatatactgtactgtagttaccactaattaatcctaatatgtttagtcaatgttactctctccgtttcacaatataagtcattctaacatttcccacattcatattgatgttaatgaatctagacatatatatatatatatctagattaattaacgttaatatgaatgtgaaaaatgctagaatgacttacgttatgaaacggaggaagtataaaatttctccaaacatgcttgccaccacaccagcctgcttgctacaaactatctgtaatccttttgttttttctttttttttactaatggatattgccttgcttcaatataaagcaaatttgagggaccgcctattgatcatgtcaaacaattaattcataccttggtcgttgatgaattggccaaacaacctaagttcttccggaaagacatggctatatccagagtggtactattttccaaattaaaactggaacaggagttcatgcctattcaccatgatatatacacaagcataaactatccaccaaccatccgaggacagtatggaaagtataatccgaacatattaataggtgaaattcgaatcaaatatttaacattcctagcgtcaaatcgtgtaccagatctcatccaaacattacatcctgaatgcctcaaatgcatatagtttcctagacatagaattttagactatataagtccatgtttggcacaggtccagatctcagatccacaatagatttgaaatttgtgcgttgaattatagtggttcaaaatttcaaatttcatccaaaataagaacaaaacgatttatccaaatgttatcaccgtaaccgtagatctagattcttggatttgtggagttaggaatacattggattcagagctgtgtcagaggggtctaagaattcaggaaaagcaacctcagtggtgactgcaggtgacatgcatccaccatgcaagatggagttgaagttctctgttattcttcgagacactgaaagcacgcttagtcgaagcgaaataagccaatgcgggctagccacagcttggtgctgcgagtgtcgaaagatcggtgttgcgccctgttagcacatgaaaccttgactctcgctcagagttctcggtgcctcccttttctagctactgtgtgacttcgcgcgcgtgtactgtctacctacattagatgcatgatggtattaggtgtcctcatcttcacattctttgctgatttttcatgcaccttctactggagagatagagaaacttgttattccgaagccttagctagatgagaggaatgtggtggtttattgatcgcgcgaggaataatgagtacatctatggcatgtgctatatcgatatgaccttccgcatgtatatacatttggctcgtagtttggtcgttgtgctaatgttaaaatcagaactagaccagctgggcggtgaggtacaaattaaaacgttatattgatactgttttgatgacggcacatggcgattgatagcaacgggatgcccgatattccgttaggtaaagataactctcgatttggtggaaacttgaaacatatgatctgaaccctacaatcgtagaatcacgtttcctctggttattaactatgccgaaacttgattgacctcgccgagaaggctaatccctacgtgcgaatcgaaaaacacaagaaaaacaagatggattgcaactcaatttgcagataaatgattgagttatcaaagatagggttccacataccgaacttgtggccaaactgcaatgatagaaataagggataagtccattttgcaccctccaactcttcgcttagtctaaaatacaccctcaaacttcaaaaccaggtatttagcatccttgaactttttttttcttgacttaaggcatacctgaactttcaacacccattcattttaccccctcgagtggttttcagctggtattcacctgtgtggcgctgatgtggtggtctaatcagcaaataaaaacaaaaataagggatagacatctcttcttcttcctccatcttccatcccctttctctccttcctctttctctctctatccttcttcctcctacgctagaagagcagcagtggtggcgtccctgttaacatccctgagctcgacgaggagagcagtggcggtggaccaaggggttcattgcgaaggtgggaggtttttccttgtacgccattaagaaaaatggtgtctgcctctgtgccactaaaaaattcgagcccccctctataccatcgtcaaactttatcgtctcctccacaccattccgtcgctattctgtttcggtttaaccatttggcagctctgacatgtgggcctgggaaggaaaaatatcaatcttgccctttcactctctcttctccctcgattccctttttctccctcaggccgccaccacgcagggcctaccggcggccggccaccgcccagccctcggtctggtcgtcgtcgtcgtcgtgatcctcgtcgtcggtgcgctgttccccatcctcggcccgaccggctcctccagcttcgccatgccgcggatccggtggagttcaacgaacccatccacgttgcggtggcggctccacctcagccaccgacgcagatgcaagctggcgtcaacatgagcagcaaggaggacagtggcctcccgccgacaacctccgccttcgccctgacggcgcgcttgtcgtgctccacgtcccgccgccgcagagcatcgccgcggggctcaaccctggacccatccccttcggcggcccgagtaagcaatctctcgcactcgtcttcacggaaataggacggacacttggtcctgtggctcctggatggcttcctggatgtgccgcatggctgatcaggcgaggtcggtggcatcactagtagcaagcatcaatagtcctcgccaccgtcgttgtgctggtcctggcatcactagtagcaagcatcaacagtcatcaacaccactagcaagcatcaatagtcctcgccgtcgtcgttgtgctggtcgtcgtcgtcgtcgtcgtcgcggcgctgccgcccccccatcgcgcagcactgccgccgccgccgttgtcgcagcgccgcccccctcttcgtcgtcgtcgtcatcgcaacgttgttgccgccgtcttcgtcgcgcagcaatgccaccaccatcgtcgtcgcagcgccgccctgtcatcgtcgtcgcagcgccgccctgtcatcgtcgtcgcagcgccccgtcgctgtcacagcgccgccgtcatctcccctcccgctcctttgctgctgctgctgcatctaaggggagagaggagagtgctacgagagagcatattggaccaaagggcaactaagtcatttggctgcgccgttacccaccgttataaccaaaaacgaacggaatggtatggagtgcgcgataaagatcgacgatggtagagagggaggctcgaactatttagtttcatagaggcagacaccatctttcttaatggtatacaggaaaaaacctccgacaatggagccggagctcaagctcctccccgaccctgagttcccacgtgcgtggctctggcgatgtacacctctttggcgtggtcgacgcattaggacccctctgtcattggctggtgcccccaatgcagtggaaggacttagctcgagcggggcagtcgggtagtggcacaactcgcggacgccaacctcattctagatctggcaatggaagtggtgtgggcgacgacgagctcacggatgccaatgccaaatttgttggcgagctccatccatggagccactctccccctcccccccaaccctgaatgcccgaagctccacacccttccgttgccggtaacaccgctcaacaagctcgagttgaaggcggggacgatgcaggccgctccaagcgagctcacggtggggtcgatccacatccatcaaccctcgtcggagcttgccagcgaccccatcttctttgtaatcggcaacccctcttctccaacctcggcaaagggggcgggctccgatacgcattgagctcgccatcaacctccctcttctccacatcaatctcaccgccgacctccctcttctctcaagcacagcgagatctccatggccgcctcaagctcggtgagagagggagtcgaaagagcaagggaggtgaaaaaaacattatgataggtagggcctgctaacattgcatcctggagtataaccgaggtaaaaacaactctagggtgtacagtgaacgatattgaaagttggagggcgtaaaatatccggttttagagttttaggtgtattttagataaaatgaagagttggagggtgtaaaatggacttatccctagaaataatctaagtgaaacccgactctaaatgatgacggctatggaataaatatgattagggacgtccaaaggttagccctagggtgctacccccttgggttttgtccatgacacgattacaagtccaaagacccaaatcagactcggactggattaggtatgtgacttgttttacataattccgatagctaaggaggaattttaacgtgggaccaaaagcatatgaaagtagactcaataagctttccaacaaatacttatggtcccaaaagttcttctggattagcagctatgtccgtttaagggtaatgctgtcaggagtacataatcctaatccagtatatgcataacttaatctcttaccttctatggacaaaaaaatcacttaatctcttaccttctatggataaaaaatgacgtggtaatattggagtagacttgggcaagatcttggtttagccctaatcaacttctttgactatccatatatattccttgtgttcagtctctatcccttaaccaaacaagtctggaaatgagaacacacaaaacttacagtacaataatgcttattcaaatatactagccatattagtcgcgctttgcgcgactttttacatacccgtataaatgctctgtacatataaactgttacatacgctgatggtatggagcaaagcagttagaagcttccccatggttaagcagcctaagaacatattagtctcaattttttttgtactgttcgatgcacgagatgtcatgctttttaaatatttggtttgcagatctcattggatagtgaaataacagggtgattacaacgggtaaagtctctgtgtatctccggtttttatccaatctggtattgttttgtgctgacgaaattcctgtccggttcttcagagtgctgaactgcagtaaaatgtctctattgtgacttgtattgatgtctactactcttctatacaaaaatagcaataccaacattgtaaaagaagtaccttctctattttgtcatcgtgaatagatatcatgtaggcaattgtcaggaaaaataattgagctgcacctatttaatgcccaatgatctgaatgatcaattttgagttagtgagaaaattttcgatgattcaatgaaatattattgttagaaatatcaagaaaggatggcatataatctgccctcgttgtctctgtcacatccgtgctaattcaatgttgagtagtgcagtaagcacgtccacggaggttcagaaaaggttgattaccttattatgtagtttgaaaattgctttattgctctgctgcaaccatcctgcaatttgtatgcccaacaattacattggaaacactgacttttaacaatacatggtgagatggaacctctgcagcttatagcgcctgaaataaaaaggtgaagtatttagtacttctatcacaaacaacttgaatgagggattcataacctgcatgatagctctggatttccactaagatgcatgtctccattcacaacatgagttagaaaagaaaattggacaattcgactcactgtgatacacaccatgtctttgattttcttaaaagaatatcactttgcctatatccaccaaactccaggaacacttcacatggcttctctgcaaaaacatgcaatctgaggtggatatataagaagtgtaatcagctattaccttggcccaggaccaggtatatacgtacaactgctaccagtgtgttcatgctgtagattgccctgaaaaggattatgcatgagagagaaattatgtaaacaaaattaggtggttaacaccatgattttataagtaataaaccaattgcagaaacactaaaagacaataggagaagatgcttagtagattcgaactaaaagaccatttatgctctggaagggaaggggcataggaaataaagaataatggcatatcaagcaaagtagcaaactatcctgttaagtataaataatgtcatactctcaatatagaggcttcaactatccatgatccgccaaaaaaaaaacaaaccttctcctaatgcattgtatccattggttaattctggatatggcttcagctttgttcaaaagatctacaaatgacagccattactggctacaatgaatttgctgcttcctaatgaaattattgatacaaaaaattacatacatcaaatatattgcaatcattttgacccatgctcaagctttgcagagaaactcacgaattacataagtaggggttaacattgtgacactaactcactctgatgcaagaataatcctattaaaaattcggatgactatatgaaatcaaaattaaacaacacattttcctattttttatagaatttcccttctattgtctacacaaaggttcggacaccttcatccgaaacagacactaatcaggacaaactcatggtgatattcagaagtagcaagttgcaattgttgatgcttcagctgaacataagcatccatattacaaatccaaatactactacctggtagttcctcaactgtactcaaattacttaatggtaatctacaatcgtctctggccactatcggatctgaagcattgttcgccacaccggcgttttgggtcttcttgagccggctccatcactacctccctctggtgttgccagctccaagccactaggagacatacccatggaggaggagctggagagcggccaggagggaatgaatcgacgcagtggcattttggatggaaaggacaggaggtgtggccgccgccggaataggggatcgatggaggatactgtgcagcagtacagatgaagagggggccagcggtggtgatggggtcttggagaggagtcgatgaggcagcggcagcggcgggtggctccaaggtcgacaacgacgatgagtgcgagacggcgccgcgagtgcgagaagacagagcgtcagggtgggtgcctcacggtgtgggaggaggaagggtgaaaatgaaaaacaaaagagttataaggatgtgtaaggactagaaatagataggagtttcctcaagggcctagaatatactatgccaattataggatccaacgaccaccaacgtctagagtaagaatcgaacggcccttattactttgatgacgtggcgcaatatggtgacaaaaaactttacttttttcactactttagataacacgtaagtctcacgtagaacatatacatttttatttttgatatgtaagctagccatgttctcatcagcgattttattttgtttaactataaatgaggtatgatgggtctgaacgtgttggtcacccacaaccttgtccctcgccctacacatacatgtgtttttatttacctagatgtgtttttatgtttgtctagatttgaatttcttaaatatttttatggatcgaccgaaccacatttctttactataaattggaacatgtttttggcacaaggggaaaactaaatacttggatgttgatctatcggttaaaaaaatgtaactgaactgcagaagaacttgccactcgtgctgtgagttgttcctcttgctaatgtagaaatgatcgctaatgttcctgtggtattctataaaatatatttttcgtcctgctcatggaggacagagatcacaaaacattttaaggagaatcaattgttatcctaatatgatgattacacagtcttgagtagattgtgttatgtttctgagaactttcaatattagtatatatacatggcaaattggcaagacaaaaaagtttctccaagcacagtccttgtggttagaaaatttctcatagcatctgttttgccgctacgtactcatctgctgttacaaccattcagttcttggctgatgtagcattgaacttatttcttccaatttggttgacagaaagacacatgttggacaacggtgtattcatagctacattgccgtgccattgtaacgtgtactctgaacataactagtgcacggcaatgtagtcctggaacaatcaaatctctcgttgggccaactaaggctgacatatgactaatcaaaattaacaaatgcagtatgaatgaccgcaaatttcccatgattgtaattgttcgagttgcatgatgcagttttgtcggctaatccggttaactgatatcatattaaataaaaatgacgctccttaattagtgatctactatcctgtccctactggcaagacttaattaattatcacgcaccatgaatcatgtagttttagcttctgttgtgttttggaacctctatgtatatagaggcatcgcctgaacacgaaagggcatgtagcttagtggttgtagtgtcctgagtagtattctaaggttttaagtttaaatcttcatagtagcaaatttcagatggggctaagttcccaattttgaatgactgcatatatatatatatatatatatatatatatatatatatatatatatatatatatatatatgtagaggccgtgtaggcatatattctctaaaaaaaataaaaataaaaaggtaaaaaaccctctaaaaattaaaaaaaggcatcggtcctgagtttaaatggctgcatatattcggttcgatgtagagaccaggtaaaaaatacccttctctaaaaataataaaaaaaaggcaaaatggctttctctaaaaataataaaaaaagaggcatcggtcatgagttcaaatctgtatagtagttgcatttatccgggtggatacggagaccggctaaaaaatattcttctctaaaaaaataaataaataaaaggcatcggtcctaaattagccttcactaaaaacaagcacgggacttgagttcaaatctccatagtaatgaatatacacagccaaattatgtaccacttacttgtggtcaggtcttggaagtcagatgttgcgctttttttttcctccattgttagggggaaattttttgcatgtttcacatatgcacgtgctgtgtccttttcataaccagaataggtttctaataagaataaccatgggctaactgaacacaaattctcaagcttgaatatccttatttttatgtgaatccctagtgcctccatttcctattgaaatactctagaaaacgtcacttttaatttcttgttcaaaagataaatagtatttcctcatagtgtatagcgtgactggcttaggatgctctatatcgtgcgagatatcggatgcctctggtatttatcacggctctcaaattcagacataactactccatgatgatagtacatgcttttcagaggtcaaatttctagtcaaccaagagtggagtgtctaagtaaatggactgagaatgactgcaaattttttctactattgtaatgcatttgcatgaggcagaccaacccagtactgaacttatgtgtgctaacagatcttgaacggtttcgttacaaatcattttcatgaaaaatccacaaagctctcctcaaagcccagtaccaaaatgtacctataactactacctctgtcccaaattagtagtcacttctgtcccaaattagtagtcgctttgacttttttctggtaacgtttgaccattcatcttatttgaaagtttagtgtaaatataaaaacagagaagttatatttaagtatttttgacaataaagcaaatcaaaaaataataattccataattttttgaataagacgaaagatcacaagttacaagcaaaaactcaaagcgacaagtattctaggacggaggtagtacctcacattaattccattttcgtagtgcttcttcttacatactactagtacctttgttctagaatacttgtctctttaggatttaaattttgtcgtactacttgtcccatcaatcattttctactcaaaaattttcttattttaccctcaataaccatttcacttttcatacattatttaacaaggggtattatagacttttgtattaaaccttaatctatcctaaacaaactagaatgacaattattatgggacgtagggagtaattgtaaagttgtagaaaaaccatatcacaaatgtcaacaatatgtgatgtcacaacaataggtttttttttagagaagggtaaatttacatggtctctacatttaaccggatatatacagcctatatttattttaagagaaagctaatttttacctggtctctatctaactgtttatatacatcattctttaattgggaatttagcacatcaaacagggaacttagccctcaaataacccaatttgaaaatcgctcctacttaggaccttgggtgctactcaggtcactacaactattagactatatgccctttcacggagtaggtattactgatggacctaatcactgtctaattcatagcatttctggacccagtcttctctcctcctatgaatatgtttttcatgttcctcttccactcagatttctctcacaattgtcgctctaaccacccatcgcaatgccattaccatactctcaaccaaaacttgggaggccatgtctgtgggattgccaccaaacattcgagccttgtagcaagggtctaagtttttagcctataacatgtaagtgctgactttacaacggattgggcagaaatgtagtagtttttttttaaaaataaaaatatttaagagttgatgtgggttatgaaaaaaaaatccatgggccttggcccattactaccctactggccttcctagatcagctggattaattggatgaaagggtttgcgaacggaaaagtacgaattacccctcccccaccccgaactattgcggtcatccgaattacccccaaaccacaaaaccggacattcttcacccccaactatacaaaccggacgaattacccccctcgacccaatccgtggtggttttgtcctacgtggcgtacgcgtggcagtctaatcagcattctatttattaaaaaatgagggacccacctgtcatacactcatactctctctctctcaggaggggcggttgggcgccggtgtccagcgagatcgagggtgggcgggaggcagcagccgtggacgagctagccggcggcggcgggtgacgcataggaggcggcggcggcggaggatgaggaggcggccgcttggcgcagctttcccccctccctctcggcgtcgtgcgggcggagcggtggccgagtcgcggcagccgcggacgagctggccggcggtggaggtgggggcgccgtcagagcggtgcggcggagggggcctcgacgccggccgtcccgccgccctcgtccttcccgcgcgcacgccgctgagagggagggggagtgtgcgggcggagcggtggccaagtcgcggcagccgcagatgagctgccccgcggtggaggtgggggcaccgtcagagcggcacggcagagggggcctcgacgctggccgtctcgccgcccttgtcctctctgcgcgcacgctgc

SEQ ID NO: 10481 - DNA, 12255 bp, Oryza sativa
caaaaccaccgcggattgggtcaaggggtataatttgtccggtttgcttagttgggggtgaagaatacccggttttatggttcgggggggtggtaatttggacagccgcgatagttccaggggggattcgtactttttcctttgcgaatttgcgatgattatgaggcccgggctattgctgctgactttgtgccgatggatcgaatgtaagtaccattttttaaagataatggaagtaaatccagtctttgctcaaaagagctataaccacttattacacaaactcgctcaacagtgatcacacaccataatgtaagtacctaaccaacaacaccgtgcttatatgttatttccataattagtgattttatgacgaagttgtttggtccgtggatcttcagtttcgcttacagcttcatgatttctttaagggagttcatcttataccaccataggtgggcaatagtcttcctgccccgctggatgatagcagtttcaaccggtagcatgaaggctttgttcgcactaatgcgtgccaaaactacatagggcatcagggtctatgtatgggctttccatgggccttgccttatggcccaatgcccatggcatgtaaatatgtaacatctccattcctgtggtccaagccccttcgacatgacaatactcgatgtgataagatgggaggtatagtttttcaggaccctcatgcatgtgtactctcctatcattttcctgcagtacctgatcttatccccgttgggcaatgaggagcttgaaattgtgttcctggcgcctccctttccctatgtatggatggacggtttaagagcttgtttgtttgggtaaatggggatttcttcaatccctacataatggcatgaaaactcgactaaagaagacatcaatctgcaaagggtttgggctcctatgtgcgtcgtacatccagatcggagtctgttgaagacgtcgtctctgacattgtttcttaagagttctatatatatcatagaagagccagctactagatgcacctatggtatttatcatggaaggcaatatcacaacgtaattaactactccaccaatgcaaccatgcttttggagacacatggatgtatagatggctatatggcccgatggcccgcccaaggcccggtgattttggcccggccaggcacctctggtcgtgcctgtgctggcccggcccaacagccgtgccgtgcctaggtcactacctcaacacgctgggccggcacggtccggcctgaagttcagggatgcgaaacagacttattctcaaccatatgtaaggcacgtcacaaagaatagggaggaaaaatatatttattttagctatatatatgtcacggccgaaagaggagggaggggaaatagagttattttaaagaagacacgatgggccgtctgtgccttcgggctagcacggcacggcccgactattggtgggccgtgtctgggcttgaggtgcagcctgtgggcgggcacaccacggcccaatgtgttggtcaggccatgccggtccggtagaatctagcccgagcacggccatgcttgggccgtgccgcgcagatgaccatctatatacatggatgtatttacttaaacatttttttaggtgatcttgcaaaaaaaaaaaagccatgtctcaagtgcgagctagcttcatggactcagaattaacctcatatagaggtgagcatgtacatctccgtaaactactgtgtattagtataaagtaggactcagtagtaagcaggatcattttatcctgtttggttttacgacatcaaacaatgcaatatacagccaatggagtttgaatggtttcaatattaaagatcattttcatagctctcccagtcccaaatgtacagcctgatattccaatcgtcgtattagttaatttattgcatcaatttgaatttgttaaaaccggtatcacaaacgccaatgatgtcatgataagcatagacctccaatctgtttgcttgatcgactaggcattgctcacagtcacggaccttatcacttacacactgattaattcaatattagcaaacgagttttttctttttttgaaacgaaatttgaggcaacgcccaccgtccgtgctcacttttgacggaatttgaggaccaaaccgtgtcaagattttgctgcgttacaacttgctttcgacgagtaatggatgtccaaaaaccaacatactcactgggacttctttattggcaaatgaaaaacacttacataagctcttcagcttggtttcaattgactgggattttagttcaattttgcttttattatgaatggatcctagatactctcaccaatttacaacaagctctctgagatttcatcgatctgtaatagacctatttagtccattatatccaagaaggttactgtgatatagtcatgtttatttttactagaatcgacagatcaaaagtaatggaaaattataaactcccaagattatgattgtgatagaccaactgagtggcagccaaaacaagctctgatgactcacagccttgtcctgcatttctccttaatcaccatcaggagatggatgttttcagttccttgcgctgcttgagatttcttctaggctagttcatcataattgcacagtgggatatcctcattaacactatacattctgccaccacagtagagcaactctctcccacaggcaatggcttttctctgatctccaactatgagcatcgagcatcacagtttcgtgatcttgcacagacaaagtatgggtgggcagatcattgaaaatgcttgctgattgaaactaacttctcggtgcctccatttccaactaggatgtaaaactatgatccacaatattcctctaccatatccagcagtggtcttcaaaccattacagaagggagcgcctctgctatttatctttggttgattattctttgtacaattttcacagatcggattaaataaagtcatgaacgaaatgaacctcgaatgacgacacatgtgctgcacaactatacatggccataaggcccgaggcccgacaacccagcccaaagtgcggccatttggcccggtccaaacacgacatggcacgattggtgtcagacccaagccagctcgggccgacagttgggtaaaatagacttattttatagagaaacacgatgggcgcctgtcatgtctttgggctggcccaattcctagggccatgggtgtagcccgtggacaggcacgacacagcacgacgtgtaggttgggccatgccgggcttggtccgggtggcctatttggctatctatatgcacaacaacttacatggaataaaacacccagcaaattatttaacttgacgacaacattatttgcacattgcaggcacactataaaagttacacatttaaagagagtttctcgtgtgtgtgtgtgggggggggggggctgaaatctcgaaaattttgcgatgaaaaaaaataaatttaaatagaagtaaaatagtgaactttctatcctgccattattcagctcacagtagttcggatgaatacgaactaatggcatttgttttgacatatttggtatgatgagatacgttttgaacattcataaaagttgaaagcaggtcttctgaggtaaaaaaatgactacatttaataaattgtaattattagatttggtcgtattgtgtattatacaattatacaaggaaagtaaaatacaggtgccttgatcacaatttggtgccaactgctaacactgtcgggttacaaatgtgctccgttttttttggtttgttttggcaggaacagctctgacgagagtgttgcatcaggcccccgtcatgtcggattggacactaattagaagtattaaacgtagactaatgacaaaactcattccataacactggacttattcgcgagacgaatctattgagcctaattaatctatgattagcctatatgatgctatagtaaacatgtgctaattatagattagttagtcttaaaaaatttatctcacgaattagctctcatttatataattagttttattattagtttacatttaatacttctaattagtgtccaaacatccaatgttacaggatccaaaaaccacctgatgaagtaaaacttctccttttatgtttggcactccatttacattttatatcctctctgatgtcttaattatggcaaaagatattcctgtttagacagaagttatcctgaagcattcatccaattcttagaactatttctgttgtcattagtgacattagtgagtaatgacatctgttgtgcatagcattttccatggagcagaacagggatcatacacatcataaagataacttcataattatctcggtaacaacattgttaccgccaaataaaaaaataacaaatttatttcatgttccatgggaagataccagaaggcaccaattattttttgtgtaaataggtatcaggaggcaccataattaattaacactaaaaagtatggtactatctgatgtcttccgagactagtttttaggaaaaacctttaacttcttcatgtagaagagatcaactccataaagaagttaaaagtttttcctaaaaaaaagttagagctaatgcttcaggtttagagaccaaagaattacacaattgaatcaaatcggaacgctttctattattgtcgttaagcaaatcctgacaaaagttgaaacaatagcgacttaaaaaaaatgactatgcagcaaaggagtacatcacaatacaacacccataaagctgctaaaatatttagatttaaaccttccttataatatatacttccatttcagttggttgttctagtatgagaaattttgggaaagagtatattagatcatttcaaattcatgaatttctaataatccctgtgtactcagctagtctggtctgatcttggtcttgctgttcaagctacccactgctctgcgaccggccatccattaccaaggctgtctgctaccaccaagcatccaaaggtgaggcaagtgcaaccgtagggcttgcaaggacatatcttactgtcttgtatagttgtaaggtgggcagtatcaatccccttatggctcaagcagtctagaacagccggaagcacaaccctgtcggttgaggatcttgcatctaaatataatcaagtcctacctttacgttcctcgtcccgaggatggacccaataggttgaaactgtattcccaatgcctccttttcccttgtatatgggacagttagaatgttgttttagtgtgagtgcggaaacctgatatcgatgccttgggaatatgatgaaaaattgaactaactagacctagatagcatgctgattttgcgtatcttgctgttcaagctacccactgcttggtgaccggccatccatttccaaggctgtccgctacaaccaagcgtccaaaggtgaggccagtgcaaccgaagggctacgtgcaaagacatgtcttaattactgtcttgtataatagtaaggtgggcagtcaatccccttatggctctagcagtctagaacagccagaagcacaaccctgtcggttgaggatcttgtagctaaatgaaatcaagtcctgcctttatacctcgtcccaatgaacccaataggttgaaactgtattcccaatgcctccttttcccttgtatatgcgatagttagaatgttgttttagtgtgagtacggaaacctaatatcgatgtcttgggaatatgatgaaaaattgaactaacaagacctagatagcatgctgattttgcgtatctacactagagctagcttgttgccattctcactttgttatcctaagagagttctggtgttctacatcagagcacagggccagttgcaagcaggttctagtatacatttctatatatatggaagtcaataaaagtaggcaatgagacgacacatgcatgcaaatatggtatttatcatgaagaaaagatcgcaatgtaattaagtaactcaaccgaccatatatgcttctgaacgcatcgatgtattattgcattttgtactttgtagaaaaacaatgggttgtgtccatgtgtgagctacctacatgtatgcactcgaagctgtaaaattatttgtatattggacataggatctcggtgcctccttttccaaaccggagtttgcaattaaaattgacgatagcatttgcttcccatctattatctacaagaataaatgttatatatataccccaaatggcttcacctatctgcaagagatcaaagaggcttcttgttaatttgcatgaccatcatgatatatctgttgtttaattttgacaagaaagaaaacgagtcaagttgcatatttcaggttcttcaatttgaagtctcaaattcgacggagaaattaaaagtcatcaggttcatgaagaaattaacattcctcatcttgcatttgatcctaaacttattgaactttgccactgaacgagagcctgctagagctatacagatcgcgggaccatttgatatatttgatgagcaaccgaggacacacgtcattgccggtcggcaaatactaccgcagtgttccattcacgttgtttgtgcccaatggagtttcttcacaagagcgctgtgtagtgatgccgaggttttagcagcgtccaagaaaattctacgggacgactctagcataagatcttatacctcactctccggttcacggactgctctttttgttcaaacctcacgattaaaccgattgccttgatcattgaaattgaaggtagcttgaaactttgttccgggtgcctccatttcctatggcatgttcgacgatgagacccattatcattttgtaagcacctccatggccgcaccaaaatgtgtattcaagcatcagggtcttcttctatttatcatgggttcacacaactctcaacataatttctgcaccaattctcagcacaattttgtgcgtaagtaagattaaataaagtgttattaattagtgagtaacgacatctgttgtgcatagtattttccacggagcagaacactcaaaggggatcatacaccacttcacaattttcttggtaaaaaatattgctaccgccaaataaaaaatcacaaatttatctcatgttccatgggaagataccagaaggcatcaatatttcttttgtgtaaataggtatcaggaggtaccataataaattaacactaaaaaatatggtaccatataatgtcttttcaaaaacaataaaaaaggctaaataaatgtgaaggaacgatactaatgagttaccaactcaatccaaaagcagagctcatgccattttgcttctgagaggaaaacaaaatactaaaaactgaataaattaaaacagcgcagtgcatagcaattaatcaaaaaaaaaaaaaaacagcagtgcatagccggccattctcagctgaaagacagtttcaatgaatatgatctaaccatcgagtgccatttggttagactgtgttgtttcttgataatggttagacctaaaaccaagatagagctaaactccataaaataagttagagcttttcctatagaaaaaaggttagagctaatgctttaggtttggagtgtggaaaaatctaattggggtattctattgttttctaatctattacattgactctcttatagggatagaaacttagagtgcaatacaagtaagagtagatttatctctaagattctatctctatgatatatcttatctctatgtttgtatttgaatcttatctctaactaacatatttgtacttctaacaaagagaccatagaattaaacaattgaatcaaatctaagctttctattattctcgtatgcaaatcctgacaatagttgtaacaatagcaagttaaatatgcttgctgctaactgtagagaaagtggaatagatgcctcaccaatgtggggaggtgaactctcatatatatatagcagaattacaatcaatgctagtgctgagttacaatcaatactagggagttacataagaccaaaggtctaggagagtaactatctaggagtgtaaaagtttaggagataaacagcctatagattaataaataatcctaatacccgcccgcagtcgtagcgggaggagcatgaacgcacagactggaccgaaaatcagtaaataactgaaccggcaaacctttggtcatgatgtccgcgaactggtgcgatgaagggacatgaagtacccggacttgtcccaaagccaccttttcacggacaaagtggatgtcgatctcgatatacttcgtccatcgatgatgcacgggattcgctgtcacgtaaacagcactgacattgtcacaatagacaatagtagccgaagcaattgggacatgaagttctagtagcaattgccgcaaccagcagcactcggcgacggcatgagcaacggcacggtactccgcctcagcactggaacgagagacagtagtctggcgcttggaggaccaagaaaccagataatctccaaggaagacacagtagccggacgtggaacgaggagaatcgggacaacccgcccaatccgcatcggagtatgccgtgagggactgaatcgggccggagccgatgtggaggccggtggagaggctgcccttcacataccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacgggcaggccgtcggtggcggagagcttggcacgagtgtccactggtgtcgatgtagagtggcactcggccatgctggcccggtgaagaagatccacagcgtactggcgctgtgagaggaagaggccggcggaggagcgcgtcacagagatgccgaggaagaagtggaggtcaccaaggtctgtcatggtcgaagcagtgaggatgatgtcatcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttaataccatacagggacttctgcaatagacagacagcatcaggggcagcggggtcaacaaacccagagggttgctgacaatagacggtctcctgtaggtgaccatgacgaaacacattcttcacatccagttgatgaattggccaagcacgggatgcagcgatgctgagaacaaaccgtatggtggccggcttgacaaccgagctaaatgtctcgtcgtagtcgatgccatgctgctgcgagtaaccacagaccacccaacgagccttgtgacgagcaagagtgccgtcagagtggaacttatgcttgaatatccacttgcccgtcacaatgttgtccccaggggggcgaggaacgagacaccaagtgccgttgtcaaccaacaccttgtactcatcagccatggcagtgcgccagttgggatcagccaacgcactgcgataattggccggaacaggagaagcagcggtggcgtgggtagccgtgtaggtcagcctgtcaaccggccgtaaggagctagtctgggagcgcgtcaccatggaatgcggctgaggagcagcagccgtgacaaccacattgggtgaagatgatggcgggaccgtcacggtgggccgacgggtgtagacatggcggaatggtgacacggtgccggctcgggtggcaccgaccgacggggcagcgccgatcgaggaggcgctgaccaagggcgtgccagctgatcgggcgtcacgtgccgcagggacggtgttgttcggcaagcgtcggccgaagaggggaacgtacggttgctcaacctccatggagggagccaccgtaaggcgtcgcggttgctcaacctctgtggagggagccaccgtgagaggtcgcggttgctcaacctccaaggagggagccaccgtgagaggtcgcggttgctcaacctctgatgagggagcgaccgctggagggagtccctgcagcaaaaaatcaaaagacgagggagcagggggagttgctgcgaagggaaatcgtgattcgtcaaacacgacgtggcgcgaaatgatgatgcggcgagtggagagatccagacatcggtatcccttgtgggaggccgggtacccaagaaaaaagcaagttgtcgagcgaggggcaagcttatgtggagtcgtggcactcaagtttgggtaacaaagacagccaaagacgcgaaggtgggagtagtctagggtggtgcgatgtaggagctgaaaaggtagtgagtggtgaacagaggaggagggtctccggttgagaaggtaggtggcggtggcgagagcctcagcccagtaggacggaggcatagaggcctgtataagaagggtgcgtatggagttgttcatggtgcggagcatccgttcggctttaccattttggggggaggtgtaagggcaagagagtcgtagctgggtgccacgactagtaagaaatgaagtggtggcggtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagtggaagtgcgagacaaagacctatcgaaaggtaatcgggtatgtttgcctaactgatacgcatgacataaagaggtgtctattttattacaggaaatagaggacatatttcgaagactgtggatggcggctggaccagggtgaccgagacgacggtgccaaagcgtggaagaagtggcgagggagcaggacgcggtgttggagggagtagcagctggaagggtgtagagttccccgtgactattgcagcgaagaatcacgcgctgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgtgccggtgtccaaaacttagttgtttgggctttggaaggccatctggttcagtgctgcaatgaggccagcttgctcccaattgggctggcctgtaggagcaaatgtgggcgacacaaatggcctagcatatgtggtattggcctgggagtagtcggccgtcggagccggcccaagaaggccggctgaagaggggcgccaggcctgttgctgggccggccaggggttaaaacaaacccaaggcccggccggcctccagctagggttggccacccagccggtcgaactccctccagcagagaaaccgccgccaccagaggaaacgccgctgccaccgccgccagagaaggcctggcgagtgccaccaccacccccactgccgccgccgttccctcctccatttccgccgccgcgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccaccgggagggcaggaaccggagccgaagccgccgccggccaccagcgccgtggctgccgccaccttggcttcgttggcgatgcgcaactccttcagcaggagggtgttgcgcgctgaggtgaagcttgggaggacggctgcgccagcgatgttatctccggtgttggagaagcgctcgttcaggccttggaggaggttaagcacgagttgggattcggtgacggcgtggctgatgtcgcg

SEQ ID NO: 10482 - DNA, 875 bp, Oryza sativa
aagtggaatagatgcctcaccaatgtggggaggtgaactctcatatatatatagcagaattacaatcaatgcttgtgctgagttacaatcaatactagggagttacataagaccaaaggtctagtagagtaactatctaggagtgtaaaagtttaggagataaacagcctatagattaataaataatcctaatactaacaaagtacatcataaaacacaacactcgtgaagctactaaaatatttaggctaaaccttccacaaaatacttttgcatttcagtggatttggtctagtatgcatgagaaaagagaatattataacatttctaattcgtgaatttctactgatcgccaagtcctgcatgctggatcctttcctagaccttgtagtcagctagcatagtctgatatgatctaagtttggtcgtccaatctgctcaagtagctatcattgtgaccggccatccatttctaaggctgcccgttgccaccaagcatccaagggtgaggccagtgcaactacagggataggtgtaggaacttgtcttactgtgttgtatagttgtaaggtgtgcaatatcgatccccttagctgtctcaaacagccgaaggcgcaaccatgtcggcttaggatcttgccgccgaatccattctaagtcctacttatatgtacgtcgtcgcaagagtgtatccgatgggttgaaacttgattcccaacgcctccttttcccaggatcttggttttagtgagtggggaaaaaccggatgttgatcgatatgccttgggaatatgatgaaaaaatgaactagcaagacctatatatatagcatgaagattttgtgtgtacccatcgacactagagctatagcttgt

SEQ ID NO: 10483 - DNA, 9127 bp, Oryza sativa
agataatctgttttcttggtcctccaagcgccagactactgtctctcgttccagtgtgagccggagtaccgtgccgttgctcatgccgtcgccgagtgctgctggttcgtccaattgctactagaacttcatgtcccaattgcttcggctactattgtctattgtgacaatgtcagtgctgtttacgtgacagcgaatcccgtgcatcatcgatggacgaagtatatcgagatcgacatccactttgtccgtgaaaaggtggctttgggacaagtccgggtacttcatgtcccttcatcgcaccagttcgcgaacatcatgaccaaaggtttgccggttcagttatttactgattttcggtccagtctgtgcgttcatgctcctcccgctacgactgcgggcgggtttatttaatttatcatgaagaaaagatcacaccgtaattaaacaactcagccaaccatatctgcttctggacgtacgcatccatgcatcattgtattttatttgtatactcgtactcgatcttggaaaaaaagatgggatgtgtccatgcatgtatgcaccccgagccttggaagcttgaacgtttccgtatattagctagtgtgttagaaagttgggctcagtctgataaaaaaaaggttggactcagtagttaggaaaaacaaagtaattaagaagaactcactactacaaaaacacccataggtgtcggtcacaaaggtgccggttagctaacaaccggcacctataagtcatttcccgtcaatatagcaaaaaaacagcacctataacgatttattggtgtcggtttttgttgggaaggtcattggtgccaaaaatactcccgccaacggtccgaaaatcgcataggtggcggctgtggataaaaaaccggcacctgtatgaaaggtggcggttatttaaccaaaacgacacctaatcctaggtttttttttggatgaagggagtacttgattgtaaaggtcaaggtagactaattgtatctaggtccttagcaacaatgtattccatatactaggctgttcaaacatgagaccaagatgagtttgactaagaagatattagtgctaattttgcttcagtgtcacacatcatagatacaatagagtcactagaacggataccctcatctcaatcgggcggtaagccccatctcaatcgggcacagcgtccgtcacagactagaagtcactgatgtgaagagttatctcaatcgggcaaacagccgtcacgaatgaatatatctcaatcgggccctaagtaaagcccgtcaccgatagctttgacccagataaccagtcaaactatagcccgtcacacatgacctatctctatcgggccacaactagcgcccgtcacagatgactactaacctttatcgggcctaaactagagcccgtcacagatgacactcatctcaatcgggcctaaactatagcccatcatagatgactgatgacctcaatcgggactaaaatagagcccgtcacagatgactgctgacctcaatcgggcctaaactagagcccgtcacagatgacctcatctcaatcgggcattttttttaaagttatggcccgtcacagatgactataatccacaaaaaaaataaattttgttttttggctagcctcaggcctttgctagccatgcccgctgcaaaaatgacagaagcaaacgcagatatccaatatccccagctccccagcatcacccattcatatacatatgcattcacatacgcagacatcaacatatttcactcaaccacacattcacagccatctcatatttcacatccattcacatatttcacatccattcaaatatttatcatatttcacctgcaaaacgaagttaattggatcaaatatttatttagcaagtcttaacataaacatatgaaatatatacataaatataagcatcacagttacatcatcacaattacataataagtgttcatcattgcctaaacatagaagttcaacattgttcatcattttagtttaagcctaaacattcctttggggttaattatttcgcggaagatgaagctggctatctcctcgcgaacctcctcaaagctggtaggcagagacttggttattgtgccctacattgtcataattccagattagtttatcgatcatatataattactaaatcacgtgttccataatcagtgtctactttctgttgttcccattacacaaaccacgatattaatagtgctaataagaaatattactacagttaatgaaacatcatttcatgaaaatcgatcatatattcatataaaaaaacttcctataatattgtcctacaagtaattttgcagttattaagaaggtatcagaaggtatgacacatgttctagtataaaatttggtatccctcgatatctctaatactataagatatcaaatcttacactaaaaatattggtacctcctggtacatatattaaaaactgtaaaattaccattgttacatacttcgtatagctcagcaccatcctggtacctccttcatatgcccatgatgtccaaacacacacccaatctcaaaactatttacgtacaccacccgccactagggtttacgttactgctggtaaccgcgcggttaccgcggttaccggccttaccacgggggtacggtaatagaaataccgcggtaagccggtaacctccttaaattcaaataaatttaaaatataatttgaatttttgataaattttgcacggttttgtatggtttttcatggttaccgcggtaaccgtgcttaccgccggggcatggggttaccgtgctccggcggtttgggaaaccctgcccgccaccactgaggttggaaactgctatgaggtcgtggatggtagcggtgaggccagtgtagccatgggactaaaagaaggcggctgcctcctgtacagcagcattgcaaccatcaggcggccggcatccatcctctaggcgcttgagtccagccggatgcacaatcctgacagttcaggaccctcatgcatgtgtactctcctatcgttttacttcagcagaccatagcgctttcagaaacttgaaaatctgctgctggcacctccctttccctatgtatggacggacggtttaagagcttgtttgttcgggtaaatttggatttctacaatccctttagagtggcatgaaaactcaactaaagaaaacatcaatctgcggagggtttgggtgttcttttttttttctttatgggttcaccaaacaacacctatgtgcgtcgtgacatccagatctcagagcttgttgaagagctcgtctttggcattgttttcttaagagttctatatatcatagaagagccagctactagatgtctagatgcaggtttcatctatagaactggatgagccgtggtatttatcatgcatatgggacgcaatgtcacaacgtaattaactactccaccaaccatgcttttgtgtagacacatggattatttacttaaacattttctgtagtcgatcttgcaaaaaaaaaagccatgtctcatgtgcgagctagcttcagggactcagaattaaccacacagaggtgagcatgtacatctccgtaaactattgtgttattagagcaattttacggtacttgaggagataccatgaggtaccacttttttattgtacatttggtaagatttgctacagtctagcaaaaagtacctcgaggtactgctacctcatggtaacaaatcgtttccgaccattcgatctagctgggcaggatcggcattgttagattcaatgcttggaaacgatttggtaccgtgaggtaatgctacctcgagatactttttgttggatcggagcaaatctcaaatttggtatctcttggtacttacgtaccatgaagtacctgtaaaatcaaagtgtgtttgattcttattctctgatgaacaattggcatatgagtattggttttgatatttggagattattggcgaagtggttttggagatgattggatttgcaggtgatgaacaggtgctgctgaagatttggtccgatcagaccgggcaaggcttgccggtcagaccggcatgtatcgagcggtcagactgtctagcccgcggtctgaccggctgactctgtgtcggttttgttttcgggttgtttcgttggatattcatggatagttcatatttatggcttctagatggatactatgcgtatgtaaaactgttgtttgctaacaatgagtcaagttggagatagcttggtctcggaatatggtttttttgtttgattcatgtgtaggtgtcttgatgcctcaggagagtattactggtgatggatcgggagtcaacttggagataaggtgatgtccagacggtcagatatatatcatgcggaatacttaggctaaaagatcaatgcacttggttggtgaagattccatatagcataggatggagatattgtgtgcgcatggaatgcggagtcgaatttagaaggagtctaaatttggtatgattggagtttgtaaagttagtttcttgtaccggaaggtttcctaggtggattaggactttttatatgagtttggttcgtggctttaggctacctacctcatatataaatagagagggaatgtgaggcctcccgggatcgctttagagagcattgagttgagagaatagttagggtttcgaatttagtcgagatttttgtgaggagtgctgttattgcactttgtaaacacagagagaagtaataaagttgtcatctactctgagagttctttgatttgtgttttctcgagttcggtggtccaaccgactgttgatgcaaaaaaacacacattggcctgggagatctgcttaactccagtgcaagtccaaatcttgatgagatgtgggcgtgccagtcagtttgatcctgcaactgacaaaatatgcaaatagtagatcaatgagccaatcggctgacaagccgatggagtagttccagccgatgccgataccagccgatggcgatagggttttgagctatcgacaatatgtccaatctagataatgatataaaggcaatcggctgatgatgatgcaatataacaataatataattcaatagacaccaatcagctagcagtatgatataatagaataagcactgatccgaaggttaaagcatacatttactggagatccgatgtcataaaatccacaatattagataaacaataaagtctttgttgtcatcggctaaatccaacttatatgtatatgcaatccttataagccgatgcaacgtctagataacttatcggctagcaacccgataaaacattagcatgaacctatcggcttaacaagatttatattatcaacaacaatctagtaggtcgaacctaaccgatgcagcacgagattgcatatgataatataatactcgatgagccgatagatctgtctagcatgatggatataacaaatctatttacaacaacgttgtgattgtagagaaatatcggctaagacagaagatcagacctaaccgagacagttccaactaaaccgatgcttctctaaacacaatgcaattagagatagaattgagatatcaggtaggaaaatatatcaaccaaaccagagcgatccaaaagatcaaaacgatgcagccttgaacaacaccaacatagccgatagattctccagggccggcggaacataggacttaccccttcgccggagatcgaactgaaccgatgcagccccgcgaaaagtgccaaattccgccagatgataagtaaaatcctcaggaaagagggtggcgatgcaccgagattagttgtattgatcgagagatatattacatagaccccgggtgtatatatttatacccgtgggtagatactagtccttgtcggacaagaaacaaaccttcctaaagataaaacagaaacataaagtcattattagacactaaacacacttttctaaagataaaaggaaactaacaaaccattcctataaagtcattattagacactaaacacactttcctatagataaaaggaaactaacaaaccattcctaattaataaatacaattgccttcttcggactcaatccgcacgtggcaatatctcatgaagcacgctaactcaatctggcaatgattccaatctcaccttgccggaatcagctacatcggcttaccttgtccgattcagtatccgccgatgcacaccgtagccaatgcagtcccgaagctgatttatactctggttctgttatcaatttccttccaaatccgcttcggccataactcgaaatccgttgcatgatttatcaaatttggtcgttaacaccgacgagacaccggcggtcagatcgatggcatcgcggcggtcagaccggcgggtttactgcggtcaaactggcggcagcaataggcgacgatgataggtttcggcggttagaccgggagatcaacaccagtcagaccggcggaataggaacggtcagacctgtagatcaaccccgatcagaccacaattcatcgatttgagagtaacttttaattgcactaaatgttttggtttttgggcactacaaccatctggtcgaattagttcttgctgttcgatcctacagtaccaaattttacactaattttttggttccttttggcacctccttaagaacagtaaaattgctcgtgttataaagtaggactcagtagtaagcacgaccgattggtttaagacatcaaacaatggaatatactgccaatggagtttgaatggttccattatattgaagatcattttcatagctctcccagtcccaaatgtacagcctcatattccaatcgtcgattagttaatttattgcatcaatttgaatttgttaaaaccggtatcacaaacgccaatagtgtcatgatgagcatagagctccaatctgtttgcttgatcgactaggcatattgctcacggtcacggaccttatcacttacacactgatcaatccgatattgcaaacgagtttttttaaaacgaaattcgaggcaactgcacctcacttgctgtcaagattttgctgcggtactacttgctttcgacgagtaatggatgtccaaaactaacatacttaaaaaaatatctttaaaaaatgtgaacgacactaatgagataccaactcaatccaaagcagagctcctgccattctgcttcagagaggaaaagaaaatactccctccgtccctaaatatttgacgctgttgactttttcaaatatgtttgactgttcgtcttattcaaaaacttttgtaaaatatgtaaaattatatgtatacataaaagtatatttaacaatgaatcaaatgataggaaaagaattaataattactttttttaaataagacgaacggtcaaacatgtttaaaaatgtcaacggcgtcaaatatttagggacggagggagtactaaagagagaataaaaagagcagagagtaccaattattcgggaaaaaaaataatagtgcatagccagccattcttccgctgaagacagtttcaatgaatatgatttaagcatctagtgccattttgttagacatatgttgttgttaggtaatggttagacctaaaaccaggataaagatcaactacataaagaagttaaaggtttttcctaaaaaaaagttagagctaatgattcaggtttagagaccatagaattacacaattgaatcaaatcagtacgctttctattattgtcgttaagcaaatcctgacaatagttgaaacaatagcgacttaaaaaactgactatacagcaaaggagtacatcacaatacaacattcatagagctgctaaaatatttagatttaaaccttccttataatatatacttccctttcagtgggttgttctggtatgagaaatttcggcaaagagtatattagatcatttctaattcatgaatttctaatgattcctgtgtactcagctagcctggtctgatcttggtcttgatgttcaagctacccactgctttgcgaccagccatccatttccaaggttgtctgctaccaccaagcatccaaaggtgaggccagtgcaaccgaagggctacgtgcaaggacatgtcttactgtcttgtatagttgtaaggtgggcagtatcaatccacttatggctcaagctgtctagaacagccggaagcacaaccctgtcggttgaggatcttgcagctaaatcaaaccaagtcctgccttgacgttcctcattccaaggatggacccaataggttgagactgtattcccaatgcttccttttcccttgtatataggatagttagagtgttgttttagtgtgagcggggaaactgatattgatgtcttgggattatgatgaaaaattgaactaacaagacctagatagcatgctgattttgtgtatctacactagagctagcttgttgccgttctcactttgttatcctaagagagttctgttctacatcagagcatagggccagctgcaagcaggttctagtgtacatttctacatatatggaggtcaataaaagtaggcaatgagacgacacatgcatgcacgtatggtatttatcatgaagaaaagattaaacagctcaaccgaccatatatgcttctgaacgcattgatgtattattgcattttgtactttgtagaaaaacaatgggttgtgtccatgtgtgatctacctacatgtatgcactcgaagctgtaaaattgtttgtatattggacataggatcccggtacctccttttccaaaccggactttgcaattaaaattgacgatagcatttgcttccccatctattatctaccagaagaatgatatatatacccaaatggcttcacctatctgcaagagatcaaagaggcttctttgttgcacgaccatcatgatatatctattggtcaattttgacaagaaagaaaattagtcaagtgcatatttcaggttcttctatttgaagtctcaattcgacggagaataaaagtcatcaggttcatgaagaaattaacatgcctcatcttt

SEQ ID NO: 10484 - DNA, 4769 bp, Oryza sativa
tttcatcagcaaatactaccgcttcactgatcaatggccatcacctgcaaccatgaaagcttgggattgccgtcatggcagtgttccattcacgtcgtttgtgcccaatagagtttcttcacaagagcgctgtgtagcgatgcggaggttttagcaacgtcaatccatgaccgcagcaaactgtgtattcaagcatcacaggaagaggggcttcttctatttatcatgggttcacacaactctcaaaagaatttctgcaccaattctcagcacaattttgtgcataagtaagattaaataaagtgttattaattagtgagtaacgacatctgttatgcatagtattttctatgtagcagaaccctcaaacagctggaggcacaaccatgtcggttgaggatcttgccgacgaatccattcgagtcctgcttatatgtacgtcgttgcaagagtgtatcagatgggttgaaacttgattcccaacgcctccttttcccaggatcttggttttagtgagtgggaaaaaactggatatcgatcgatctttcttgggaatatgatgaaaaattgaactagcaagacctagatatataacatgatgattttgtgtgattcgatcaacactagagctatagcttgttgccattctcgcattgttttcctaattaaaagagttgtggtgttctacgtcacagctggccagcttggaagcaggttctagtgttctacatgtatggaactcgacaaaagtaggcaatgagacgccacatgcatgtacatatggtatttattaatttgtcatgaagagaagatcgcaacataattaaacaactcagccaaccatatatgcttctggacacatcaatgcatcattgtattttgtatactttgtagtagatcttggaaaaaaaaatatgggatgtgtccatgcatgttcgcactccgagccttggaagcatgtacatttccgtatattagtgtgttagaaattaaaagttgggctaagtccgataaaaaaatgttggactcagtagttagggaaaacaaagtaattaagaacaactatcgataaatcttgttctgtcgatcgaacataatctaagaaagcaaataggttctgaaggtttaggttataatattccatgttaattaggggctgtttgtggatggggctaaattttttttaagtccctgtcatatcggatatttgacactaattagaagtattaaatatagactaatgataaaacacatttcataattctggactaattcatgagacaaatctatatattgagcctgattaattcatgattagcctatgtgatgctatagtaaatatatgctaattatggattaattaggcttaaaaaattgtctcgcgaattagctctgatttatgtaattagttttgtaagtagtctatgtttaatacttcaaattagtgttcaaatatccgatatgatagggactttagtctctagatccaaacacccccttagaatattattagtcatattgtaaattttgatctcgattctctctcttccacctaggaatgtgatgatgtggcatttgtttggagcctgctgactgagtttattgtacctgttctaaagaacttactagtactactactttgtttgttgtgccaaggataactttttaacctatagatgtattcattactcctccttgatttatactattttgggcataatcccctatatttattgggggtataatcctctatattccggagggtgtatgatctagcctcgatcatgtcgattggagtcaaaatgatgctaccatacataccatacagtgtactcgatgatcagccacccttgagaatggggctctctctaccttcctacatgctagtatgaagcacgctagtcttctcttcgatgtcagcatcatgtatgccgaatgtggaactctacaagtacgaagaccctatgttctttcactaggatgtactaatacactaccaaagccatgccacccacactagcataaccttgtcaactcttgaaactagtcactctttccatagtagtagctgtctattgatttcatgggacactccaaggttatgccgatcgaaaagtggaccgagagctgtgcgatgaattcctgatacctccatttcctactagggtagttcttcacttttgttcagagttttgctacaagagcttagattttgatctacgtaataacttgcacaacaaaatgactagaaaagacatttcttttatatgtcttccaacccaactacctccaccaaccatgcatgtgcggactgagctcgtagagttaaatcatttaagaattcttttcaacaccattatatatcttttattcttcctagtaacgaaaagcaggtgaacagattctgctagctagggagcaattatttttgggggtttttacacattagagtaaattaccgtgctatggagaaacgctcaggttcttccggctagctctataaggtgatgggctagacgacttggactcgaagcatcaccccttctaattatttgatattaggtccttccctaatattcgcgtttttaattaccgtgctatctcattcagacagtcaggtagataaatacagtggcgtgtatatgaacaccatcaggtttcccctaacattgagtttttctttgcttgattatattgaattattggcatcaatgtctttgcgctcagtccacacatggttatatatatcaccgatagtggtcggaaaggctaatgggtgggtgatcgctcccccaccagcccagcgatcgccgcccaccctctccccgatactactagatgtatgtcacaccccaatccagcaccgccgtacaacgacacctgacactggcgtgtcgtaggaaaaacggcgcgaaccgcttcctacgaaaccgcgatcacagtaccagtcccaggacatagtgctggtacccacggtgacaaatatgattcattgcaaatccttaaaataaatagaggacttatttaccttaacttaggttgcagctcaggacagcctgagaatacaaccaaagacacagacgaggaaacaccagcaacagcagcagcagcggaaccaacggtctaacaccccacaccacaggcgacggctgggaaccaggacgaaaccctaatcttcactttacttcatcttcaacttccgggtggaggaactatatatatttatatagagcaagggtgagtactttcgtactcagcaagtcacaggaatttaggtgtttaatgcaagcttgaaagagaggcaaagtagttttgcaaaatcctttgtttgaaatcattttttgaaatctctaagtgatttatttctttttaagtttggatcaaaaaggagacttgcgtctcgattcgacttaagagatgcttttcaacaactcaaatggtaatgtactgacccccgggtcagatcattacttatcggctcccatagccatttcacttgattaagcggctcctagagcctttttcatttttgcggactcccagagtccagctgcccagcagcaaagcaatccgcttccactcgggaagcctagtctatgatgcccacagacatcccgaatcacacagattcgtttctgaccactcaggtcatccatctgccacttaggctgattctggttacgattcccaatccacaacaactgttcacaaagcacaggcaaacaaatctacgcaacgggaaccacctcacatccgcccatgaccgtgggcacggctgtttgaacagttagttaacctctgcagaggggtgcactttacccacaagacacgaacttactccagacactggccggtgtcagaggtttgcgacaaagcctttccaaagctaaatttgggtcacctcatgccacatagagggtctccctgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgaatttcccaaaggaatcggtccttatatgcgaatacgggacagtgccaccaaggcacagcacccgcatcgcgagctttcacaattcattttattttcaaacacgccgacaccacatgtcgggttttaaaggcttctcaaacccatttcccagattatcgacaaacaacggtgtatgtggaatagttggtatacgcgctcagagagcacggataccgaagtaccacaaaggtggagcgacaaggaatcagggtagtacagcctacaggaattagtgcgactactaggtaggtccgtcggtttggcacgcaaaccgaaaccaagcatgctataaatgtgtgttgctaataatgcgagttgcaaacaaattaataatgattttccaattataggagcaattggtcaaagggtgcttgccttgctcaaggtcttcacgaagcttcacgaatcttcgagaaaacccgcgatcgacgaaaatccggtaactgcaactatacgcaaacaattaaaaacctacacaagacccaaaataaagatcctatttagactacataatagtaccattagatagatctcaattttacggaattattggaagttgaacggagtcaatcggatgagcggttgagaagatatggattttctaagtga

SEQ ID NO: 10485 - DNA, 7368 bp, Oryza sativa
  unsure (1)..(7368): unsure at all n locations
agtccaccttgcggggtcccgagtggggcccgcttgtcggtggcgcggctcaccgtgggagcggcgcatgagggtggcgctagggtttcgggtgagcgcggttcacgcgcgtgcaccggatggaccagggatgcggcgggcccacgcgcagccggttggcgcaccgtggcccgcgcgcgcgaggggggggagggaggaggcagctgaccggctcggctcggtcaatgccgaggtggcgccgacgtggcgcctacgtggcagccacgcaggccggcgggtggaggaagaaggggaggccgagatggacggcggacggcggccgtgttcaccggagcaagcgcgacgggtttggtcttcgaggagcacaccggagtgacgagggcgtcgagaaggagcgagccaacggctcggattcgccggagggtgttcaacggcggtggaattcgacagcggcggccggcggcgagagaaaggggaaatcaccgaggggcgacaaggactcaattaaaggcggcgggagcatctccggggctcaagggtttcgttcctgtaatcggatagggtggggaggcgccgtggaggtccggcgacgagaggcggcctccgggagcaggcgctgacggtggcaaggccatgccgagcggcggcagagctcggggcggcgtctacgcgcgttcgaggggctaaccgagctatcatgcaagctagagagggcgagggagaacgaggaaggagaacggagggaggtactaccgagccgggcgtagtgatgggcggcggcggtgcggggcgagctctctggcctcgggccggggaaggggaaggagagggtgcccggagtcccgcgtcacgcatccacgcacgcaccggtctccctggtgcttcggcgacggacagcgagggcgactgcagggcggggtggcaacaatggcgcggtggaggttgggcaaggaaacgaggaggaaagggaggggctcaggttgggttttatgggtgcgggaagtcggttttgggggaggaaaccgacttagggcggtcaaggggaggagctggcggtcgcgcccgtggtccaggcggtggcaagcggtgacgccgatggtggtcgggcaaaaggaaaaaggagagggagaaagggagctctgctccttgctgtttcgggaaaagttgaaggagggagagggagtgagagaggggctgcctctctcggctttggaagctagcggcgtggagcggcagagcggcagcgcacgacgcaagcgatgctagggcttgacgcggcggcaaccgggcggctgcgcggcgcaggcgcggcagggctgacggcggcaacgaccggccggtcggccactcgtgagcgccggaaagagcgaaggcggtggcgggttttgggcggcgtcggcacgcgagagagaaaacgagagagagagcgagaaacagagagagcgagagagctctctctcggctcagctcggcacgtgcaacgcacgtgcgaggctgagggagcagaaacggctgagggagggaggtgggctaagggggaaaacggcccacaacacccgagggaagtaaaatagacttttgcagagaagactgatttggagtgtattcgaattggggttttggattcgaattcaaatttgacattcgaactcgatggtttagggaggaatcaagggagactcgaggagaagtcaaggaagagattcaaaacagaaacttggatatttttttagtagtcggagcgaatattcggcaaggattcaaaggaagggattgacttttggaatttgatttcggagacttgaattttggataggaattcttgaggtggaggatttttgatttcgatgagagggaacaacgggattgagttgagatccatggcacgacttagactctcactcaaagaacaaaaattttcgcaattagtattttgccgaattagtgtttaatgtctcacgaaaagcggagcgttacaatgtactcctccctcttctcccccttcctcctctccttctcctctttctactgcaatagaccacacaaaattttttgaaaaacaaaagttagaaaaatttatgtatagaaatactatatataaaaaatttgaattcaaattcaaatttgaatcgggtatgtaaacttttgacttataaattttgggtctataaactttaggtgtataaactttagatgtatagaaatactatatatagaaaatatttgaattagaaaatatttgaattcaaattcaaatttgaatcgggtatataaactttaggtctataaactttaggtgtataaactttagatgtatagaaatactatatatgaaaaatatttcaattcaaattcaaatttgaatcggatattcaaattcaagatcaaatttgaaacgggtatatataaactttaggtgtataaactttagatgtacagaaatactatatataaaaaaatatttgaattcaaattcacatttgaatcggatatataaacttttgacttataaacttttggtctctaaactttagatgtgtaaactttaggtgtataaactttaggtgtataaatttactaaaataggaaaataatacggtgacaaaaaaggaaaccaggtggagggagggaggggggaggtggggagcgaatctgatcgctaccccatccccacggcgatcgatcgcccattaggggtacccgatagtggttgctttcatcgttaaaatgaataatcaaacaattgcatcacttgtttcttatcaaaataaagatatgacgaattgttaaacatgttgacatatcttacacaccaaattccatgtgagactccaaagtcaaaacccaactactaggcctaagaaatcatcagcacaagaagtaagcacacggctgctctgctcccagctatcttcttgcttcaagaggtcagcgtaggtgggcacggttttcctggctagctttagctactggtgcaaaggaaaaaacaaactccttgcctactggcaagctccaaaacacggacttcgactgtgcaatcgttggccttgccatgttgccatccgcatattatattggctagtttacacattatgtactctcagcagctggttgagagtatagtagattgcaactttgcaccgaattcctgatgcctcccttttctattggacttgattgtccatcgtctcaagtgagacttgtaaacattggaacacttgcatccacctctacagcatgccctacaagaatctagctagagtgatggatgatgcaggctgtgttttgaaggactatgtgcactgatacttttttaaaaggacaccactaggcatcagacatgattttttacagatcataaggcctgtgtttcaccacttgtaaggaaatgcgttttagattatatattcatcactcagtgaaaatgtttctacaataatttgtttatgatgtttaatcacttagtgaaataaatattccacatgtagtaaaaaaaatgtttcgattagatgcaacatcagaaagtttgggttgcaaccccaaaactttacgcaaggtcggaaaaaaaagtgcgtgtcgtcatttggaacatctgaccaaagagggataaatactggaatacaataacatgcaacaagataaacaatagtgcaacaaacctatcgctctagtatgctgagtttgtgtatctacatagtagagctagctaagtccgcgtggtacttggacaccatggacttaatgccaagcgcagacattaatacaacatagtgaattaatttcacattagaattcatcagattatctgacttcaaataattcttggcatctcttccactagaactacactggtactctcctaaagcgatgggaataggctttgaaatgatatttttcttagataggcttgaaacgatatgtacagtaagatcgatgttgccactgctatgtgtggactgagctttgccaagtgaagtcaatacatatcaaggaaaacggcataattgcactgagctacggcttcattgcatccatggtacacaatcactatattatgttattaactgtctgaaggtcaggtgcacagtattagtgtagagagcccatctaatgttacagagtttgtgtcgaatatatatatatgtagtttagaacttggagttgtacttggtgttaggactagagtaagagtcagactctatactagactctcttaaatagaggggtggacctattgtaatcgcatggcgacttagcatagcgagaggaagcggttgctggcggtgtcctagtactgctagagctttacactaaatatagttttagtatgcacttcccgcactgcaagagcaattttacagttcttgaggagataccattaaggataaaaatttagtgtaaaatttagtagctcctagtacttaggtattaagaggtaccaaatttacaatagaaaatgtggtacctcctcaaggactataaaattgctcgcactgctgactgcagagcagtgtgacctttcacgaactcaactgtaatatgtcgatcaaaacagtgttacagtaccaattctgtggttctaagcaacaaattatgttgacggctatgctctactgttcctagacttccatgtcttcaggatgcacgtacgtaactttgccctgctggttttgtactcttacttctgctggtgtaatacgaatgggtttcagcaaaagctgtgatgaatccacatgttctgcagctgcttcaggtaattcacatgcgatactaagtcatggtgcacagtgttgtcactacgccgcgtccttcttggactctcctcccaatcgtttccctcggggctacactattcaaagcctcctaacctaagttctcagtgcctcccttccctatgcttactgggttatacagtggcatgatcagtgattgatattcgagttttcctccatattcttctccttgagtttttgcgagtttcatgaaaccaaaaatgctactctcgacatggatatatagagataagtggttattgagcattcagaacaatgaatccaataatgatttaatttacatcgtatataatcgagtgcacatacacaccaacaacctccagccactatggtttctctggatctctgtaattgatgtcatatggaatttttttttcttttgcaaaacaccatacagaagaatatatttatatgcacgtcggctatctcatacatccatgagcacctccacgagatctggattggtgtatcgtaatattgagtaaggcatcatacacatctcatcatcgatggacgcattgtctaccacttaacgaatagtatcataaatgtgagcaccatgtgacgagtcagaactcgagggtaggttccaccgtaagaaatttaatcaactgagagctactctctccattcatgtcacacaacagttttagtgtgctatcttgaaacagaaaagagcagataaagctaaagggttcatgtctaagcattcttgcacaactgtttctaaaaggacttctcttgcagattttcatcacaacagttttttacaaatgaagtgtcgcacatttttcataatttcattaatgaaaagttaaagggttcaggtctaacttaacggagaggaggataaagtgaatctagcctgctgacctagtcatctggacagccaaagcacaggaggcgattaaaaacaccatcaaacgtcaatcacgtagccatcatcattgttctttaactttcctcaatcaccactgggagatctttgacgatgatctttaaccattggaatcttcagttcatcgatcctaattgcagagttaagcaacctgtacatcaatctcttgtagaccagttgatgcatgattgttgcggagtgaaatatatgctcactagcacaacagtaggcatctatctcggcagtacatcaagctctctgtgtgggtaatgatgtttatccctgaataagatcataagggtttcaacaagtagcacgaaggccctctcagtgcttaatgacgtaaacactctacatctctagttcccaacatggtctgccatcagctgctctacatctctagtttccacaagttcattttggttggtctgatcttcgatagtacaagccgcctaaaactaagttcctggggcctccatttcctaccggttatgaccctttattgtgacttgcacctaactccataattcctcgaagatatacagttatacactgttttgatctttgagcattacaaaatggagtacctcttctatttataatgggctcacaacttttagcacaatttctccaccaccaaccatatggaattctgcgcggataggattaactaatagtcactctgtgaaatatatgtatcttgaatgatgactggtgtgggcacaacattttttatgaagcggtatttccaatggttctcaaacaacttaatctacaacctactacattctaagagcaaatttaatggtatagccaactatcggctccaaatcatctatagtcaattttatagctaattaattcatacaataatagttacacataaacatatactacacaattaatatctggtcccacctgtcatacatacatgcatctttgagtccgtgatgtggctagctacagatctgtagcccgctgctcctctctcctattttatctccacaaaatatatttatagctagtttataatctgctattgtacccgctctaaagctcaacatgcaaagatatcacattatcatccattagtaattgttacatcttaaacctcatacaaacatgctcttatctatattttattatattttaaagctttttaaatagaaccatgttaaatcatcatccgatgtaagttacataatatttcaacatatatttctccatcattttctacaatatcctagttcttcttcatttagttaatgttttctatcttctcattagaccatatatcacctaaattatttctagcctttagatgattaatctatagtccaaattttatccctcatttgcttcccacatgaagccacaccacctttcttttacttttaaattatcaatcaatattctactttaattattctaaaccaaatcaattctatggttcatagtcttttccaattatcgatcaaaaatataaattctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10486 - DNA, 374 bp, Oryza sativa
tcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcagaatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgct

SEQ ID NO: 10487 - DNA, 1087 bp, Oryza sativa
cctgctgtttgttgccccagaggaggacaacatggagacgatcgtcgcgcaggatgcgcttgtaatcacgtggaactcgtcgccagacaccgcaaatcttgcccgtggcattctgatagacactgagagtgcccgccaaggtggtctccagttgatgctcctccaggattacacccgcatcatcaacgaattgaatggcacgcggacgaccgattcgcgatgaggtgtagaaagagtagtatagattcttcttggggaacaagaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgg

SEQ ID NO: 10488 - DNA, 18760 bp, Oryza sativa
  unsure (1)..(18760): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaattatttatggtttagccttacattctggtaggccggtgtgtatgagtttgaataatttagaggagcttcatatttaccccgaagtggtagtttaggtgactaagcgtgtccaatacaacggtattgtgccacgtggagggttcccgttgtgtccgccaccatggcattaagtttaaggcgtgggcccgccacttaacggttctaggtcatatttccagtatgactaggatggaggaacacgtatcgtgctggtgtaaggctaaatcatgaattttggaaaagctttgatgcgggtaataaatcgggtatttatttatcgcgtgccatgctcttgcatgattattatttcgcatcatgtgggtaaagtgtagaaactctgcagagttaaaactaatcgattagccgtgctcgcggtcatgagcggcgtgtggatatgtattgagtatagacttgtgtttattcttctaaattctgaaatttaacttcaaaatgtgatgagatttgtgaatgatctccttgctaccatggatggcaatgaggtgtatatttatacatgattaatgactactttgatgcccaatatgtcaagtacttgcttgctgaaatttatttgaaagcaaaactgatttggaatgtttatacaaatcaaacgggtttatgctaaaaaaaaccatatcatgccttatatgagtatatgccttgcaagtagagtgcaatgtaacgactaaaaagtatgtactgactgttgctgatgaattaacctttaggttgcaggttaacacttagtctatgagtgatgcaggtaatctactgtttcttataaggtaaaccgctagtcagtgcacttgtagattgggtagacaagcttccgttgttctattatttatttggccggtcggccaatgtaactaaagtagatgtagtttataatcactttcatcttaattgtgtttgctatgtatatctatgattgagatgaaagtgtgagtctagtgcacatcctgggagctagattcacatgagtatgagttaagaatatttgagatgttgtagatctttagccatttttgtcaagtctcctgaatgtgtaacacatctggtcgctgccttcgagtggtttgacgagcacatctcaggcaaaagttgactggcaggctaaaggcccagcaatgtctccaatattcctctcttgaggcgtcggatatttcattgtacttgtttgatgattttagttattcatttcatctctcaattataatggaaggtccggagagcctacgacagtgatggagtacagatggacctggattttggtctatgctccttccggatttaccttggcacgagcagggactgcacattgcctgtatagggatgggggtgaaaccggaggtgggtgtgttggttaggggaggctatatggagggtttgtcatgatttccccctttgtagtatctcggtggtacttcggggcatggtaacatgtgtggaatcgtgtcttgtgagtaaagttgtacactctaatcagagtaaaactatttgaatagccgtgcctgcggttattgggcggtcaaccagctcaccgtgactagtctcaccttaataatttgacctaatgaactggtgtagttcaggtggtttgggttggacctatcataacatggttttagcgttggatagtgatgatgttaatactacttaattatctactattttactgctttcaacttatgatttataaatgctgcttcttacttcaaatatcctatcagccattcctttgaatatccttgcatgataccttccccttggtatgagttgttgagtacggtggtggtactcagccttgctttatttttcccaatcccagaggcagagaatttgtcggatggtgagttctatgaagattaggcttgtgccagacgtcgaggttttgcctgtggattatggtggaagcttccctttgctgagaagaataagtttagatggtctttagtttttttgctgcttttctgagtttttttatatttttgtaagacgtggaactgtatcaaattatcatctgtgtactctgcttgatgcctggatagaggttaaatgcacagatagccggtgattcgggttgtctaatctctaggcgtgacacatacactccattccaccatataccacatttgtcatccacggaataaatactctagaagaagaacaagactaaatttgctgcaaattttcttttgattaaacttggtctgccctcaggggtcgtgtacaaaggcatatatagccattacatgtgttagaaactaactacgaatcaaatacaacacaatatagaaacctctctgcagcaccgtcaatttgatttggctcttgaggtgaaaccagaaggaatttgtgtcctaggccctatccaccaagtgtgtcatgaagttagcttttcaacaagtgctcacacgtccaaaacggactccggacgagacagaaacgggcgttttagtcctggtatatccaggctggcccaaaccgagtccgaactgaatcttttcttccttgtctagaaactccttgctttggaaggcttcaatccatggagaaattatagatggactccttcccaacccaagatgggccataggatagtataactccatccaaacatgccgttcaaagccgacgttcatcaccattgttgttacttgcgcgttgcccgttctacccgcacatgatgtcttcaacttgagattgccgttggtagaaagctcggaatgacatgccgtttgatccgatggaaagtggacttgataacctttcctagtatataagccattcatgttgaaagccttctcatcaatgcagaattctccatgaacttcatgaacagaatagcaattgatcttcctcatgtacgccgctacaacggtcacctccgactggacccacatgttgtttatgccagccaagggttccaatctctcaagtgcgaaatattatgtagcatcaaattctcatatatttcacacatagacttagagagaaatgagctcaccttttgttctgatctgtaagtaaagaacaatgtactattgataggtagatctggatcaattcttcttcatatgctctcgatactttagttcatctaagtattgtctttactttatgtttgtattggtacagtcatatagttagcctaccagagaggtgcaatggtgtgggtttaatgtccgattactcggttgctctatgtcatctcgagggatgtagagtagtatttaataatgtagacagggtgtctagattactaagtatcattatctgggtttatatgctacgagtcagtaaaggtgggctgctaattgtgacagctcagtacgggtattcctccacgatagtatctaatcctaagaaactttcctagggagggtactcctccgtatttagcctaggttggacggccatggtaggttgtcgtaagaaactcggcaacccggggtagtctctcgaagcaccaggagggcactgttagggggtattggctatatggttgtatactagtagatgtagactaaagttgagtgtatattagaattataggaattgattgttttttctatttcttcttccacttagttcagaaatgattaaagaagaaatatgagtgctttgcttcgtgtcactctacccatataaatattttaacccatgcttagactttgattatgtaagtggcatgtatatatattattagcatagttctctcttacaatcttcccttgcgattaaataaatacgataccttagaatactcccgggtgaaatgctacaatggtaaatccgtgcgcttgcggattctttctgtaaaccatatatataccaggaccatttctagcgccattgctgggaattcatatttctagtaatatcgttaagaaataccaacaacaggctggccggactagagggacaggatgcaacattccttggaacattgggatggccaagtacaacgcacaacacaggaagcgcaaacaaactaaggaacaaagagagggtcgtcttagagaatagattgtaagggaggttaaacaaactaaggaacagacagaagatcatcttagagaacatattgtaagggaggtcatgggtgaatgttggtatttcttacgaccaaagataaatccacaagcgcacggaataccgctgtagcacttcaccttcgggtgaccccaaaaggatatcaaactcagggaatgtgtgtaatctacctagggctaagacgatccaaggacaacaactataggtaggcaggctagagaggactttctctgtgttttaattatctaagctaagcaaaggtaatttcctatctgttgctacgggcaccgacccctgctggtctgtcagtgtggttccggctatagctctatgatgtacccgaacatggaggattactaggacggaattcagggctgtcaccacctgccgtctacctctgacaaatccgtgggatacacaacaaacaaaggtaatctctaacctagacaccaggcctaagttattaattacttctctaatacttgcgcaggaaattccttctctatccggagtcctagtactagagcacttagtataaatactaaataatgaacctgcaaagatggaaatatatcttactcagactaagtaattaaataacataagaaaggaacacgaatgcttacttaatagaagaagttctctgaacctagagcaaagtgtaccaacagctccagtactcctccagaattcctactacgaagctacactcgtcgaggcagaagtcggatgagcgccaaacttccgggcactcctctagagcttcccctcactttctacctatttctaatgtacaaaagatacaatagagcctcttgtaattcagctcaaagttgtgtgtgcttgaagtgagatgaagacctccttatataggctccaaatgacagttaggggtatgggaaatgaccaaaacaccctgcaactgcctaaggggagaaatccgagacgtccaggtgaaagtagttggcgggaagcaccaggattggttcggccgaacccaaaaactctcctcctggcctctcctttggtcgggaggttggttaatgggcccccaacaacctgggcgatgttttggtccaattctaaatagtttttattgacttattgggcctctaatccgtgtaaacgcatcctgaatgtgcggaggtgcattttgtcacatgacggatgtgttttctcctcaaattacctgcatacacatatttcaccaacactagtggaaatgattagtaataacacctaccactaagttggataccgtgttttatttcattatttgcaggtattgatggtcagatattatgatttaaggaccgtcaacaacacccccacacttaacctttgctcatcccgagtgaaggctatggactctacaacagagttatgacttcctaactaatcatcatgcaaacaaattattcaaagccatacctgtacttgtcgatctttatagtgtctaccatgcgatcttgagcaattgagaaatggaacaatcttgacattaagtcaccctaatttttcatgaagaacaacttgtggtttttgaggtaacacaaaattataactatgctttgctcctccattgattctttcgatcgctcaaagtgtatgattcctcacaaggcatatgattgtgccttttcttttcctaccatctaataaggcttttgtggagctcagggtatggaaaagagtagagcattacttgcatcacatatattgcaaagtcaaataatggatccacggaaatacaaaacatactttctggtcaagaatgtgcatgtgtatgtgtatgtgtatggtaaatttgtgggtggaaaaaaaatgaatcaataactccttttgtatacatcctcttccatttatttctctttgaaaatttcaagagtgcatggctatctcttttttttctttttcttttttttctcatcatcatgctcaatacttgtatgagcattttttttctttctttttgcatagccatgcctctctctcaacttttttttgaaagaacttgtatgagtatttatttgatggatgaaatgaatgacaaatgaggaatgctaacttgcagtgtagaagtcaagaataggtgggtgtatgtggaatgtgtgtgatcttgaccatgaaagtatgaaaagcatttcactagggtcacaaaacttgacaacgctcaatgtaatgacaagcagcgtatgtagcaagctaattattaatgatcaacctatggctcaagtgggaataaaaatatcaatgagcagtttagcatcattatacaagttttttttcattttataaaattcccaagtgtgcaacatgaagagcagaatttctatcatcagactatatctcattcatcaattacttagatagcatggggtccctattggataagtcaccacaagcaacaagtaatgagcaaagaataataggcatgcatgctattttcagggagaccatgaactctaattgtaccatccctagtttgagtttaattatcttcgatattttagaattgatagtcaaattaaactcaagatagaatggatgtccaaaggaaaaattgtgcaaacatgcgctctgtataaaatagaaaatgatccttggtagagatagtttagccgaactggagatttggctgacccctcactaggtctaactgcatcaatttcccgtgtgtggtttgtcatagctcgtctggggtgatcttgcttttgttacggcgttgatgtgcaagatcacccccacacttgtcttcgtatatgagaggctttattggacacaaaaaagaaaaagaaagacaagagtgaagcaaaaagggctcacatggttggaagaccaaggagccaactttatttttttttatttttttatttttatcatgaaagctagacctaagataactagagggaggcctaaggactcatggcattgaaaactaacggatcaaggggggacctaaagactccgggtagaagctaaaagagacaagattcacaacatccaagtcatgatcaacttctaacggatcaaggaaaacttttaaacaatggccatttaccttaaagatgttaccttcgttgtcacgcagcgtgacggctccatgtgatgaagcatcgacgatgttatatggacccatccatttacttcgaagttttctatgtccgaaaagcttcacccgtgagttgagcagcagcacgttgtcccctaccttgaattccttgtgcttgatccactaatcatgccatcttttggttctttccttgtagatcttggcattgtggtaggccttgtccctccattcctctagctcagagaactgcatcttcctgtgctatccggctcccttcaagtcgatgttccaagtccggatagcccagtgcgccctgtgttccaactctaccggaaggtgacaagtcttcccatagacaagttagtatggtgacatgccgatgggcatcttataagcagtcctatatgccaaaagtgcatcaggtagcttgttcttccatgcctaccccatctcatttacagtcttttgcagaatattcttgatttgtttgttgctcatttctgcttgtccacttgtttggggatgatacggagtggcaattttttgctgagccccaagttcttgcaaacagttttggaaggtcttatcgataaaatgagaccctccgtcacttatcaccatccgcggagttccaaaacgatggaagataatctcatgaaacatccggcgggcgtgcttggcgtctgcggccctgcctctacccacttcgacacctagtcaacggccaccaggatgtacacgcagtcataggactttgggaaagttcccatgaagtcgatgccccatacatcaaatagcttgacttgaaggttgtgtgtcagtggcatcgcatctcgagcagtgatccctccatgcttctggcatctagtgcatcttcgaacgaattactttgtgtcatcatacattgatggccaaaagaatccactctgccagatctttgcatgtgtcctgaatgctccatagtgacctccatatggggcagcatgacacttctcaatgatcatgatgccttcgtctgtcgaaacgcatattcgcagtagaccatctgagcagactctgaaaaggtaaggtgcatcccacaagtgcctgcggctctcgtagatcaacctcttcttattttctaccggtggtacatgacccgtggccatgaagttgacgatggttgcataccacgggtcagagtctatgactttcaaccgcatgtcgtcccgtagatagtcatttatcagtagcttctgcatgttagtgatttgcatacgcgacaaatgatctgcaacataattctctactccctttttatccataatttcaatgtcaaattcttggagtagaagaatccacctaattacccgaggttttgcatcttttttagtaagcaggtattttagtgcagcatgatcagtgtaaacaactaccttagcccccactaaataagacctaaatttctcaatggcaaacactacggctaggagctctttctcagttgtggcataattaagctgagctcccgtcaacgttttactagcatatgtgatagcatggtgttttctatccttagtttgcccaagaacagctcccacagcaaaatcactagcatcacacatgatttcaaacagcagcgaccaatcagagggttggatgattggtgctgagatgagtgattccttaaggattttaaaggatttcatacactcatcatcaaagtcaaccggaacatcattagctagcaaggcagttaggggtctagcgattttggagaaatcctttatgaagcgcctgtagaaccccgcatgacccaagaagctacggacacccatgtcattgacaggaggtggaagttgtcgaattacttcaatttttgctctgtccacctcaactcccctttcggagatttgatgtcccaggactattccttcacgaaccatgaagtggtacttttcccaattaagtaccaagtccttttcttgacatctttgtaagaccttatctaaattctccaaacaatgattgaatgttttaccatagactgaaaaatcgtccatgaagacttccatgatatcctcgatcatgtcagagaaaatagacatcatgcatctttgaaatgacgcgggtgcattgcactacccgaacgacattcttcgatatgcatacgttccgtatgggcacgtgaatgtggttttactttgatcatcgggatagatggggatttggtgataactagaatacccatcaaggaaacaaaagaaggaatggttagccaaccgctcaagcatttcatcaatgaaaggcagcgaaaagtgatccttcttcgtagccttgttgagtttcctatagtcaatgcacattctccatcccgtgacggttcgttgcgggatcaactcgttgttcgagttttcaacgaccgtcatgcctcccttcttaggcactacttggacagggctgacccactcgctatatggtacgggatagataatcccggtatgtaggagtttcaagacttccttttttatgacctctctcatcgcattatttagcctcctctgaggttccctagatggtgtgctagacggttctaagagaatgcgatgagtgcaaagggtcggactgatgccttttaagtcttggagggaatagccaaaagcagcactatgcttttctaaaatggcgataagtcgggccatctccctctcagagagtttgtcacttataatgactagagactccgcatcgctgttcagaaaggcataacttaggcttgacggtaagggctttagctcaattggggctcgtgacggcagatccgtttttggcagatccatcgtttctccagtttcatcctccccttcattgaattcttcgatggattcatcgaaaatagactctagggtctcgaatggagaaatagccatcactccctcaattggctcaggaacaggaagagactccatcaaagaattggttgattgcaacatagggacggaggtggcaattcttcctattttcaggttaaggacaccggtttcgggcacatctaagagtttttctatgggatgccctatgagtatgtcgaaatcatatatttcaaacacatgaaaatctaatatgacctcaacactgttgtgccgtgtgggcactccagagataatccctaaaccttcggtagtagagtttgtggaaattcggaaggttctgacggttggttccaacgatctgtcccctaagcaatcgaatgcaaaggttgcggacataatattggcaccaacagagggattatacagagcacggaccgaattacctccaatgtgacacataatggttgaggaggggcatcggatctgaatcgattcagataagagctctccttctcttaaccatttgttactcatgatgatggtcaacctcttcaccgtctctttaagcatagatttatcaagaggttcattagaattgaccttggtcggtggtctcttctctcaggaataattcaaggtgttctaataatcttcgaaaagatcctcctcgaattggaatgaaatttccggaggatgaatttcttcttcctccggctcctgcgaccgggatgaggattcgacagttgagtcgggttccaactccacgtgcagaggttcctcatgaataatctcgaccttcgggacggcttcgcttcggccgaaagaatcgttctctaagatcaaatctaagagttctcttccttcggcggttgtcttgtgtgcgaacgatcctccggcagaaatattgagattttcggcaaactccttgtctaacccgtaccgaaaatgttgcaacaacacgtggtcgggtaacgacaagtctgggccagattgagttaacagtgagaaactggcctaggctgcaccgagatattccttctcattctgtcgaaaagaaaggatgtctactcaaagattgattacacgggttaatggaaagaaagtaaggcagaaattgcacttaagctcctcccattcacagtggaatttcttgacagatagagtgtaccattgcttagcttcatctctacgagaaaaaggaaacaatttccacttaagagtatcatgtgtcatgccgacgatagataggcacgaacacactagctcaaagtcctgaagatggaggtatggattttcaccgatactaccagagaaggttttctctcgaaccatggctataaagccaagactgatttcgtagccatctaggaagctactcggccagtactccagtactcaccgatactccagtactccttcagaattcctcctaggaagctacactcgtcgaggcagaagtcggatgagcgccaaacttccgggcactccttcagagcttcccctcgctttctacctatttctaatgtacaaaagatacaatagagcctcttgtaattcagctcaaagttgtgtgtgcttgaagtgagatgaagagctccttatataggctccaaatgacggttaggggtatgggaaatgaccaaaacacgctgcaaccgccttaggagagaaattcgagccgtccaggtgaaagcagatgacaggaagcaccaggattggtccgcccgaactggtaggttcggccgaacccaaaaactctcctcccggcctctccttcggtcgggaggttggttaatgggccccaaacaacctgggctatgttttggcccaattctaaatggtttttattgacttattgggcctctaatccgtctaaacgcgtcctgaatgcgcggaggtgcattttgtcacatgacggatgtgttttctcctcaaattacctgcatacatatatttcaccaacactagtggaaatgattagtaataacacctaccactaagttggataccatgtgtttatttcattatatgcaggtattgacggtctgatattatgatttaaggaccgtcaatagtgaacttagccatgaattcaatgaaaaattacacggaattgaggctaggataagggaagagatgctagccaaaaaggaacgaggacaacggacatccagaagaagtgcaagtgagcccctgcagcggcgaagtagttgtttgtcaactgggattccagaatgacatccacctgtctcagtcgaatagtagttctcgttgtagctgatgtgattcgtacaacttaaactaatatttttttctggattgtatgcagggcgtagcccaatgcatcctacaagttagggttacacaaacattctgttgtcatgctgccgagggctaaccatacaaacctactccataaacaagagttcgcggtgcagatttggtggctagacatgtcaaagtacaagttgacatggtgaatgctgattggatgaactggcaacttccaatcccgtggtatcttcatccaatggctaaaagacctcatcatcatcaaggtcactttgaggacaactttagctccagctccacctcgcccagattcttccacaaaagtcccttcacctcctctggccatcgaagctccatttgagagccatggtacggacttcggtgaaatggccaaacttcaccctcctccgcaaaacaccaaggccatttcatctccaccgatggtgcaaagaagggcgcatcatgcaagagatagatcaaaaggaaaaagaaaggcacaagagccgtagttacctcccaaacaactagatctggataaggaggtcaacgttactccaaaaaacaagctccaggtacatttcagcaacaggtgccattggttgcagaccatgagttagccaaaatgggttctgcttgccaagtgctgcatagatactacatggagaaaacaaactccaagagcaagatgagggacacgtccatagtaggttaccacgaccaagaaccatccttggggcaacaaaattattttgcagtggccttctcggatcttttttacctctataagctacgagcagtggacaccggcttgttaaagtgctacacattgtaagtacaaataacaccaaacttacatactattaatacttgtagaatgcttctaattgaccacacatgtgaaccttgaaggatacgttcgaaagaggcacggaggaacaaaaaccaggtgaacagataatgagataatgaggcagaacttcaatctcacttggatgatgtgattaattacttctatgaaagcttaagggcccactaggatgaagacttcatcttattagcacacaatcaacagtgaatagtacactacgttaggaattttaaattttactacacatgtgtggtcttcaacttccagtatattaacgttgcagattccattggataagtgaaaaatggagtagggtatacttccttaactccaaaataagaaaaaaaaatacaactttacatctatgaaggaggactttaatgcggcttgggagaaatatgtcaacaaagggggtcggcaccgagaagatatacccgacctctatcaccatgataactacaaatgcaagaaacaaaccggcgaaacctgtgtatttcatgtatgtcatcagatgaagattctcgctagaaaggtgacctccttggatcctgaggttcatgggtttataaaatcggccattagtatattacataaaattaggtttgcgtatgatatgtactaacttgatgcctctttcagaatgttatttccaacattccagagcacaatttcgccgtatcagagaagaattggctgtcttcatcatacatgaagttatatcttcgaagggcacctaccatactagatgatttatcgtgatcagttaatcagatttgagtgaaaaatatgattaagtcatgactttttatgttggaaaacaattactatttgattatgtttaatttatctatgtacacttgtaaacatttatgttagaagtaatatatttatcacttctttcaaattgcatacttatttcacatgttgcaataaatatgcatggttgtcccttgaagatgcttcacattttggcaaggaaagaaaggtaataaattgttgaatttgaatgtgataataatgtgggttcaatatgtgaatgtgaaatgtatatatttgtatgtgaatgtgaatgtgaaacttgtgaatgtgtgagacttgtgaatttgattgtgaatgcgaaacttgtgtgaatgtgaccgtgaatgtgagcaaggatatgctggattatattgctgggttattgggatatgtagtgggcttggctatcatttgcctgaggcaagccaataaaacaaatttaatttttttgtgaaaaacctcatccctatcgggccgcaaaagcaaaaccgtcaccagaatgtactacattgtcgggttgcactactagcccgtcatggattatcatccgtgataggccctaagacatgccgacaaaggtgggggcaacacctctgtcgggttccatttggagcccatcatggatgattcatccttgacgggctctaaacacctaccatcaatgtgagggcaacgtctttattggagctcaatttgaggctgtcacggatgagtcatccgtgtcgggctggagaacctatccatgaagggttttatttggggcccgacagagacatgcatcattggtgtcggagcatggcccgatacagatgatagtttcacatcactgaccatgaacttttctgacacagatgagggttttgccccgtaacggatgaccggttccgtagtagttactcctcctcacttatggccttgtgttccatggctgcgacctcaaacaccgtgaggattaccaatgcgcaaaaaaaaaacaaatgaatcatgtccctaattttcttaaaaaaaatcagttggtccaaatatttctgttgagcaccagtgaaatatcctaagaactggaatagacataaaaaataaaacacgtgaaacacatcgctctcacgcatgaaacatcgaattttaacggttgaaacatttatattcctcaaaagataatcataggagatcattttttaatgatttatcttcaataaatacaatggtgaaatcagatcttaaataaagatacatagtttagggaaaacatcatttgaggctcgtgtgtttggtctggagccttctccttgttaaatgcgtgcatgcttgcatgcagacttgcagtggacgaaaacgttggttttgcatgggaggcgcgggcgaccaaatgagcttgcatgcaaacttgcagatgggtggtgttggttttgcatggtagacgcggggtccgatttttttgcttgcatccaacgtccagatggaagcattatcgtaaaaaaataataatccagcaaaaaattcgagtcagaagcggaagcgaaattctttccggccaaatttcatcggcgcattggggtggagtttgatctcttgcaagacagatttgctacgaaagtgtgttggttggtggcattgtgctgcgcatggaggttgttcctagaagaaggaaggaagggtgccggtcataggcttggccgccagagacggcggtggcaacggcagggagggcatggcgctgttgcggaggctattctataggaagccaccggatcgactcctcgagatcgccgaccgcgtctatggtaaacccatgcttcttcttcctcctgcaatgttgttgcttttcaaatgctgaggaggatctggggaaacgctgcagcaacatggaagggttaggttgcgtggaattggtggaattgtgtaatgtgtcattgattctagctttggaaatggggctgctttgtacattcactcaattaatagatacggtaatattacttatcaacctagataatacaatttcatggattatataggtttttaatatgttgttgaaaagtctacgaaatgcatatcggttttttctctgaattaattatgtaaataaaacaactacttccttatgtgatagcttcacagatattacatccattcttaaatacaagaacgtctggagttcggcacaagtattaagaaagtatgtagaaataaatagcaaaaaaattatgattggttcacaagggaaagtaggtgctgaaattaattgagaaatgtctctgattggttgagaagaggaagcaggtgtacaagttgctatattttgagatattttttaatgctagaagctattatattttggtaaggagggagtagcttgctaatgtttctttcacaggggaaaagtagcttgctaacattctgcagtgttactaaaatgttagctaagatgccttctagaatccaatttgacttgaagagaaattgattgaaatatttatgcttgcagtattcgactgttgcttctctacagaaaccatggaacaatttgaatacaagaattatctggacaacattgttttgcaacttcgtgagcagtttgtagattcttcattgatggtatttaacttcagagatgaaggaaaaagtctggtttcaggcttgttctccctttacggtatcacagttaaagactatccctgccagtacctaggatgcccattgcttcctttggagatggtcctccacttcctaaggttgagcgagaggtggcttatgctggaagggcagcaaaactttctactcatgcattgtgagaaaggcggttggccggttttggcatttatgcttgcaggtctccttctatatatgaagcagtataatggggaagaaagaactctagtcatggtttataagcaagcgccaaaggaacttcttcagatgttaacaacactaaatccacaaccttcccatcttcggtatctacagtacatatgcaaaatggatgatgagcttgaatggcctatacaaccaattccttttactttggattgtgtaattcttagggaagtacccaattttgatggtgtaggtggttgtaggccaatagttcgtgtatatgggcaggattttctaactgttgataaaagatgcaatgttatgttgccaccatcaaagcctaggaaacacgctaggcgttacaaacaggtaccactaatcgcagtttatctcaattgttgttctatttgttttagttattctttaactgttgtagcaggcagacaatatatcagtgaagttaaatgttggatcctgcgtgcaaggagatgttgtccttgaatgcttgcatattgatgatagcctagaagatgaaaggttgatgtttcgggtgatgttcaatacctattttatccaatctcacattctaccgttgaactttgaaaacattgatgtgtcatgggatgctgaacaacggttcacaaaaaaattcaaggcagaggtaggctataatttttcttgcatacatgtgaaatactattttcaacataataaaatgtaaatgaaagtgcatgcctgaaccaggtactcttttcagagtttgatggtgagtctgatgcatccatagaagttgcatctgactatgatgacgaggtggaagttggctctatcgacgtgttctttgaagcagtagaaattttcagcaatcttgactcacaagaggggcagagggatgctgaaatcctttctataacttccacagagtgttctccacgtgctgaactaatgaaaactgcacccttttcccattttgacatggagattggtcttggtggatctcaaaaaaataaaattgatggcatggttttgtcactagaaaagtcagatgaaaaatgtacatctgctgaaggagatattatacagaacaacataactagagtagtgaggtcaagttcagcaaatacaactgatggagatagagatactatgaattcaagttgttatggaggtaaagtggatggctgcatagtagaaaagaacaattccaacaaggaaatattgacggattccaatgaagactcggggatagaaaatgtgttggtaaaggaggtcattatatcagaaactaatagtctaaaggatatacaaatgatcaaagaggtcataatatctgaggtcacaacttcaaaaccagtaatagaggtagatacaataggaaccgagttaagtgatgtggtccacaattctgaaaccattacacatgcagaggctaacaatgaggaagaagttctggttactctaaaacagaatgaaggggataatctagtcgaagaatgcatttattatggcaatagcataatgatcaaaccagaaaagaataggaagaaagaaaaatctattatcggttccacaattggtgtagtacctgattccacagaggagaatgctagggtgggacttctattatcagtgaaacctcatttggatagcacgggcacttatcatgatttaaattctccctgcaaaagattgatctacttaatgtttcaaatactaattg

SEQ ID NO: 10489 - DNA, 50292 bp, Oryza sativa
tgtcttttaatcagctttaccttcaacctcaacatcatttacagcttacatcaactatcccatataaaaaccgcacctcctcctccaccaccaccacctagaggacttctagaaacttcatgtttatctccaatcacatcctccctaagagaacattcaaaaatattacctccccctcctccacctctcccaaaagaatgtttgccaactccatctccacctcaatcccctgattgtccatcttttcctacaaaatatgcaactacatctcctcttccatcaccaccaccaccacttctacataaagtacatgaatgtgttattccttctcataccaggcatgttgtagtacctgcaccaccaccaccacctccctttggagaacatcattctacttttagtaaagatttaacgacatcaccttgttccttttatgaagatcatgcaaaaaaatatactagaattcctctaccaccaccacccccagaaggtagccacggaattttagctacaacttctactgaattgattgatgctggtcctcaattgccaccattatctcatcttgaatggaaacggtgtccacatcatcctccagaaaggccacattatcttccaggagaagttggaggagctccatcgccaccatcaccaccttcttcttagagagaaaatacatcagtaggaattcaaggtggcattccacctctgccaccacctctgccaccaactctgggagattatggagtggctccacctcctcctagcattggtgcaggggctccaccacctcctcctccacctggaggaatcacaggagttcctcctccacctcctattggagggctaggtgggcatcaagctccaccagcacctcctttacctgaaggaatcggaggagttcctcctccacctcctgttggagggctaggagggcctccagctccaccacctccagctggatttcgaggtggaactccacctcccaatgcacatggaggggttgcaccaccacctccaccccctagaggacatggtggggtaggtggcccccctacccctccgggtgcacctgctcctccaatgcctcctggtgtgcctggtggtcctcctccaccccctggtggaaggggtttgcctgctccacctggtggcagaggtgtagtaggacatggacttactcgttccttggggctgaactcagctgccacagcaagaaggtcaactctaaaaccactacattgggttaaagtaacaagagcaatgcaagggagtttatgggcagaaatacaaaagcaagcagatgctaataggtaccctcttgttttttagctttttgattactagaaaatataacttctctacctctttcaccatagttacaacaaaaaatactgtagtgtaaacccgctgctatttcaatttatttctcgtatcatttttttaataaaattttactaactggtagtatcatgtatgtagccattctgaatttgatgtgaaagaattggagtctctttttgctattgctccaaagacaaaaggtggttcaaaatcagatggagctagcaaatctcttggatcaaaacctgacaaagttcatctggtaacttactctaacacattactatgctaaacagaaaatattcccagtacttttgtttaatctactgctatgataatgaattacttgattccatgcaagtgtaatgcgcacaaaattaataattactttcattttagaagacaagttttctatatagttgcggaaaaacctcattatcatattcacttttgaaaatgtgttgatggctttttgtaccgagattgtatctttagttcatatatttatatttcacggtattcattagcttctctctgacaataaaatctgcccttcattaattactggtatcacttgtgttttctaagagttaccttggtgtctttgaaatctacagattgatttaagacgagccaataacacagagatcatgttaactaagatcaaaatgccactacctgatatgatggtaagcaccctgctatttcttttttgcctttattgatgcacaatagttggacaaaagggcaaggtcattaaatgtctttgttccttgctaatactccttcagtaccatattagttttagctctaacctgaatcaaacttctctaacgacgaccgagtttataggaaaatgcaccagcatctaaaataacaaataaatgcactattaagagctatttcatggtggaattaatggaactaatttgatgttgtagatgttgatgtacttttatataaactatatcgaagttcaagaagtttgactttggacaaaactacataacttactatattggaacgaagggactaatatgactactatagtgattgaatatctatcgtgcgctatattatttccttggcgtagaactgatacaacatccaatatagctcgcttttaaccagttttgcatatgtgggctattattttgttgtttgggaattgcacacatagacctttgcattgtgacaacatccaacatagcttgtttttaaccagatttgcttacaatctgaagattaggtagctgaccaaaataaatcatcaacagagtttatgaaagttttgtttttggtgattgggttcttccactggaaagtagggtgtcagcctgcatttaagtgataaattaagtgggattccctactaacaaatattgagaattttttgggtttccttttgccaagtaggatgtagaagacattttatcgacacaatcaaaatttcatgtgaagctagcttcacatactttagatctagcttcacatactttaccacttgcgagagtgctcggtccagctcaccaaccgtgggtctcataagttacattgggcctacttcaccacaggtccaactaaagccacaacttcagatcctaggtctaaacaaaccaaaaggtggtttgatgggtgagtataacctccacatgttaagccatgatcccccatcatcaattatcaatgtaggactaaacccaacaattgcatcggatatgtaggcttcagctaaactacattactaaatatcatgtgttcctgtgttatctctggaatgtcaaagttgatcaatggttgcagcaatcaggaaggttagtcatcgtttcactatatcgattaacttctgcaacactaccaatcagtgaaggccaaacactcgaactagtttgagatagtttctttaaaaacagggtagcaactccaaatccacaagtatagtcgcaatgatttatgttgaatattttcaagtcaatctgcatgcacttcaaggatttggatttggtttcgaaatttttatgaaaatagatctacaatggagacacgaatttttacgtggaaaacccttacaggaaaataccacgggtgccgaccgacaatgatcataattgagaagttgattcaaacataaaggaataacaatgggatcgtcgccacttcctatacggcttacaagagtatatataagggataaacggaaagacacacaatagggaaagacgtgatgacctactaggaaactagtctgaatattttgtcggcctaagatttggatcacatatttaacatgttttccatctggttcagctaatgcttataggaatgtttcaatcacattccatcttgatattaattaatacaccatatttagtccattttcctggagctgaattgtataccctgaaaccatttgcattttagaccaaggatcacctccgtttgatgaaactcagttcatgacatttagtagctacttcattcttaagaattattcagatttttagtggacatttactcaaaagttactcccattttttaaatggctaccggtaaggcttaaggtgcttcatccattctatatctactttctctacttgtaacagagtgctgctctagctttggatgattcagttctagacgctgatcaactggaaaatctcataaaattttgcccaacaaaagaggagatggaacttctaaaggttgttttaaaattaaagcttatatttccttgcactccttctgtaatctttaatttttctcttctctgaatatcttgcaaaagtaaagtatttgcactttttcctatcagaactacactggagacaaggaaactcttggaaagtgtgagcaggtaaaccttcatgcatgtttggactcttcttttgttatatattgatttgttttcacttatatttgatcagaactattgaggttataactgacaaattatattttgtacattcctattcatctcctccgtctgcagttttttctagagcttatgaaggtgccgagggttgaatctaagtttaggatatttgctttcaagattcaatttcaatcacaggtcatacactgttgaaattttgagttattatctccgtatttgaaatgtccatagattttcactatcccccttttcatttccctcttagattagggatgttagaaagaatttgctgactgtgtcatccgcttgtgaggaggtaaatatgttttaatacacctcctttggattaataagtattaatgtttatcacgtgagagctcatttcaatatgtcaatcagctcagaggctctgagaagttaaaggtgatcatggagaaaattctgtttctaggaaataaattaaatcagggaacaccaagaggtaatttactgcgtctattgacgagctataaaatctttcaaataaactttcatgcaaatatgtttagcttaaaatcattttgcagttgaaatttcctggataatttctaagctccctcttcattaggactaggagggagaaatgccctgtgacaacttcactgtatatataattacatttatcctttccactattatcaacaaaaataagttgtttctctaggtgcaacaatgtaaaacaattcaggctatagattgaagttgtttgaatgtcaatttaagtactgtatgttcaagatctgtgggtcactaattttagcttccctatacctcgtattcattgaggaagaaaaaatatttaatttttccttatcttgttgcaggccaggctcttggttttcgcttggacagcctattaaaacttacagacactcgtgcaaacaacagtagaatgacactaatgcactttctttgtaaggtatggagatatatagctgtcgtacactagttgttcatataaaatcaagcatgagtatgaaagataatgttgatcccaaaataataaatttgtctatactaattatgtggggcccaaatatcagtggtggtggccaccaccatcaccacaaggaatattcaaaggagtaaagatatattatgctcgtaggactagaaaagaatgtaattgtgatattttgcttttcaccacatttcaccaaaagagtgtcttgtaattacatacaaggcactcttcatgattaatatacctcaatagtgctatgtacattaactcaatagtgctatgtatattaactctaaaacatgtagttctttgataacttcatcactaaatcagtagttttgtgatacaatgctataaatctgtagttctatgaaaaatttggcactaaatctgtaatttcgtcatatacatttttgaatctgtagttttgcgatagtttagttaaaggcagccttagttaaaatatcgctagttttgtgatatttactcaatttgaaaggccaactaactagctaatttctttgtcatgtttaacttgtcatcatactgcttattttgctcctctcataaaattctaagtttgcttctataataagctttaattcttattaactcgatggttggtttaagtgtttatcagggccttgcggacaaatcaccacatttactggatttttatgaggaatttgtcaacctagaagctgcttctaaggtgtgtatgtcgatctgacgagagcatccaaaggacttgtgttgataaaaaaaattatacattgtttagaaaatggaagtttgtattgaacccaatcaattacatcacggtgcctctgcataactaagatacacacgaccacactcaacaaacaaaaaatggagaatatcatggatttgtaaggaccatcaatcgaaagaataaatcgtcacccatgaacaactccttaaatatatcctctaaatgcacaaagtattaagagccaccaatcctaatactagatctccacccatatacctgggtaaagaactccttgaccaccttctccaaatgtagacatgccgcaaccaccatatcccgcggatcaggcttctgtaggatagcccatgtacgaagccaatggataagacaatatataacctgtaatagtgaagttatgattttttttaatcaaaatatacattattcctgcatagccaaagcaaccaacaagtagcaaatgctcttaacaggacatgtgcttttaaattattatgaattccagcaaggcagctcccaaacatatgggctacactatgcagtggaggaagtccaaatgctacttggaccaaacagaatgggcaaaatcaaaaaaaaaaagatgtctaattgtctcatcattgtgacaaaaacaaccgttcttattgctttgccagtttccttttgtcaaattatccatcgttaacaccactccacaatgaaaataccaaagaaaaatcataacttttaagggtatctttagtttccaaagatgtttattaatattaagaacattgatgtgaattagagctaggtaatgagactgcaccgagaactccccatttgaggttaagttctaacgaaactcgtcttgctcctgagttaattgaaaatcagtgatacatgataataaatacaagtttaaggaccacccgtgcattttactcataataaattattccaagccacctattttgatcctataaggtcccttctccatgaaagggaatgattggtttctaagacttgtgcaacagtagccggcttatgcttaactatattttgaaggcaaggatactgttcttttaaggttgaattgcccaaccatttgtctctcataacctgatttgggagctatataaaggatccaaaccagagaaaatcccatttctccttcatgggggtggaccaaaagtataagtccctggccttccactaagcttgagaaagaggtttatcacctacatacttattacatatcaactgttgtcaaaccccttccgtggagagcaacttgaataagcacttactaagtagagccacattcttaatgtccaaaacatgaattcccaaccccccccccccttgttccttggggaggcactttttttctctgaccaccacatttccagtaaacctggagcgaaaatacttaagctttgtaagtatcccctttggtatggcaaagaaagacatcatatatctcgggaggctacttagcactgaattaatcaatgttagccatcctccggtggacaggagttttcctttccaactactttgatgtttttcaaagcattttatcacatctttacaatcggcatttcttaatctcctatagtgaatagggatacctagataccggaatagaaatttaccagtggaacaaccaaagagctccatgtattcattgttaaactcgttcgcttcaccaaagcaatataattagtttttatggaaatttatcttaagactgttaattgctcaaggcaaattttgctacatgacactgcttatgtgtggttttagctctaggacactgcccaaactcacttttgagggaaaacactccataaacatggtaatttgctagtggataccacgccgattaaaataataatttccggttgaagaggagagagaaaacgcgtgaaatgtcaaaaatgcccttaggcccacatgtcagctctatctcctatctctcttctcctcttccagcccacatgtcgctccccgccggccgccggccatgcccgcgcagatggcggtggaggcagtcgttgaactcgtcaccatcgacgtgacatcgagcggctcatcgagatgttcatctggaataactcgttggagaagggcgcccgccgatcggccgcggtggttgtctccatgctcaccgaggggaagttgaatgctctctgcgtcaccggcacccccggcgccatcgagtcagtcgcgtcgctgcattacgcttacctcgacgagctcaacctacttggcctccatgcccatccaccactctctgctaccgagcttgccgctagcaaaatcagtcgttccaccgccgggtatatttcgccggcgtcgtgtgcagtcgcctcccccaatctgcccttgcctctgaccatcacacgcgtgtttgtggggggaggggggattgcggcatcgtgattcggcgattgggatgagagaagggcggcagcggcggctgcggcggtggccatgagtggctcagcgtcgacggggatggggtgcgggagctacggctggcttgcgtcggccggcggtgggaggaagggcgggggtagggggtgggggtggcgaggcggcggggagaaggagcggctgcagctgctccaccgcgcgctacggctgatgggctgccggagggccagggtgcttctgctgctcgccactgcctcccaagcagtgtctacgcgggcatggccggcagccagcgaggagcgacatgtgggcaggaagagaagagagataggagatagagctgacagtgtgcccaagggcatttgcgacatttcacgcaatgtctctctcctcttcaaccagaaattattgttttaatcggcgcggtgtctactggcaaattaccatgtttaaggagtgttttcctctaaaagtgagtttggtagtgtactagggctaaaaccacacataagcagtgtcctgtagcaaaattttcctttgctcaatgacataaagcaataacgtcaggttacgagctttttctaatttatgatccataaaaaaaactatatcattggtatattgcaagatagagagaccatcattcattagatgatgtcgtactacttctgcaatttgccgatcaactttggctctattaatcagtatagccaatacgtcagctataatattaaataatatgggtgataagggatcaacttgatgtacccattctggagttgctttgaacagttgcaactgaaagcattggctgaggagcagcaagcagttgtgaaagggctgcagaaggttgaacaagaactagctgcttcagaaagtgatgggcccgtttctgaggttttccgcaaggtataatttaattccctacctttttggatgctatgtgtttagtttagatggctactgctccatccgttttttaatatatgatgcagttgactcttagatacatttgaccattcgttttattcaaaaatttatataattatcatttattttgatgtgatttaatttatcattaaatattttttaagcatgatttaattttttttatattcgcacaaaatttttgaataagatgaatggtcaaacgttcgttaaaaagtcaacggcgtcacacacacacacaaagaaacagaaagaaatttacttgacgttcctttctgtttctttaagtatggaatcttaataaacagatatatttactgatggttttgcaatctagactttgaaggagttcactgatgcttctggagctgatgtaaggtccttgtcagcactatatgctgaagtagtaagccatcgtgatccaacaagctagctttcaaaactgttccatttggattcgaaccccttttaacatactgagcggtgacagggtaaaagtgcggatgcactagcctattattttggagaggatcctgcaaaatgtccttttgaacaaggtaatattcgatctggaaattctggatgattcccaattctccatcaagttgtggtagaacaagttaatttttacagttttgtgaacactgcttgagagcatcattttttccaaacatgtgacattcactagctcaaagacagaatcaataattaaacgtctgacagaaattattagatctaataaatacttgaattttacgaattgtcggatttaggaagttggtgctctttcgttctagaattttcaagaccaggtaaatctcctgttgtgttcacgatcatctaaattaataaaagcttatatgctggaacagagggaaggtctaaagtactgaacaaagctaaggcttagggtgtgttacagtgttagttcacgttaaaattgaaagtttggttgaaattgaaacgatgtgatggaaaaattgaaagtttatgtgtgtagaaaaattttgatacgatggaaaagttgaaagtttgaagaaaaagttaaaaactaaacgagggcttagtaaatggacctgggctcatgggctggtgccatctgcagcacgttaggtcccatacagaaaatggaccactgaatttaccgtacctaatccctgatcggcaaaaagatctaggctgtgtttagttcatggcaaaattaaaagttaggttgaaattaaaacgatgtgacgaaaaagttggaagtttatgtgtgtaggaaagttttgatgtgatggaaaagttggaagtttcaagaaatattttgaaactaaacacggcgctagtataaattaacaagagttcctgttaactgattgattatgtgtgctaaattcattttcttttacctttttaaattaaaaagctatcaatgttcgtatgttctgattaattttctgatcatgtacatatgtaactgtaaatcttatactatatatttatatgtacactgtaggaggttctcctacagtatttttcctctaaaacaaatgttaatggagactttaagtagtaacagcatccttctttcctcttgctcacattaattttgaattcgacaaaaatacagtcacgtctactcttctgaactttgtggggttatttcggaaagcacatgaggagaacataaagcagattgaggctgacaagaagaaagcacagaaggaggctgagaaggaggcaaaccaggaccgtactcctgtaaagtctaaagatggactagtagatagatcaccaagatcacccttcaagtgacatgcatcactaccaattttttattgtccagccgggtcagtttcttctcgacaaatgccacctccattaccattagccattcagaccatcgtggctcaagcaatgcatggctccatgtgcttgagaaacaaggtaacgcatcattatgtacattgcacacttttgttcttactgtattgatgaaattatagtcgtcattaattatcattctaacctataatatatatttttttattttgtataggtactcaacccatgcatgctttctagcttgcaatactgtacagagctaactccgcaactatatatttaggtccgtttgtacatatttcactagacatttcttctattgtacatgtatactagaagaaataggtcagtagttgtaaactaggaaaaggaaagaacgtaagagaggatcagtaggtcagaaaccataggaaattaaggattagtgttacctcgaggcagttacagcaactggtgaatgtatagcaatgttcctgactcgtgctatcaaatgacgcatccaagtgtacaccttttatctagaagcatgtgttgtcaattaattaaaaccaagctagcttacttatatggttatggtgttactgtagctgttaatgtatagaaagaaaaggaacgaatacaaacttcgaattaaatttgaaaatatatcgctcattcaattttatttcaggaatattcgggatgtaaattttttaaaaaaaatatatcgtcgatctcgcacaatcattgagcgaaaatgaggtgacgtcgagggcggtatcgtgcggtgaaaaagcgagaccgcgtgctctcgcggaaagaacgagcgagaccgaacggtatcgctgaaaagagagcgacaccgtaccaatgcttcctttggttagtgactaatgacgtaattaactatttaataataacaattagtgattaattaataattaattaatcactaattaatcattttgaaatccggtatcgctgattggttcagcgagaccgttcgttctcgctctttcatttcgcaagaccgcacggtctcgcgcttttctcgtgcgatactacccgtgacgtcacgccacgtcactttcgcgtaatggttgtgcgaaattgacgttatattttttaagaaattttgaatcctgaatatttctaaaaataaaatgaatgaacagtgtatttccaaattttattctacaaacttccatgcttgcatattgaggagtgtttgctttcggtcagattcagtctagtacatactccctccgtcccaaaaaaaacttaacctaggagagtacatcccctcctaggagaatgaatctgccatcttctcttaggttgaggttttttgggacggaggagtagcttagaaagaattgttacaaaattcttggcaaataggctgctcccaaaactgacagacttggcatccccaaaccaaacagtgcttttatttgaaaaagagctattcatgataatttcatatatgtacaaaatctggttcaacgttgcataaaaccaataagccaaccatactcttcaaattagatatcccaaaagcattcgacttaggcaggggcagatccaacatgggtgcaagggggactcgagtcccccctacacccacaagacccatcgatacccccggagcatccccttcgattttttcaccataaatgataaattaaaggtctctagatgactagaggtgaagaaactgtgtaattgagcccccccacaattttttctttctggatccgcccctggactcaggccctctttatttaggcttaattataagccaacttataagtcgaaaagtctaagtctaaacaaataagcagcttttctgtttggcttttatgaagctataagccactctaacactattaagccaaaagctaggtttgagaagctttttttttttttgcttatgtgaggtagatgtatgacaccatcactaaacttaggacattaaatccactagcttataaatcatataagtcaataaactgatttaaaagtctagaccaataaacctaaccttcaataaagagggcctcagtgagttggacttatttattgacagatctcacaacttttggctttggcccatagatggagaaactggatctcatctctcttgctcacctgatcgtccaaaattactgatgaatggttctacaggacaggaatcttccatgcaagaggttcaagactgctatagggtgatccactttcacctatggttttaatcctcgcaatggaggccttgcgtaagatattacccgcaactgaaacagtgggcctcctgtcccaactcaattgcaactactgcaggtttaggtcttcgctttatgcggatgataacatgtgatcatgaagtatatacatacaaccaagcatgagaaatataaaacattgtcaaacaatgcatcggatgaacgggggatccataaaatattaaagtctaatgagttttgaaatttagttcggcctctagagacaacactgaattcaaacagacctagcacctccatgccatctccgatttgggtgatcttggacttgatggaaagcttatctctctacctttcaaacgcattcggtctcgtatccaaattcattccgagttaacatgaatcgtcaaaacaaggcagtgctgttactgaaacctaacttgggtcttgggccttctaatcactggtggagaaagcctttttactcccggttggtaacccccctatagtcccggttttccaaccgggagtacgaatccgggactaaagatcgctatctttagtcccggttcaaatacccgggactaaagatcggttggtgttacgaaccgggaaaaaaaagaggaatctttagtcccggttgataacaccaaccgggactaaagagagagtagcgtcagttcagatggtgccctttttttccagatttaatctctatattttctcccgaatctagtgccatgtatatccctaaatcaatccccaaatccccaattcaaagtaacatcccaaatcttaagttattataaacataaatcaaatacatcacaaatccttaaaaaagtgcactcaaatcaaatacatcacaaatcctaaaaaatacacacaaatcaaatacatcacagattatgtcacgcccagaagtttcccccttttcttgttttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcacagccctggaaataattttaaccaattaaaaatcaccaaagtgcaattttttaatcccaggaaaatccttttcctcgttttcttttcttttccttcctttttctctagatgggccgtcggcccatctctctccccgcgctcggcgccacttcctgggccggcccgctcctcctttcccctccccgaagtcctccctccctccctttctctttctggcgccgacaggtggggcccacctgtcggtcgtcccctacctcccgtcgctggagccggagctccaaccggccgcgccgccgccttctccgcttcacgtggagcctacactccgagcccgcacctcgcgcccacgtcgtcgccctcttcccgcatctaccgcgcgcgcgcgcccgcaagtggtgggggatttgaaatcccccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccgccgcccatctccggccgcgtgccgtcgccactagggccgccgccgcgccaagccgccgccgccgctagctccgccgccgtgtgggccatctcggccaccgcctcgcgtcaccggaaccccaccgggaccccatctccctcgcgagccggtgagctatccattcccctccgtctccagccagccactttggttgtcgcggtcgccttctccatccctaactcctctcctccccttctctaggtgtcgccgccgctcgtccgcccctcctctcgtcgggtcgtcgtcgccgccttcgtcttccgctccggccaccgtgtcgtcggtgagtcctccctccccctcctttcctcaccttcccgcgagcgccggccacgccgctgctccggccatgcgccgccgcctttcggccgtcgccgccgcttcccgcaccgccggtcaccgccgtcggtggccgtgcctcgccgtcgcctcgccttggtcggccggtcggccttgaggccgagccgagcccggccgacgccaccctcgcctcccctttgagccaccgcctggtggggcccacctgccaggcgccacctccttcccttttgagccgctgacctgtggggcccacgtgccggcgcccccttcctctcccctttgagaagctgacccatgggccccgcctgtcggcagccgccccccccccttggatgacgtcagccctgggtattattgcgcaataattaattaaggactttttctttattagtaaaaacacagtttatcttctaaaattcataagtaattcatccgagctccgttttaagtccattcaagtctcagtaaatcaagaaaaatgcaaataatccattaaaaatggttttgtttcctgtttcagtagtcttataccatgttttgcttgtgtgctttgtttgtcgcgtaggtttcggccgtttcgtcgatccgcggtttctcgaaggcgttgctgacgtctcgtcaatgtgagagcaaggcaagtcatgctttacatttgatcatattgtacccaatttacaaacaccctgcatttctattaaatgttgcattcttttacaatgtcatgtgggatgggtcctattacttagccatttattgtttaccatatgccattgataacctgggtatcaaaatgattagatgttggtttaggaaatgcttagccatgcttagctcaactagtacacaaaaagggatcacattattacatagactttgtctattagcatagttttggattggtgccaccgcaatggtgttagttaattaaaatacactgaatggtgggctgtgggtgcatggttttgctggtcgcacccatggcagttaaggaccggttcacgggaaaccctgggagacttaccgtgcttaccgcaagcgggagtgggtaactgcttgatctgaagtatagctcgaccctttcctaggcaccggtagcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttacgtggagggtcttgtcacgatttccccctttgcagtatcatggtgatacttcggggcatggcgacatgtgtggaatcgtgtcttgtgggtacagttgtacacctctggctagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggatagtgattggttaatattgattaattactacagctgttttactgctttcaactactgttttgaaatgcctgctttatgcaaaagaacccctagcttcctttggttatattctgcatcatacatcctcttccggtatgacttgatgagtacagtgggtagtactcagtcttgctctcttttcccccacaccagagttgaagttcttctcagttggagccgtctcagagaggttggtttcgtcgctgcagtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattatcgtttgtgtaccctggctggtcctggacaggggtttaatgcacattcagcttagaaattctggttcgagaatttctgggtgtgacagattatacatctcatatccatgcaatgaatcacaaaattatacatctcaatcaatcacaaattatcagaaaaaaaaaagaaaagaggccggccggcagacgagagggcacgaccgctgccgcgcgtgacacctttggccgcccgccatggccgccgccgggcgcggccccgccagctgccgccgcccgccatggccgccgccgccggccaccggatgggaagtgagggggaggagaggtgaggaggaaggcgaggagggggaggagttagatctgtgaagaggaaggggaagggatttgtgaagtgtaggagaggataagggatagggattatatactacatattaaattttagtcccagttggtaaaactaaccgggactaaagatcaatataatttttagtcccggttagtattatcaaccgggactataaagatgatctttagtcccactaaagatcctcggccccctgacagactactgacacgggatgaaccgggagtaaagatgatctttaatcccggttggtgatcataaaatagctgtggtgtttttaaccgggactaaagatcatttttagttccagtttttattgcaaccgggactattaatagactaggcccatctcggaagtgtctccctccacctccacgaattaacactaaaccctagatctattttctctataagtgtctatgtgcaccctctagaacatttgggttttgtttagttgaattttgccaagtgccattcaccttttctctaatcctcgctcgattagtcggcgactatagattcagagctcctaatagttggtgtgttgatttgtcgggtcgattagatctaccacttcaatcagaactatttcttcgtgcttcatcacctattcgtaatttagattgcatcttatcttgttcctgcagtgttctctcatttgcattgctgagatcatcaaccacgtgtcatggttggtatgacatcgtttgtggtgtagcgattgcacgacgttctagacttgttctggttggtagccacattgcaaatgttgtactcgatcaaagcaagaattatcctctgaccagaagatcaggccacgagagagagcttcatcaaactacctccgtccctaagtaagtgttgttatgggttttcgtatcatgtttcactgttcatcttattttaaaaaataatatgattagtatttttattgttattacataatagaacataaatatattattttatgtatgactaaatattagaagaaatttataaattttttaaataaaacggacggttaaacattaggaaaatattttttttctatttcttttgttcgatccccgctcccaatgaaccccatcccttggcaggcagtcaggtcggccggcaggttaggtgcatcgcatcgtcccaagacctgaatagcggtggcggtggagagatatcgctcacatcaatcaccaccacctggccatgctgccggcaggcagtcctcccacgtggcacttgtatcgacgtgtgggccccaacccaacacccaacggagcctctcggaccatatcatcttcctaccggcttcctctcatgtgctccgctccgttcacaccagcagaaaagtctctctgcccacgtgtcaaagcaccggtggatgccaccgtttgcggcgaggccttatatcagaaggcgagcgatacctacacaccgcaggatccaatccacttgcatttcagctcaggaagcctctgctactttgcttggcctgtacagtaatacagataaagacctgcagttctttggtctctttagtgaggactgaggagtttggttggagattgttgaggagatgggcatcgtcgacgttgtctccgagttctgctccgtgccgaggactcgccgacacctcaagaagaggaaacaattccaggtaatactgaacatgttaatccattaatcgcatctccctcttctgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgctcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccccttgcagctgtaataatattctgtgtgtccagattcgccatccctcaaaaatctttcatagtattatagaagggaggaagtagtaatttttccagctgtagtaatgttctttgctttagatagggtgttgtgttactattggactctcttttgcttgtgcttttggtttctgatgtaaaatactccatcatgttcttgtttggtgagatgaatcttcaaatctgcaaagttgcagatcggttgtttgagcttagcatgattgattggggtgggtgggggagacgtgtgaatatcgtactgtatattcgagttttgggtgggctcacaaggtcggcagcgccgaaaggtttttttttttatccgaggcgctgattgcgacgttctgaactgtagcccgatgctggtgtggcattattttggtggttggatggtcagccgataattctaaactttgaatcaaagtttagtttagttatttttcattacatcaatatgtcatatacacatattagttatatcatctttaattttaaccaaaatctaaactttgcgctgaactaaacacagccaaggtgtactatacgccaagtacgcgctatatattgctattaatattttaaatatttaaattttaaacatatattaaatacataggtttttcaattttattaaattaatataagtaaactttgttttaacgaaagttatatgtaaactttattttgaattcataaggacacaacaattttatttatctatagttttaaaaatcaggattagtatctatattgttgtcgaaatgacaataacttctctcaatgaaatgattggatggtaaaagcaatgtattaatgatgaaatttttttggatcccctattacatagccctaaagttttgtgtgagccttcttgggccgcaacacctcctagcccttttgttgaagacgagccccattgggcgaaccccttctgcttcgcgccatggcttcacccaacagagagacttgatgacgaaccttatggcttccattcttcgacttcgccttacagcttcatcctatggcttcacctccaagcgaccccttgtgattttagtcggcgctttgctaatctggtggtttcggcagatttggtcgaaggccctcgtgatatgcctccagcaagcccctcatgggcaagagcgagtagggagctttgggcgagaccgtgcaaatatgtggtatggcatgaggtgccccctttcggccgatgttcctgccaaaacctatgtacacctgcagaagctaacccttgttatttcatgagttctctcaaacgtttccatgttgtttttcgaccttctatccttttcggacgtgagttaggtcacttcttcttttctttaaactcgggttttgggtcgcgtttttcctgttcatgtggccttttactgttcggcccatcctaacaagagttaccattgtgtccatccctgggtgccacgtggtgggctgctattggccggaaggcaaaccgtcgcatgactagggctatatagtccccccgtgggtcgctttcacttttaccccatctatttttacttcccccggctgcgttcttgctctcgctttcaccttttctttttcggccttgtagtcttcgctagctctgactttcatttttcgccattccatcatggctccgcgcaagcctgctccagccgcagcgaccggaccggacccctgcaagattggcgaagactgcaccggcttcctcggcacttcgctgttcaacaaggcggatctggcgaagctcgtcgcgtcaagtacagtggttgaaaagcaagccttcttcgctggcgatgcagtggttcatcgccccgttgatggctggaccgttgtcttcgccgccttctttgatgcaggtcttcgcttcccatgcgacgtcctgctccccaaggtccttcaacttttccaagtggagcttcctcaactgagtccctcagtcctagttcggatcgcgatcttcgactggatttgccaaaccgcggggttcgtgccataaactgatcggttcggcgctatcttcttcgccaccgttcactcaaagatggtggtcactccggttgggacaaagaaaaccgtctttgggagtgtgaacttcaatgttcgcgctgtatgctccgatttgtggccagtgaatgcctccatgccaaagtgggagcggcattggatggagaggtggttctaccacacgaatccctatggagctaagacagacgcgacgaaggcaatccgatagggccggctagtgatctcccctaaccggaagctgaaggtggcgattgatgggacgatcgagtcccgtttcacccttttgcggagaaccgcccatcggttgagctgctgtgatttcgtggaggagttttgcatgttggcagatcaccgtaaatgaggatgaacgggttctcgacttgcctcgccttgttttgccaggaggcgttaatcgtaagtttttgggccaattccctatatgcccatgtaatttcacctaatcccttctacgcccctgaaatttgtttgatctcttatatacccctgagttttttatttggatcccttacatacccactccgttagttgaccattagtttgaccgttagttattgtagaaattattttattgtccttggtatattgttaaaagctagaaatgttttatgtgtaaattatttgagttgtgaaaaccaataaggaataaattactaaatatttgttatgaatttttaaaaataaaacattatttcattaaaataaaaaagatttatcgtaaaaaaaggttctgcataaaatttgaaaattacttttctacaaatatttagtgaaaaaagattcgttgtgaaaaaacaaaggggatgtaattagtttatcacaaattagaaaacaaatttaaaatttttaaataaatttcagatcaaatttgacaaatttcgtatatcttcccaaaaatttaaacctaaataacatttagtttttgctcttaattttctagcgaaactaatgtatggatttaatcataatttttaaaaaataaaaaataataacttttattttttaagttgggcattaaatgattatattgcttttattttgtataagttaatttttttcatatgaaaatttattgggtaggtaccacatatgtataggatggataatatagtcattttaaaatatttagcggtcaactaatggtcaactaatggagatgggtatagaggagatcaaaatgaaaactcaggggtatataagggatgatgtcaaattcaggggtattgaagggattgagtaaattttcaggggtatttagggaattttctataagtttttctaatttgctaactctttatttatctcatacccttttgttctttttttttttttttgcctctcttgtttttttgcctttttgcgcagttctcaccctaacccaggccgaaaatgaggcccgaactctgatcggggacctcaccattcatgagtatagctgtcacgccctaaaaatcctaaatatataaattgttgtttaattggaattattagaatttattttaaaagcctacaagttaaactctaataatctaggaaaattttcaacataaaaatgagctagataaaattttattaaatactttgcttgttcctctattttctagatttttctgggaattatttgagcaagggaagtatttttaataattgaaacaacatttcacaaattattttaattaaaaagttcaaaaacccctccctaagccgttgggccgaattcggcccaacattcctctctcttccgcacgccggagccggcccaaggccgcccgagtcggctcaagccgagccgcccgcccctcctctcatgggacaccgacatgtggggcccacatgtcgggcccttctcctacctccggccggccggccttgctagctcgagccgccccttttcccctccaaatccgcacccaatccggccctttttcttccgattgtttgaggagtttttatcctctcatcctcctctatctttacccccaaaaatcggagcaaatcgttgagtatcttgcccgaatcgaactcgtttccgagtttatctccaaaaccgagtttttgatttcccgagtcgattttcttgcgggaggagtccgatctcttcaatccaaggctataaataggaccccctagtccttctttttcgtttgccccctctcccgtcctctcccgtgacccgtagagccgtcgccgcgtgaaaccatccgccgccgccgctggccgaactccggttgcgccgccacgccgcctccgtcgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccaatcaccctagctccggcgaggtcgccatccgagccggccgccattgatgacgtcatcatgacatcatcatcttccccttttccaggttttttttaatagattaaatcttcggaaaatcataactaaataaccgtagatccgtttcaggtggttcaagttgctaaatttttctaaaatcaagatctacatgttaaaaatatccacatgtactgtttatgcttgtttttgtattgtttatttggtttttattagtctttttcttcgttttgcgtgttagcttgtcgtttccatcgttgcgaaggttcgtgagtgcgccggaagtattcaagaagattaattgaagaccgattattgcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgagtagcatgaaccttatatattggattggttcagctaaatgctatatgtatgtgtgcttagctatgcttagaaacattagctaactaaaggggataattataaactatattatattattttaattatggttatatttaatggtcgatcacgatggttaatcgtgtgatgttaattaattgataaataaaatctggttaaggtgggttgtgagcatatggttttgatggttgtgctcatgacaattaaggactggttcgcgagctactgttgtgaaacatttatcgtgccaaccacaagccagcgtgggcaacggctttatcttttgtatagcatgattcatcatagtgtgccagactgtgaagcggcaagaagtccgtgggggtcgctggggagtccattgcctctggttttgagggggagattatgatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacacccctcacaataattatggatgttataactggtaataatttgcttagctcctggtttggagttagaactgtacagccgggtatggttgttcaggatggttgggcctgtgcagcatgggtgtgttgctcagtgttgattaaaatttctgattaattactccactgttttacttctcttaaatgttttgctaaatgctgcttttgcaaatgagcctatattatgccatcatttggtatccttgtgcacttgcatatttgctgtgtggtttgttgagtatgtcatatgctcattcttgcaataatcatcaaacctcagttgaagataaaggatccagaaggagaagacgtttggcttataccccagttgagctgcctgtgggagtggagctgaagtcatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctggggtgatggccacgtgggacaccagcgcgccgatgacctggtcgaacatccctgtagcgtccaccatcgggtgcagctagccgctggcactacctgactatgtccaccacgctctgccacgaccactgcggcatctcatcgagagccttctccgtcatcttaaccaggctcggcggtgtcgacacctccgccatcgccgctattgctgccaccatgtccatgaactcaaccgtgcaccgcccataaaatcccccaagatgcggcgctggaggagaggatagagagagaagagagataggagagttgaaatgtgggtccaagagcatttttgatatttaatgtgatttctctctcctcttcaaccgaaaattattattttaactaatgatgtgttcatcagcaaatatccacgatccattttttaagagtgtcttccgctaaaagtcacttcggacagtgtcctacagctaaaaccataaagtcatgatctcctgtaacaaaatttgtcaaaaaattagcacaaatgaaaaaaaactaacacagaggttaactaactgtaatagcaaaaaggaaagaaaaacacgttacaatttttttttaactagggctggaaagcccccatttccattactaaaaatgaaacgacaagtacaacagggttcagaagtaaaaaaacaaaggaaaaggctaaacacaacccccttactggagcagcaccctgacaagagagactaacagtttctgcagggcaagctttacagagatcaccagatcacagacaacaagatgtaaagggcagacctaaccgagtagtaccatagcaaagcaaagaactcagcaacactaaactcctgaacttctttattccaaacgtcttgcatagattctccacccaaatcgggaactgaagacttcacttgccacttgtcttgccagcttggctcccaacattaagcttctttgtcttgcctccgatttctgcaagttagcccaattttcaataaaatgacatgtaagatatatcagctcaattggatcattgggccattttttatcaaaacacactttgtttctggacttccaaatggcccataatacagctgccaccccccaccatcacaagttgcttagagtgtttgtcaaaattagataaccattatccaaacatatggtttttatctctagcaggtgttatattcaaggcacacaacatcacattccagatcaatttagcaacagagcattcaaaaaataaatgctgtatggactcctccttatcacagaattggcacaatttatcacattttctccaacctctcttaaaaaggttatctttagtaaggattctgttttttaacaccagccataggaaaatcttgattttcagaggtattttaaacttccagattttttttatatgggaatgccacttgctcccttttaagagctttaataaaaggatttgacagtgaagcaaccatgcttttctagattccaccacattttatcttttattccttcttgcaaattcagaagcatccatctctgtttaatccagtctctaagtttatctccatgcaaagtccttctgaatttgataatctcccatcctttctccttcagttttgcaagggtgatatgtctagtatgggtaatgttgtataaagcaaggagctgcaaattcagaggtctgccaccataccaattatcctcccaaaacagattgtttttgccatctccaacctaagttgaacaaaatttcaggaattcttcctgacttccatcaaaccatgctagaaatgaaaattacccgctttataagtcacccatgacaaagttttttgactcaaatatttttccctgagaatggaaattatagaaacgagcgctcgtcaattcgtcattgataaatcatagaatgtcacatatgtatgttggtatgaataatctagagttgagctcctaattggcacagtccgtaaaaagacattcggccttcatggtaactatagtcctcttaatttttatatgtgtacaccgatctcaagtgaggccaaaagatggacagcgcttgaaatgaagaacgaaattaccggtgggcggtggtacaatcaaggaatgatctgcggaaaaataaaaacggccaccactttactgttctcgattaccggcatatgtagtacaccgatcttaagcgaggccaaaaggtggacagcgcttgaaatgaagaacgaaattaccggtggtacaatcaaggaatgatctgcggaaaaataaaaacggccaccacctactgttcaagatttaatttatatgtatatcatgatttgggatagatgcaattggatggtcagaaaacaatcttcactaaaacatggctacccaataagcgtttaacaactgtccatagctgctcttaggcacgaaacaatctacctgcccaaggtttgcccagcaaaaagatttcaatagttgaaatgggtaaacgaccgcctaaagctctctttcagtgaaataaacacaggtgttcgaaaataagtgttgagatcactgaagatgaagtgccttttcactggaacataatgaccatgagcatattccaccgagggaattgaaccacactagcacacctttcgttttgcatctaattgttaagtttgcaactgttcccacatttgctatccagctcgcctaatggggtcttggaagtattggagagagatgagaagtgcttcctgaaaacgtttgcttctgtcaaaataggaacaaatccctgaaaaataatgaactttccaagctttcaagtgtcaagtacctccgttcttattgttctgctcccttgactgggacatgtattcaaataggtattaaatacatcatctacacctttaccctgcagaaggaaatgtgtcttcaataacaatactaacagtaaaacaaccatcatttactaaagtatgagcagttagccacactaacacagtaatcaagttatgtatatcataaactaggaagtttatagaacaaatctcagctgacccattaccgagagttaaaaaacacaagacattgcaagtgagaatggactagatgatgtaggttgggcagttggtctatggtggattggtggtctagtaggtgcaatttggcgtggctttcctagttggtatgaagccagcagcctatattctcattctcataaaggcacacaggaaaatactagcaactaaaccactactatgcagagctgatctccctggcttcttttcatatttttgttgtactccaatctgaagttacaaaattttccattagttcctttcaccccttgtttcatcagttctcaagttcgtgttttagttagagaacttggactctgccacatctcttaacttcgcttcagaatctgaacagccagtattgttggtctgtgaccattcagttttattcgtttattcagcttttcattagtacttaacaaagaataccaaatattcaaagacaataccggtccaactgagttgactgctgtattttgataatttcagcctggtttgtctagtgtcagaaataacaacataggtaccagttttttgttagtactaacaaaatacgtattagaaactatcatatgcaatgataccttcaaatttctatcttcttcaatgcattcttctagaccagccaatccaccaaatgcaattaaaaggtgcctgtacaatgaagcgctcataaatgacaagatagccatacacccacaatggtggtcctgtgtatttttcagtttatgatgaagaatagagtggattctactttgcctctcatacactatcatctgagtctagaaatcaaccctgaataataaaaacggacatcttccacccctcaaccaccaaaaccagtttaaaatatccccttaagagcaatacaatgtggttataaccaaggttctaaatagaagtgatagttacaacaatggtggtagtgggttactaccattaccaagactaggtagtgctacgaaatagcgcattggaacaaagcagctgcaatagcagctggatagcaacctcataagcaaaatagcagctgctattgcattgcacactgaagtctgaattatggagcttaaatttgtgttgtgttaactcttgttgattacttgctttgtttttttaaatagagtaaagacctaattaaccatatctctattttctttttcataccaaggctccaaaagcagctaccctaatgagggttaaaaaaaaaaagcagctacccaaataactcgacactggtaaattcaggccagaggcaaattatgtaaactatataaaatgatgaaccagctgttcaacaatcaaatcactggaaccatcaaaataagttaaccagtaacatcaccaagtcaatagctggtctgggttcaagaactatctgactggatcacatatattgttgtatggcctattttatagtaagagtctgcaaaacactccctataacaaaaaagaaatggacatgtttaatgcaaaaaaaaaaaaaatcacattcagtttgtatatgttcattttttattcatagaaaaaaatcctgagacactggcaaaaaataaataaatagtcatcataaattatgtcatagcatctagaaacaaaattttgcattcagcagaccaaacaactatggaaaaaactgaattgaattctgaaggtagtccaagggaagtgaaaacaatatacctaaaggaaggtaagatcagctcagatgaactaatgatctttccatgctctgaagtaccaatgatataatcatatccttcctaaaaatatgaaaataattagtaataagtactctttaccctgtactacatgtgattgagctaaagaaaattgtaccttgtatggtgaatcactgaaaactccacccaaatttgaagcataccggaccttatagccccaatacaattccatttcatccctgggagaggaaggggaaacaattttccttttgcaagctagatgaaaagtaaatgacaatatgtcattaatcaatatcaaaataacagacaaaattcaagttgtagaaggcaagagctaaaataactgaatggggatataagtatgcctagtgaacaggaatgataaaatgaagcgacgcattacgaagtgaatccaaagagcacacatgtgaactgaaaatagtcactctgtttttatgttacataattaaaaaatccatccattttgctctgcagaacaagcagaatggtttacttgaaatctgtagtaacgcatgggcactatattattcatatgagaaataaaatcctgatagttgttgcagattttaaccagtcattgcaaatggttaggaaggatacttcagggtatatggattaaagaacatataccgagtaattcagatactaaaaagttctagacgaagaaaaatcaatagagccacatctgaagcctgggtcaagtgaataaatcatttacctgttgtaatgtcacgattggtacccatggcaatagttactctcttccctggttctagcatttgctcaaccagaacattctgtgatgaaagacaattatagtaagtttattggatgagaacgtacattatctaatacatgatccacaaaggtgtatatgatacaatatacattacagaatctgagaatcaagtttatcatgttgagtacaaaaagatttgctcagaggcagacatgcaactatcaatataaagttgctagacttgccaaagcactctggccaggcagctatcagcattgaagctatcccatgctgattttcatgtttcaccattctcttacccttgccccatatgcagttatgggtaatggccatggcatgcctctttggtgcaaagatatctagctgacattttgacagcttacagttatgctatgctatccttgccaaaaaaaaaaaaaaaaaaaaaaaaaaaaaaagcagtatgccctttgtttggcccagcttcagcgtatattgaaagcagccttactgggagtatagaaaattcaccaagcaaacctatattacagaaaaaaaaaaagaagtattttgttggaataacaaactatgaactcgtttgttatgtgtttggtatgacaccacccactagcttaactttttttcattcaattaggctaagtttacaggggttaattcctcggagtaaaggaaagataaagatagttgggtttatgaaaaggaaagggtttggttttttggaaaggaaggaaagtgtttgctctttccggaagtaagagaaggactaccttgggtaaggtaggacttctcggagtaagggaaagcaaggtgatacgtgttcctagcagtagttaagcgctattgttgctagggagcccatgtatgggggtatgcgcgtggaggaaaacgcccagaagggcaatttttgaagccctacggcactttagggtaggtttaggtactctgatacctaaaccagaatttaaatgcatttaaacgcatttctattagtgaattaattattcgattcatgcactgggttagtttgtttggacaataaccatattataacccctttgtttataactgaacagatattttatagtctaagccgtcaggttacaactgaacggatatttaattacacaagccacttgagctaaaaaatagtatgtgaaaaaaatttggataccttactcaatccgacatcaacaaatgtccccattgaacgatccccatccaatgttacgcctgtctaaattcattctactgtaagcattctgttgaatcacacatgaaaaatgtggtaacaaaaacttttccgataccagcattaaaataggaatgaaaaaacagtcgaaacaaatccaattatgctattagtactcatgttcctttttttagttgagaagcacaaaagggtgccattctaaattgaagccttaacaaagttgagcatgtgggataggcagtcctcccccaagaagtaattctacattaacacaaccaacagctcagccattcagtaacacagcaggatcaaagagcgtataaagtttatttttccttttagcatgaactacgagaattgataaagtccaaagcaaatgaattgcatattgtgcatgtaatgaatttctgaaagctacgaagaacagataaaacaactgcacaattcatgggcatactatataatatttataaaaggtgcagacatggccacgcatgacagaattattaaacatgatgaatcattcgaaataccaaacactgcatgtgcttatgcatagttcaattgatgtgctcatatacatatagtttcattcaaagatgtccctaactagttaaatatgaaatttacaacttctcctagttttctttttgaccgaaaaacagtagcagatctctagaacttgtcctaaattaacaagagaccgagaggtaagtcgcatagctcctataaatctaggaagacaaacttcatatttttctagttaggtaaaaaagttaaattacattggccatgtgatatttactttgatttctctctcctatttcaatccgatatactaaaataatggtaggagtgtattatagcaaagagaaaattcgctctatgcacagaaaaaatggcagtaccaaaaatagcacaaaacattcccccattcgaccagaggcacacgccactagtttttcttcaatttgtagcgcttccgtcacattttccgtccaagtgattggttagccaaacatgaacttgggctcctcggctaattgaacttgtccacggtggtggctgtggtggggtggccagcagcggaggagggggtgcggccgatggagaaggtgtttgcatcgctgatgaggtcttcacataggtgtggcttatggagatggagaacacagagaggtgcagcttgtcgtcgacgcgtagcagttccctgtttctctctagaaaaaaaatcagagaggaaggggccagtggtcatcacgcacagcaggaattgagtaagaagatgagacagagatgtgaagaattcagtgctcggcaatgcaaatcaatggtgtcctatggaatttaatttttgcaaatcaatgattgaacaggacacaacaaactagttcatcatggggttcggggatgggaaggagtcgttagccgccactgtcatcaacgaccttgatcccatgtgccgtcgcacggcgcaaactgccagccgccgcatgcttgcctgctctcccagccaaacgagcatgaactgatgaagaacaggaatggtccaacccaaccaatcacgtgtgaatacagagaggactaagggtaaatttgtcattttctgtccctattcacatggaaacactcgtcttgcactgcagttttggtggaagtgctatggatggaagaaaaacgagtggcctgtgctaccagtcgaaagcggaaattttagttccttgtttctgtgctacagatcgaattctctatagcaaatagccagaaaactagagtacccatggccgtgacatgattttagttccccacacaacaaatgccgacttcgccaaccatatacgataaaagcaattcaacgtggataccaatagcactgcaagaagagagagatcaccttcacgaaattcagaccactcatgcttgcgcaaatggtgtggtgcatcgagtgggggcagcaacccctgcatacaagaagcgacacggatcaatcagcacctccaggaaacccaacatgccgatgatgcaatcatgttcttcagcggtctcaccacaaacttcaagttgttgtgcatcgggaaaaggcgtcggcgcaggtattgtggagtctccagatactgtaggatgcgaacaaggaagcgcgcgccactctctacgtcatcgccgctgttctccactgaggaattgctgtcgaagaccacaacctcgtcgatgcggaagacggtcgccgcgcgggcgatttgtcctgccagctgaaacagggtaggagctagagccgcaagaactagcaagggaaggtgagaaaggatggatactgacgagggtggcgagctcgagggactgggcgttgtcgatgatggatccggcgacggcgatgctcaccgtggtcttccgattcggaaccgccacgtcatctccgttcttcttctgttgcagctgcttcttcctcttcttgtcgtggacgatttcttcgtcagccgctgaagcctctgcggctccgcagtcgtcctttcgcttctttttcttctccttcttgcaccgggccttcttggaggccgctgctgcctcggcgtctccggagttcattgcggcggcggcggcggcggcggaggcgtaggggggactaacacgagaacacctccaggttccaggagtcgagaggccgacgaaagtagggtagtgcgtaagggcccctcatgtgccggccttcggccagcgaaggggtttgcgtggagtcggactgttttcggcccagcgataagtctactttatgtccctcagtaccgtttgagtttcattgtatctctcaaccgtaaaaggtggagaagtagaaatagaggctcattcagattggtcgcccgatcgaatttgagaaatattgggcgctgacgtcagcgtccgatttacgtgcagaaactactttaaattgatttttctcttaaattacttatccaaatcataatccgattgcaccattaaattcgttgcaattaaattttcaaaacaagaccacacatggatatattccgacgaaaaaaaattagcttattattgaattatttttaaatattgcacaatgttccactaggtatatcggaattgtttcactaagtagatcgaaaatgtttcactcgtttaaatcgggtgttgtttcaccttatgtaaaaacaatgtttcaacaaatagcgaaagaatgtttcagttcgctgcaacattagatctatacatagtgaaacattgtgagtatactaggtgaaacatttttcggtggaaaaaaaatataccaaattcccttaatagggggtttccaaaatatatggatttttttgttgcaatggaatgtttcgttcactgcaacattagatctatacatagtgaaacattgtaagtacactaggtgaaacatttttgatggaacaaaaaataaactaaattcccttaatagagagtttctaaaatatgtgggttttttttgttgcaaaagaatattttaattcactgcaacattagatctatacatagtgaaacattgtgagtacattaggtgaaacatcttttgtgaaaaaatgggagggagaagtgggtgggcccaccaggtgatcacgtgggggagcgcccgatccggctcaccctgcgcgggtcacccggggtgaatcattatcgagtataaattgtccctcattttttattaaaaccagtacaaatcgataatatggaataagttcacactgcatcccttatgtttgcgcattgagtttaaatcacatccttaaaccacaatactggaaatcttaaacctccatattacaaaaccgggttaaataagatcctaagacggtacggatgattgttttggctgacatggcatcctagctagaaaaagaaaataaaaaataatatgtggggctcatatgtcggaggctttcttcttcctccaattctcccctctcttcccaatctcactccacaacggcaaccgctggggaaggaggggcggctgaagaaaagagacaaggcgatggtggcgttcgagccaaccaaaggtcgctctcgtggcgcaaacagctcgggctcaccttggttgctgagctccacctcgttggggaggccacaccgcccgctgggtacgacgcaacgacatggcggaccaacgccaaagatttcacggcaacagaggggatgaggtggtggatgacgatggtgacctcaaggctatgggagggggggggggagagaaagcctgagcaggcagtggggatgaggaggtgaaggatgatagcgagctcgaggttgcagcagtgacacggggagaaggggggtgaggggtggaggagggagctcgagtgagccggagggaacaaggtggtgggacgatgtgggcgagctcgagacgtgggtgagcttgaggccacaacagtggctaggggagcctgagcaagcggcatggcctccccatgcgaggcggagcttggtgaccagtctggccgccgccattgccttatctcctctctcctgccactatgaccgcctctcccctcgctgccatcagccattgccgcgaagagagatcgggaagagaagggaggtgtggaaagagatgggaatagaggagagaatgattggaggaagaagaaaacccgtgacatgtcaacccccacatgttttcaattttttttttggataccacgtcaaccaaaacaaccatccataagcttctttcatatcgtgactgaaaacctacaatttttcgagcgcatgaaatctagcaaacaacacaggaatttaacaaagggagagatttgcacgtgtttgtgtacgatagtatgttttattgtgccacttccgtgtaatcggaaaaaaaaaagaaactgattaagcttcacctcacctctcatcctcacaaacagtacatgagaatatttcacctgtcataatcccaccacgtaagatgcttccacaaactgtacatgagcacgatgaaacaatcaagctgtattgcacaccctccatcctaaaaaaaaattaaagcacaatcaagctgtattagaacatcacaaaatatcgatggagaatgtaaatcttgcagtttatccatcaacacgatcacaagttaatacttcacgactgacccccccaaaaatttctcatatactcctaaaccaggaacgaaataatgacgtcgcgacttggaaaagttagatacaaacagccgtacaatgatttaaaaccaaaacaggaagttcgagttccttctttttcatgttcaattctctgtgtactaaatatatgatgtcacattattacattgtcacacattctgcaaaacttcaataatttcaatgtctaaagcatatacttccttccgtttgaaatggtcaaagacttgaagaggcaaaaagaaattctactaatttcgttctactcctggattcttgatggttctccaattgcatcttccatacgttggtaccagtcaccaatttgtgtatgctcaaccatatcttttccagctgtcaagtatcggataggtctcaaaacaccaaatactgcaagatctgccaagttaggcttggagccacctggataaatgcaagttaatatcagtgcggagtaacaaacttgatgcatgtggattttcacccttccaggctgttttttcccttttcccttcctttatggaaaaatatcatacctagaaaatcccttccatcaagggcttccatccatgtgttggcagcatcgtataatgaagcacgcgcatcagttatattgtacttcttctttagcttcttagacaccatgtacattgctgcagcaccagcatacttcacagcaaaccgctcagtaaaactgaagttgcctgcattacagagttcgggtgcacatcgtcaaatgttgcactaacaaaatcatgtgtcatttctgctcaaatgattaaaacagttagcgaacagagcaccacctctgcacccaattttacgtttttgcctagagatgaagaaatctagtgttcctggataagtggatagcatggcatcttgaacttttattttttagttttctagtttgaatataattggagatgaatcatatcttactataaagttatcccccactaactccttaagcttaacatgcaaaggtgccacatcatcatccactaacaagatgctacacatcatccactaacaatcatcacatttaaacaacatgcaaacatgctatatctttatagtttttataatttaagagcttttcaaataaaaatatgttaaattatcatccaacataattcatataatgtttcaatatatatctttattatgttttatgatatcctatatacttatatagttcatcctcacttagttagtacttaaatgattaatctatggtccaaattatctttctccttttttcctctaattaagtcatatcacatcaattgtttttagcctttttttactggaattgtttttagcctttagatgattaatctacagaccaaactatctccctatttttcttcttccataaagtcataccaccttactttttacatttgaatcaccattctacatactatttaaatttaaattatcataaaccatattaatttacttaatctgatgttatctagctatcttacacattctttttttattgttatcatactaaattcccgcagcaatgcgcggggtttcacctagtatagtaaacaagtaaccccttacatgaggggattttgctgaacagtgagcacaaactaatcttccctacactgttctttccatgcacctcatgttctctcaactaacctccgctatcagcagttcagcactatgttagtatggtacctcgacgattgaatttccctatatctcacaggtaaaatccctgttcagacacattatgcataatgcttttcatttatggggcatccattgacaatcacgctgaacagtgagcattcaccaaattgtgttatctccaacatttagaaaattaatgaactatgaatggagagcacctgggttcacaaaatcaaaatattcatgccaagtatgttccagagagatcctatatgtaacctcactgtaacaccctaatttgcaaggtgcaggccccatgtacacactgcattccattctagcttcatgtaaaaggttaacctgaaggttctatggttggaatgtgtaggtttatttgttatccttaatacatctaaaatctctatgtgagcctaatctcaccaaaaatacaccacgggtcacacaggcctctagtacaaagctggggttcattcacccctttctttagaagctgatgaacttgtcagcacattttcttgtttattcctgtgttactccgataaaattcaatcctattacaaccaaatatcaacttgttaaaagccttcgatggcagtagatagtgcacgaccatgtcctatccaccccatgaacccagacacatactcgtgtagcacaaggtttatgctctgatgtcaacagtaggaccctagctttcaaaatccactttggcctggttcttctgaggagcagggacatttacatagcaccccacgtaaacttctgttcttgattcatgtaaaagggttcccaaaggtgctatggctcaaacatgttggccccaacctatctaaactcaccatgtaagactaatcccaccatcactgtacatgggccacaagtgcctctactacaggaccagggtgttacactaacttataaaaaggggtttagcgttaatgattccactcactctggtctcaaatacttcttattttgaataagcatctagtcaaacatttaaaagtagtgtcaacatcttttaaagattatttggatacatgagaatcataaatataaccaaaagaaagaaaatatagcagcacacagacaccaaagttaaaagttccaaggaattaccatgttttgaaatataatcaaaagattccaaggcctctgaagttgtccgatatatatttggcgacaagacatgcacaaggtgctcatcaacccacctaaaccaataattcaagacaaattatgttaccgtagataaactccagtttgtaagaatgttaagagagtaaaatgttggtcactcgtgcaaccagggttcgccatgctacttctagaggaatccagctcactccatcaagggtaaagcctaaatgcagccaatttagtggtagtcggcttttttgtttttcatctttcagtttgtgaatcctaccagaaaatgcataactacccctaatacaagataataatggacttactggttgtctctagccttggaaacactactatgaccagatccagagaaaaagtctataaagtaatcatcagatcataacggataagctcttagtttcatcaattaattttagtggtaaaaacacaatgaaataaagcaaagaggatagttgatggccatactgattctgcctggccttgaaacattatcaccagatccttgggaaacatgtaactataaactatcagatcgcagaaaaaatgtagtaatagtgatggctatgctgatcctgcctggtgttggaacattacaatgaccagatccagggaaagaagtctatcatgtaactatcaatgcataaacagaaaaaactgatggacaaggtttttgttcaccgattgatttacattgtaaaacaatgaaacaaaagtaaagaaatactataaaagtagaacatattgcacatactaatgccatataaatgattaaaaatttcaagaggaaagtagactttaaacaatatttgtttctagaaataggagtactataacattaatgatttgagaagctagaaccaagacctgaaaaaaaaattacaaatactaatgccacataaacagatgcaagtaatggagaaatacctgcgccatttttcttcctcttcattagtggctttatcatcagggcggaccctttgctgtaatatattgattatatctaccaacaacagatgtaacaatacgttaactctggagtttaacacataaaaagttattttacttaaaagttgaaaccacaacaatgtaaaggaaccagaccggaataaaccaatatgaaatgaatgtaacctgatgaatcaaccagctgttcaccatctaccatcagtattgggaccttcttgtactcagaccacttgatttccttcttgctcaatggattaacttccacaaccttgtagggtatatcatgatagtctaggaaagctgaaatgaagcaaatgaagaatctttcaactaaaagaaattatgccagaacagagagatcatcaatgatttcagaataacaagtgaatgatctttagcaagcaactttcaagcttcagaaatctagaatacctctatgctctaagctactgatatacagatcacacttacaatcaggattgatcatagactcacagtacgatcacacttagttatcgaagtgtatatactcatacagcagataatttgtgaacccattgacagatgacaaccccagtcccaatagcattatgaagtttcacgtacagtaaattattacatcatgctgccaatgaatcagattgctgtgcaagtttgtaggtgagggtgacacctgtcaaaaaagggatggctgatgtactaacaagtaatgacagttggacaaaaggaaaacaatttttacaacaaattctggaaggtctgattcaatgaataaacttgaccaattcttagctgggaggctcctctcttttgaagttatgcaaaatgtaccgacagtccttaaacatgtcatagatgggcacagatgcacagttggacccgtgatgatacattaaattaagggcttaaatatgcaatttgaaagttcaagaaccataatgatagaagaattgtactctactgactatgttaaattacatactgctacctaaaaacgcttagcttgtaagtttttcattaccaacaaatcaataattatcccctcaacagaaaatcaggacatagaacaacacatcatggtaccccatgaactatttccatgaagctaaacacaatactaccaaaactcagaccttgagctatttcaggagggatggtttgcctagctgggggaaaccaacaacgcttgactacaagctcaaggccaagtttgcctcggattacacaatcaacctaactcgtttcaatgatttcaacaactttcaaggtattttgagatgagaccaaaaggctggaaaaggctcagaataaacttttttgtcgtgtgcaagaacacatgcaatcaagttaccatgaagatttgtgctcactttagttcaggctggtctctggaggccaaatagggctccaaatatgccctttttttgtatctctaactcaaattggacttaaatactcatttcaaattgaacatgtatcatacataaagacaaatactcatttcagacaataagtagtgttatatactcaatcaattcaaattgaaacacattaagcaatgaggttacttgttcaaaacaaaccaaatgtagcttggcagatgccattttgtatggaacagaatttctctgaccactaaggcaaattcatagtatggcatgctctttgcaagcctctagtaaaggatcacttgctccaaacaggcaaacactttattgtatggagcaatttcgtttctgcccctactttgatgtagtctaatactgattttacccctactttttatggttttcgtttttgcccccaattttttgaaccggacgatcgtcttgcccctattttggatgctgaagttaacggtgttaagtaattagcaaaaggacatttataccctcttctattttttttcattaattgtgtttttgcttccattttatacatgttgctttggaactttatttttgtgaatgcatttaaaattaaatgacgcacattgactaatataacaattaggacagattcagacctaattgttgtggcaatgtgcatcatttaattttaaatatattcacaataataaagttccaaagcaaacatgtataaaatgggggcaaaaacacaattaatgaacataaataggagagggtataaatgttcttctgccaattacttaacaccgttaacttcaccatccaaagtaggggcaaaacgatcgttcggttcaaaaatgtgggggcaaaaacaaaaaccctaaaatgtaagggtaaaatcaatattagacatcaaagtaggggcagaaacaaaattgccccattgtatctattcatccatatgctccaagccctaacaacaatagcaccaatttataattatttttctcaaaattgtcaactgattctggaaccaagagatctcttgattgttcatcctcttgggtctccacattacacatttttcaatgctcaaacatgctaagaccatagcaaaaatccctaacagctcccaggctcaggtggaaacctcaagcatgtattagtcaatgcaacaaggtaatgactaataggtgacatggcatgggtagcaggactacactacagtgatgtcatgaagtctgttacataaaacggaacaacgaacacaaggaccctgaggtggtcagttcaatgagtgcatgtgaactgtaaggtgacaagaagcacaagtaaagccactcagtgagtggcagagatggcctcatgggagtgatccacagatggcctcattagagtgatctggcggataatagcataatgcaaacaatgcaaccatggtaactaaattaccctccattggaatgttccccacactgatatgacttatgagtgcatggacaagataacaggcccaacagaagcttcacaaaggggacaaactcaggtagcagtatctggtgagctctgctgtggcctcaaggaagaacagtaaaggcaactttggtgacaccagcaagacggtgttagtgagaatgatagcaatggttacaaagcaggcacccaattttcttaaggagtgatggaatatgttccatatttttgaaatggacccaatgtattgtgttagtttttttcccttctattagctgtactttggttaaacagatagaagtggttttcttcacctcatccagaaatcttgatgctaactgatgggagcttattttctgtaatctactaccttagaatcaattctctgtgtcgaaagatagttcccttcaaatatccttcaccttctgtaaagcatcaacaaacctatttcagatgacacctaaattagcgatacttgattttctgtgttttccccattcttgtaattctatttatctgttccaaacagccctatcagcttacgagctaaagaaactatattgggctcacaatgtgaatagtcctacctgtgcatagggacctcgctaactcatattgttcaaaatattttcattcacttttttatctaaaaaggttggatagatgaaaaagaatgaaaaaggttttacaagcaggtattgcttggtttgctaggcttagcactggtcatccagtcgttgtgcaatcagccttggtgcattctcagcagtgctcttggcattaaatcctgggtagtctatggacacgtatggattcagtgggatgtattctacatttagctattttcaaagcaatgaaagtagagaacactatcaaaaggcggtgaaacttatgttctgtagatttatgcattgtccagaaacattgttggtccgccaaactcatgacaattgactgtcctttaacttctatggttacttgaatcctcccaacctcagaaacagcttctacagcagcctcccaaccaaaatacaaattataatctatattctcgatagtaatcattaagataaaaaggcaaattacagctagtgaactattttatcgtaaccagatcaccacgaaaagtactttttatcaggtctaatgcacatcgaaaacgctagattggaggagtgcacggaagcaggagcacatcacctctgactttgttgcagaaggggcaggcctggtactggtacagcaccacgttctgcggcagcagatccatgggcggcctttccttggcctccgccgccgccatcgtcgcgaaggtcagggagaaggagaccgccccagcgattccagctggcatggcccgcgaggatgatgatgatgatgcctgggatgggggcgacggctggacgcccaatctcccgccgcccgccgcggccgccgccgtggaggcggcgtccccatggagagcgcgcgaggagaggagcagcgagcgggaggccagagcttgcgccgctcggattgacctcatcttggcaaacgaatagagcggggctgttagggttttggactggtttgcctcgccggcgccggcggaagaagagacggatttaggaattacaagggagatcctggatggtgctggatggaacgcctaaaacccttgatactttacgtattagtacttcaactactattaaattgtgttattatcgcggctaagggcccaatgacggatcggttttctaaatagacttttgttttcggaggatacctttgcgctcgttcttcttggagaagaagaaaaaaatacgcggaacagttgggttcgcaggttaacgacggatgacgggattgttgtccacggctcaacatctacttccctctgtactataaaaaaattaaacctaaatctaataacctattcaaaatcatagtaatataggtatgtttagtttttttttatgtaaagtttttaaagtatacggacacacatttaaagtattaaacatagactaataacacaaacaaattacagattccgcctgtaaactgtgagacgaatttattaagcccgtcattagcaaatatttactgtagcatcacattgtcaaatcatcacgtaattaggctcaaaaaattcgtctcgcaatttacatataaactatacataggggtgaaaacggagcggatattatccgatccgatccgatccgaatccgtccgatgtgaggatatggtaaaaatttttagatatccggccagatgcggatgcggatgcggatatggtatcaacgatatccgacggatgcggattatccgatattttaatcggattatccgatgtaatgtttggcggataatccgcacctttcagaccacacaacaactctatttagcccattttacatcgggcaacccatctagcctatatagtgtaacctaatccaatcctcccctaaatctctctctctctctgcgactcttctctcggtcccttctcctgctcccacatgcgccgccgcatggcaccataggtgcgccgtgccatcgctacagcctgctggcgccaccgccgccgctcctccttttagtccgccgacagtgtgttgtgtgctgtttgctgtaagcagtgtgctgtatggaactagtgtgttgtgtgctgtatgcagtgtgctactgtattgtgtggctgtgtgctgtatgcctatattgctgtatgcctcattgcctcatgcctgtcatactgatgagtgaactactgaactgaacactatatttttaaattttaagcaacgcagtgaactgctgaactgaacacttatattatgtttttgatggatgtgttatattaagcaaaattatattattgatgtgttttggttggtttttcctagagagctgagatcatgttcatatgttgtttggccatcgtattgcggcaattgtattgccgccctcttgttgtatggattgaatacaaacttgacatccgacaactttttgtctgtttccgaacagagtccgcaccgactccgcaccgaatccgacgtccgaaataatccgctccgcatccgcatccgcacgtcatctgcactcgctccgcatccgcttaaagaaaatggtttaggatatggtatagctattatccgtccgaatccgctccgttttcacccctaaatgtacaattggttttttcctcacatttaatgcaccatgcatgtgtccaaacatttgatgtgacgtttttggccaaattttttttatctaaacaaggcctatatcatatttttttattatgtttgttttttatgagacgaaagaaatacacctttaccaaaagcaaaagcataaggttctcggttttggacatgtgaatatgaaagaaacatgatgatattaggatcctgttgggtagggcttcaactattaaatttaatttcaagagttaggtctggactagagttatgaagcgcggtttaaacccagctttacctcgctagtttattttgtgatgcacttcactccgcttcgctcccttgttaggtagagctgaaactatttggatggactctagctctaagttagagttgaaactctgcctaacaagtcctaggtattgggtagataagcacatcagcacgtacgaactttcaaacacacattgcttaaaaaaatccacgctttcttgtttaggagctacttagttttagttgataagggtgtgcatttggtttcctcggtttggtttgatccgtttttctttatttggtttttctaaaatgccaaccaaagaagagcgtgaaaacttaaaaatcaaaccgaaaaatttggggcctcatcgtttggcttttttctaaataagccaaaacggcttattagagaataaaaatgaatttgtaggtaaagcttttatacatgtgtttttgtgacttaaaagctaatgctgaaaaagaaactacgttgaaaatatctcaaaatcaatatcaaaattaagtttgaaaattcaaattttggctttttctttagctgaataggccatccgatgggagccttttggtgtactcgtcatcattttttactcaagaaactgccttctcccatcgttgcgggcttgagacgatgatcttcactcgtgcgatcgcgtccacccacatgctcatagatctgcccttgcatcgaggttgagctctcatgctggagatcagcactctagcaaacatcgagctccaatgtcactaccgatctaatctggcagatatcaagatcctacgccatcgtagaggatctacttgcatgcgactcatgactctggcaggaggcagcaaatttccttggttgtgcagtccttctctagcactgtgcgtgaggcaagcctctcctgcaagtgaagatgaagaggcgcaaggcatttcccctcgtccttgctttcagtgcggtttccaatggctcgcttgaaagagtcacttaggcttacaaagggaagctagaaactaaaccaggtcggattgtgtgatacctggtcgaacagttcgggttgtttttctttctttaccaaaacacactgagggagacccccacggtatatattaattttttgaagtttatatacaaagatggtagaaagggataaaaaggaaaagaaaacataattacagaatatcatggaagtatatgaatctccctatgcctaagtaaatgaaggctcaaatccgagataagatttctcttccaagaagcaacggaatgctgaataccttgaaatattaggccgtttctttccttccaaatattccaagtgtcgaaacaatattaccttgaaatctgccatcttctcttaggttgaggttttttgggacggaggagtagcttagaaagaattgttacaaaattcttggcaaataggctgctcccaaaactgacagacttggcatccccaaaccaaacagtgcttttatttgaaaaagagcaattcatgataatttcatatatgtacaaaatctggttcaacgttgcataaaaccaataagccaaccatactcttcaaattagatatcccaaaagcattcgacttaggcaggggcagatccaacatgggtgcagggggg

SEQ ID NO: 10490 - DNA, 1084 bp, Oryza sativa
tgtcgatctctgtatatctgtcttccagtcgaatttgtaccatgatagtactagttgacagttgtgttgttggagtggaaaaaacttatgcctatatcctcttcttgtttcagacagtggagatgaaggtgcggatagactgcgaaggctgtgaaaggaagatcaagaaggcccttgaggacatgaaaggtgcttaatcatatttttgctgctgcttcttctttcacacgctctgaaaagcaaaacaagggctcctttagcttttgttctttgttgtggaaatgattgacgaatctgtgcatgtgcgcaggggtgagctcggtggaggtgacggcgaagcagaacaaggtgacggtgacggggtacgtggacgccgggaaggtgatgcggcgcgtggcgtacaagaccgggaagcgggtggagccatggccatacgtgccgtacgacacggtggcgcacccctacgcaccgggcgcctacgacaagaaggcccccgcggggtacgtgcgcaacgtggtgtccgacccctccgccgcaccgttcgcccgcgcctcctccaccgaggtccgctacaccgctgccttcagcgacgagaaccccaacgcctgctccgtcatgtagctagctgtgtgtccccgggacgacgacgaagcagcctagcagggtgtttttgttgccacttgcagctgtaataatattctgtgtgtccagattcgccatccctcaaaaatctttcgtccagattcgccatccctcaaaaatctttcatagtattatagaagggaggaagtagtaatttttccagctgtagtaatgttctttgctttagatagggtgttgtgttactattggactctcttttgcttgtgcttttggtttcagatgtaaaatactccatcatgttcttgtttggtgagatgaatcttcaaatctgcaaagttgcagatcggttgtttgagcttagcatgattgattggggtgggtgggggagacgtgtgaatatcgcactgtatattcgagttttgggtgggctcacaaggtcggcagcgccgaaaggtttttttttttatccgaggcgctgatt

SEQ ID NO: 10491 - DNA, 509 bp, Oryza sativa
catttcccattgtgaaggtcagaccatgttacatgaaatcttccattcacatgcaccatcatgtgttcaatgttggtcgtgattgttatcatattgaaactagatttgttgatttattttttgggggtaatgctgactagctgagacaatatgggaaaattatcacctcatgtcatgtttcaatttttaatatgatagccatagttatgagtacaagcatcttctcctttttcatatggttctgtttatattacagtccacatcagcaagcattttctttccatatgtgatttgtctttagccttaagcaaaaaatatgcactggttcagtggtttatccaccttttacgcttttgtgctagcattgaaataatgtctatctttaattaattttcaggaatgggagaaaccaaagcctgggaggaggcctgatatcttcccaaaattcagccctatgaaaacaccattgccccattcattgccagctgatgatcctctggatgatgatg

SEQ ID NO: 10492 - DNA, 910 bp, Oryza sativa
acatcctcaaatacaaagcacttccctagttagatgtaggttagacttcccgttcgttaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttggtgctatctaaattccatttaaggtcgtaccttatcgcccagcatcatcttattctctatttggattccctccatctttcaaatacggatgtagccttggatgtgcccgtgcccaatgaagaggaagagcgcaacatgaaacgtaagtacaaaaatacccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgagaaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctgaaggagcatcaa

SEQ ID NO: 10493 - DNA, 126 bp, Oryza sativa
aaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaagaaaaaaaaaaaaaaaaaaaaaaa

SEQ ID NO: 10494 - DNA, 7195 bp, Oryza sativa
ctaaacaaacactacatttaactcaccagatcaaaaggaagcccaccaaacagaacccagtttttttgacggtgaagaaatcctgcagaaaaaggtaaatatgaaaggacactaaaaaacaacttgcaagtttggtggagtggaaggaactggatgcaggctgttataccttcaaattaccacacatcgattgtgtgagtgcagaattcaggattgtattccagaagatagtgtagtttagcagaaaagctagcatgcatgagaatagcagcaccgcctacaatcggaataacatcatatgatattgatagctttctgaagaataacagaagttggatgtgtcactcctccactgaagtgaacaggcatgattgggtttttctttttttaaaaaaatggtgcacccagaagtgctggaatctttaggtgtctaaaaacattacagataaaaggagggtagatattgcacaaataagatcagtgatgaccatggttctgtgaaatctgtacctgaaacccaggggaatagaggtagggaaattctatagccttcttaggtcaccctgaatatatgtcagaaaaagtactgaaggcccacagacaagtcctggaatccaaatggataggatatgaatgctaaggcaaatatggtttaatctggatattatgaatatgaaacaggtcatcaaaataataccgttgcaccacatcaggccgaagctatttagaccactagattttcctaaaacaaaacaaaactgctggttagaaagctatgtagtttagaatgggattgtatgtggcaaaactgaaaatgaaatgttacctatacggtttatagtagcaaggtaaacagctggtgtaatgttggccacaaagacaatagcatacccacgagcatcaaacgacaggtctcgagctccagcgataaatgctccaaatacaatcaaagccacgctgacaaacccatggtaaaaaaaatcagaaagtaaaatatggcatattcagaacataacaatgttctggaaatttttagcgtaagaaaacaagtgctacaactgcaaccttatttcaagctacaaaaatacaggtacaacagttagcaataggctacagaaaacaaaaaacagcaacagatactaattgctagttcactgggatagactaataatttcagggtttccaaaagatggaaataatatatagaaataaataagaaagcatatgacaaaaggaagcttacattagttactagcacgtcagactattctgagaatattacgaatttataatacagtaaaaaaaaggaaaaatcatttttatagacatgtacctgccgattataggtggcgtatgcttctgttttgccaagaaatactccattgtcattgtaaagactactgttgtgcgcctcagtgttgtatacatcggaacattgactccacgcacagattccattgaagctaacttttaccatgatggaaaacattactcaggattcaattcaaatagaatacatgcgactaagtgtatttaataaatgtattataagtgaagaaagaagcataccatatagagtaaataagccaaagaaagaggtgtagtacgcaacagtattctgaacggaacgaagaataacgcatcagaaggcacggatggctcgctatttgtaaatgaaattatctttagccgcctcagaacataaagaaggcctgttgagcacaccatctgcacatgtttattaagtgtcaaaaaaaaaaagaggcaggagatgcgagcagcagattacatatatgcatcaagaagttcatcaacagtgatatcaaataaaggtatgaaaagacctttagcaatatccattgctaagcagatgctcaagtaagggtcggaagttcagaatgttctttgattagataaaatcgaatatgtaatgttttgattatgctatcctacagtttatctcctagactacaagcaagttattcatgtgtaaatgtgtaatgcacacttgcacaacataacagcaaagccagactttccagagtccatccaaggggacatgagaagtacctgaaggagcgtaatgacatttgcacaggggaaattatatgaagacagtgctgctttgttaaacatcactagcaacactgcggattgaaaagttgccaaagttagtaaaatgatacctgagatctgaaaaatgaaaacaaatgtagaaagaacgaaaacaagatgtccgtatgtgaaattaagtgactaatccctgtttcataagaacaccacctagctgactatctgtgttggacaactaagtggcataatattggattctcaactcaatcatcaccaggttttcaacctatcatcgacatgctatctgcatctcagagatctctatcgattttgattgcttcgcagatctgccatcatggccaaacccgaaacaaaagtttcagaattttcaccaaacgcagtttttctcttctaaaaggttattatccttgtagattttcactgaaacgctgacagtaattactacataatgatgtttgtacagccgctgaccacttagcacctcctgtcctagtatttaatgttgaagatgcaagcagcctcccagacccccggaacacatccgtcaagtgaaacccccacgaatttccaagcaccacgcagcatgtactttgcgtgtaatgccaaaatggatgaacttttttttctgaagttgttggacacaagtcaaccaaccggccctcttcccaaagataatcgaatccaactgaattaacgaccaaaactgaaaccaaaagtcacctagtagtagtacaaattcgtgagctgaacccgcaggaaccccaaccacgcgctaccccccaaattcgcagccgcatcacgagacgccaccctcaaattctcgctaacgacgaccgcatcccgagacccagccgacgcatcagagaagaagaagaagaagaagcggcgcggatcgggggaacgtaccggagcaggccatgtaggagagcgcggcgaccgcgccgcgccgcgtcatggcggaccccttgaacagcgcggcatcgtcgccgccgccgcccccgcccccgttgcccttccccgcctccgcggacatcggcagcagcgccccccctcccttcgccatctccgccgcccggatctcccgccccccgaagcctccgccgccgaggaggacgagcaccaccacgacgacgacgactcaggaggaggagaagtcacgaggatatttctaaacgagacgcggtcagcccgatccgacggccagcctgcctcgtccgcgcggtcgcgatgcggaaaacttcttctctctccgccttcctggtgcccgagcgtggccagcgcggccgccgccttttttataatgaagtggaaacgcttttactcccaccgtcccataatctcccaccgtcccataatatagggattttgagtttttgtttacaatatttaaccactcatcttatttaattttttaaaaattattatttattttatttgtgacttactttatactttaagcataactttttattttatatatttataaaaaaaaatttaaataagacgagtggtgaaaaaaaaaaattaaaatcacttataccgtggacggagtgagtactacacaaaaattgcgccctctcgctgtccgcggcggccttcgcttcgctcgatgggcttggctttccgccgttggtgagttggtcacatcacatcatggatggatcgcatcgaccacgtcgaggccggaaaattttttggggggaaagaaaattaccagaaagccaacacgaggaggcagccctgccggctgagtggagtctcttatctcgacctgacctgcgaatgcgcgatgtcaccacaagccactgagagcaagtacaattacagggctataaaccagatataaattatattttaaaaagataaataaagaaagagaagagcagcggactatacatctgtagccagctgtaacacggacttcagaacgtaatgtgtgtataacaggtaggaccagatatctatctatctgttatattattaaaacagccttgaaaggaggcaccacgttcgctgtgggactagaaattctcacattaatcggagaaaaaaagaaaaatctacaccgttagatcgtagtggatctaaattataacggtgtaggttgatagcaatatatatgtagtacaattgtagtttttaaattataataagttgtggatgaaatatagcaatctactgctcatatttggaatcaggcagaatcggattatttttctttgatgaaaccgttaaggagtaggattaggattgcagccgcacgaatttttccttttctttaatgaaaccgttacggggtagaattgcagctgcccaggagccgagtgccgaccggcccttcatactctgtctggctgcacggctcctgtgcttagaattctagatttactgtgaaaagcataggctcatggtaaactaacacacgaacccaatacgagattaattaattttcagaacaacaaaataaaatctgaaattagcaaaaaaaaaaaaggaaaagaagagtttgagtagaaatacaatttaaaaataactgaaattcgaaattaaaattatgcaatattggaagaagagtctatataaaaacccaatacgaaaatattaaaattcggaataaaaaaatagaaattataaaaaagaaaagaaaagaagagttcaggtagaaatacaatttaaaattaactgaaattcggaattaaatataagcaatattgaaataagagtatatataagaacccaataatactaattaagattcggaatgaaaaatagaataaaatccgaaattggacaaattaaaaagagagttcaagcaggaatataattttgaaacgactaaaaataaaaataaaaaataaaaatattaaaagaacacaatacgatattagttaaattttgaaataaaaaataaaataaactctgaaattataaaaattaaaataagatttaaactaggaatacaatttataaataattaaaattggtgataaaaaataaagactattagaagaaaagatcatctaaaacacatgacgggattaattaagtaataggcctataaaagagtagagtggtggcggttgatgggatatctaaaatctattaataaaacactaaatagaatgataatgggcaggtcgtgaagcaaccggtctaggcggttggtgggacttcggaaagtaaaaaaaaaaaccaatgataaccatatttgatttttaaaatctcaatgataataaaaaggagaggcggcgggagggtcatacaggagtacaatggcagagccgacgatggttggttagacttctagaaagtaaaaaaaatgaattccaacgatagttatgttcgatttttagaatcccaatgataataaagagtaggcggcggacgggtcgtagaggagtatagtggcagcgtttgacgagatttctaaagattataaaaaataaaatccaacgagacaataaattataaaaactataaggtccaaatttaaaaggttcgggcttatgaaaagtaaaaaaaaccaatgataaaatctcaatgagagtaaagaagggaggcagcgggcgagccgtattggagtacagtgataaagtcgctgacgttttggtggaacttccagaaagtaaaaaaaatgaacctaaacgataattatgttcgatttttaaaataccaatgacaattaagagaagaggtagtggacgggccgtagaggagtataatggcagcgtttgatgggacttttataaattataaaaacaaaacccggcgggacaataaactctaaaaattatatgatctaatttttaaatgttccaagaagaacgaatagaaacagtgctagatcgagaaagcaaataaaaaaaagatatgacataattaaggggtatcaactggcgtgtgacttttataaaaactataaaattaaaaacacagtgatgataatgtttggtccaacgagataattatttaataaattttaagtaaaattatattaaaaatatataattttgtatgggtgttagccgcgtaattgcgcgggtcacccagctagttaatattgtagtaagtaattattatatgtattagcttttatattaattatagatgatttgaagctattagttggctgtaatgttaaacttgctctgatggctcgctcggtcgctacgcgcgacagtatactaaacaagcaaatcgtatctacgcgacgggatacgtcgatccactggggcatcatccgtcatgtgttgtgtggcttttgacggggtgatgggccgggctagatagagatggggcttgggctggcctggttcgagtgaaccggccggggaatcgcgtgtcacctcgagatattttaaggggcagcgcgttactcctatccttttctactgctagttgctgtcacataaacgagcaaatcttggggatatggtattggtatccactggatgtgtgatcaacagccttctgcttttgttgttcgagcgtttcgagtgtttgcttggattagcagatctgcttagtaaggtaaggcgtcatttgccgatacgaattaggcattgttatatgatgtacttccggttttggttgatgcgtttttgctttgagcgtcattgaaccgagcaaatcctgatagtagctgtcacctccaaattagtacgccatcatggtgtgtgatacacctccacctttgggtagtgcgctttatggagagcagtaatgcgttccgttttaagcatgggcaaacggagcaaaacattgtatcctcataggtagaggttgttactaaatctaaccgctttaagcggttaaatgaacggtattgagaccagacaggttggtgcatggtaatatcattggtggagaaaccatctttcctcccggttcgtaacccccatttaattccagttatttaaccggggctacaaatccgggactaaagatcgctatctttagtcccgggtgaaataaccgggactaaagatcgatctttagttccggttgttaacaccacccgggactaaagataggggattaaagaggagataacagcagtctagatgccccatccttttttttttcttttttattttctccc

SEQ ID NO: 10495 - DNA, 801 bp, Oryza sativa
  unsure (1)..(801): unsure at all n locations
catgcaataaatcacaaattctaaaaaaaaaaattcacaaagacgccggccggccgctgccgcctcctttccacgcgggccggccaccgttgcgccgccgcgccgacccgctctcgctctcgctcgatctggatagagataaggcagcgctctcgctcgatctatcaaaaagaaagagataaggcaggaaagaggaagagagttagagaggaaaaaaagagatagagagagtttgttgtgtggacgatataagaggataagtaatagggattatatagtacgtgttagatttttattcctggttggtaacaccaaccgggaataaagattatctagtcctgttgttcttataaattgggactaaaaatcgtttttactcccgatttttaatggaaccgggactactgtggatttgggtcgaccgagcaaagatggtttctccaccagtgtatgttagtactaccttcttttttttttggcatatatgctccaatgtaatctgccggttcatcaaattgcatttgcctctgactgtccaactttatccttgttcttgttgtctcgtctaggtgcgccctgcgacaatgttcgtgattgtacgtgtgccattcgtcgttgagccatagcgcaatgtatcgcaactcgcaagttgcaacgtatttggcccgcgtaggagtgcttgaacccatgcttcccaaagtcattacacatttttctctatgagagagagaaaaaggatnnnnnnnnnnnnnnnnnnnnnnnnnnnnnnnnnnnnnnnnnnnnnnnnnnnnnnnnnnnnnn

SEQ ID NO: 10496 - DNA, 2942 bp, Oryza sativa
  unsure (1)..(2942): unsure at all n locations
atgaaaaggctaagagaaggatatgataggagttcttacttccaaacatgattacttcaatgcaagttacagcaataaatccagataaaatttcgtgcttctatttactgaaggatgaacatttggaactaatctcatggcacggaataataaacagctaatctgctcaacattctacttagagatctccagagttctacaaggttagcttaacaagctctggcctccaaataacctatgataatttcaatggacctccaaacatcctatagttgttttaactcaaacaactccatccacaggacaagcagtgtaagtaaataacatatttgtactccagccgagatcttcttcaaatggcactccatgctgagagtgacgaattccttcgaaaagtaaggagaatgtcactgggatggctctatctaatagggcaacatatcctatgcacacaagccctcacgtgtncacacgtgcacaccaactaaaaaatgtcaccaaaaaatctagaaaaaatcatacacatactttcaattgtattacacctagggttaaaatcttaacgtcaaattcattatattttagccgtaacaaaaaaaaaaaacaaaaaatctgacagttttaagggtgcaattttgtcagaattttatcttttttgttattctctatgtagaatgaatttgaagatgcgactttgcacgtagatgtaatactattgaaagtacatgtatgaatttttctagaattttttgtgataatttttagttggtgtacacggtgtgtacacgcgagggcctgtgtgcataggatacgctcccatctaatagagcccgtgcaattcggaggagcacataacaaaaaaaaaaatgtccaacctaatgacaagcacctgcgagctacgaacctatatatggcatttcttctgatttcatccacccccaatccccaaatcccatgaatccgcatgctataagctagtaaaatgaccaaaaaaaaaaattcctcaacccgagcactcaattcaacacacacgagaacaatcagtgcataaaccgatagaatctttcacggtgaatcgggaagagggggattattacgatgggaaaatcgaggggcgaccgccgcgtaatcttctcctcgtcgggggccgcgcacaccacgagcgcgtcccatcttcgccgcctcctcgaggggaccgccgcccgcgcgagggagacggaggccaccgaggccccgaggggcccgggcgccgccgccgccgccgccaccggcgcagcggcggaggccgaggccgagaggcaccagacggacgccatggtgaaggcggcggagctggctctcttcgtggagtggagaagtcgggttggaattggggtttcgcgaagtggtggtggacttcttgagcttttcctccaccggaggctggctctctctgagacgagaccggctccgggcgataagagtcggcccgtgtacagtaccgccgacttgctgctgtgcggagtttgctgtgctgtcttagtgtcttgccgaggctgagctggtggagaatttctgcggatgcacgccacagatggagaaatcatgtccatgtccctcggcctaaaaaaccatatttgcagaaacgcccgtgaagagggtaaatactaaatattgtgtttatatcatgttcatactatgtattctcttcgtttcgtattataagtagccttgattatttttctagttaaactttttaagtttaatcaaatttaaaaaattagcaatatctataataccaaattagtttcattaaatatgacattgaatatattttgataatatgtttattttgtgttaaaagatattattattttttttctattaactcggacaaatttaaaaggtttgattagaacaaaaattaaagctaatcataatattaagggactgcctatatatatactagataatacctcgcgcgttgctgcgggatatttttttgcatgacctagagttgtaaacttttagtaatagatattgaccgaaagttgtttcatatagtctaatgttacatgataattaatttgaaaccctgatgtttgtagcagtgaattgtgaagatgttcacctagaataatggaagttcttaattaattagcagcttatttgtttactgaatcacattcaccagtttgttatattcttacgtcatgattgaatggttagcctgattaggttgcaagcaacttctgagctccagccatacgtacaacaaatgaacctgccatctacagtaaaaaaaactcggttagtcgagcaacaatgtgtaggctgcatgtgaagttaacggtgtgtaattaacagtgtatatattttcaaatatatataaaaaatacgtacaacacactttgaacaatagattaagtaaaattctatgggaacatttgaaagggtcagttaagttttacctcgtaatgcagtattgcactttattgagtaaacaaatagctgaaaattttccctagtaaagcttatacatttctagacttttttaaactaaacaaaaaacgtgatatttgcaggatgaattcagaaagagaaaaaaacaatccgtaaaatagaagctacggagaacgaatactaacacacttaactgatggatagtgaaatactgaaatacctgccctgtactgcagatgacgatcagttgcacttctattttgtgtattgatcaaatcatgcacttcatgcaattacatcctttcactacatctgaatcacctgataataatatggtaaggtagtgaatcacctgatgatactatggcaagaaaaatgagaaacaaaggagaaagattagagcaccttcggcaacatcttttattatgaaaaggaaaactggattctcaaaaaggtgaaaaccatgacagttaaaggtagaagacctggggataataaac

SEQ ID NO: 10497 - DNA, 1736 bp, Oryza sativa
ccaaataactttctgtacatatcaaatatccaaagggataaaaataaaactacttactacggttatcaatgcagaacatcgtacatgtggaagaagcagagttggtggaggagaacagagaacctgattgaagcattccccagtaataagcgaaggccaaggatgaattcaccatgacgttatgggagcagtaaattgatgtatttgatgacaaccatgaagtctgatctcgaagcagcggtttcgtttctcatgacattccaaagaggaggcgaaaaggctgggaggcggcaggtgggcttgaaccaaaggcagagggagcgccatatagatggagggacacgacgcacgtgggagaggaagtgacgggcaccgccacctcaggtggtgcggtgtatggaactggagggttttcctgaattttttttatttatacttttttttattaaaatatttacaaaaataattttttgtttcgaaaatttacaaatctaattgcctgccgccctcaagaagggcgatttttaaaaatcgccctctcaaagagcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatatacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgcccttcttgagggcggcaggcgattagatttgtaaattttcgaaacaaaaaattatttttgtaaatattttaataaaaaaaagtataaataaaaaaaattcgggttttcctctggttagggatggatacccgttgagttgggccataacatgggcttcttttggcccaataaacaaccggggaactctgggaggctgcttcatggattccctgccgaatgattcagatcgtacggttaatagcaaatggggtgacgtggaagcaccaggaagtagagaattcctagtagtggggatgatttgtatagatatataggatatgttgacagaaaatcccacctcccatctttcaaattttggaccgtcggatatgcttttagattcgtgcagaggtattaaccctaactctccttccgttcccctcccctcgctcattccgtcgccgccactccctcccatcgcgcattccaccgtcaccgccccaccgtgcattccaccgccaccgccccaccgcgtcactacccgcctcaccggctagccgtagggcataaacgcgccagcgagccccccccccccccggccggccccttccccttcctctcctcttctttcctcaagcggatggtggcgtgctgtcccctcgccgtcgtcttccccgtctccggcggcagggcgccaccacctgccgcctcctcctaacacacccttccgctttgcccccgccgcctacaccgac

SEQ ID NO: 10498 - DNA, 7272 bp, Oryza sativa
cccactcccacctcaacccgggaccttaacccgtaaggtcctcaaccggagtctagggtctcgtcggcgctgaagaagaaagaaggtcgccgaagttggaggagaaggcctggagtacgaatcgcaaagttcatccggtggaccaaaatctgcaagtttttgaggtagattttctttcaacagatcgttagcattcccataatattaaatggaggaagcactaaagtgatgttgtgtaaaaaggatggcgattaagatacagtgatatatggagttcattcttcacaagtagggatggcagtcgggcatgacaggcacgggtagagactacccatacccgtgcccacgaggtaattcatgcctgcgggcatacccgttactatatgacgggcaaggaacactacccatgccccgttgcccgcgagcgccatgtgcccgcgggcatgcccatttacccatcacaaactcacagttcaacatttcaaccacaaatctccacaagcagagagacattatcacaatttaaagaaagggtagagttgtaccaagttcaacaatacaagcattacaagttcatcaatactagatggtggcatttatactaatttgactgagggaccacatgtcagttgattttcgcgggtaaacgggcgaagcgggcatgggtagtgactacccatgcccgtgcccgtatgcccgttgggtataggttttgacccaataaaaaacccataggtactaaatgtagaacaaacccaactctattagggtttttacccatggataaacgggttaaattgccatccctattcacaaggtaccaactttggtgtttgggattattttagaaaaaatggtgttttcagggggcagagccagagtgtagtcaccgcctcaccggaagtctgggctggtcgacgctgagagccttttaattacttccgttgttaaaatcatcttttgaatgggtgtgcatgtatgtatttataagagtgaacatgcacgtgttacgagtgttcgtgtttctactgtgctcttgtaaaaaaaacagtctatactaggaagacgactcacagtggcgcagctaggggggtgccaaagggtgccaacaccccctatgcaaacactgccaccattacaccccatgtttttactctatattaaggttaactaagataagtatttatctaatttattttgtgtagcttgaaagtattatcagtttagttagttagcaagtctaaaaatattagcaagaaatatgatctacaaaattagtttgtgatttctcgtctttttcaaagtaaaatagatgatacttatttgtgagattattcaatattatttgtgagattattcaatagtttacattaaaagaatttagtaataaagagtagtttcatacttccaatgatattattaaatagctaaaattcaagtttttcttaaaggactactttacgcattacttgttattgatggtgactatttgacatcttttgctatcaatattagttattcgatctcatgatttatctttacccccacacccctctaatctcaaatcctgcttcgcccctgacgactcatgtgctttattagtgcgtggtgcgattggaattggtacgtttgctttcctttttcaactctggacattggccgttacagtacatccatcgctttgcaaagcgcgtcccgtgccttcagatcgttggcacaggccaggaccagccaaaaaggagaagaactgcatgcctatgttttcggttacctccgcctccgcgctggcgcgctgcgcttgtcaaccagggtaaaatctaatcttagggcatgtacaatgttctttattagtggtctctctctattgacatataagtaaatttgatgacatggaagaaagagaaaggagaaaaaagaaatatggttgttatgcacgacaacggcttagagtcgactctagcatttattaaagcaaattttgttacatagtggtgaaagaaaggaaagaatagtaaaaaaatattttgatacattaatgattagagtccatattgtctccaactattgtactccctccgtttcgaaatgtttgacaccgttgactttttagcacatgtttgaccgttcgtcttattcaaaaacttttgtgaaatatgtaaaattatatgcctacatcaaaatatatttaacaatgaatcaaatgatagaaaaagaattaataattacttaaattttttgaataagactatcagggttatggataccacatacctaatagtacttgactaaatctcggcaggatccaccacataccatatcttatatggaaactgacctcgagggagttccggataaggaaagacaaccagagttctacatggaaatgacaatgactactcggattgtatccatattggtttccctagttctacttggacaaggggacacctatgggtataaatacaagccccaagccccccttggaggagagaggacacgagagaatcaacacccaccatggaggatcaacacctaacacaatcgacatagaagcctacatacgccaagacacgccgccggatatcgacttcagggataagcacggctagtaccctacggtgtctccggatactgtcaggagagacaaaagcgctatctctgatctcgccgggcacagattcgaggaggaaggctaccatgttgtcgactacgagtcagaccttcaaaccgtcatgtcgataacagttagataggctatcccaaatattgtacttgtgtgattatggtgaataagagcaacgaccggctccggccaacaggatgtagggttattacctgacaattcaggggcccgaatctatataaaaatcctcgtctccgtctcgcatatatcctagcaccaacgatccccatactatgaaataccaggattgcaacatcaaacgtcgacaaagacgaacggtcaaacctgtgctaaaaagtcaacggcgtcaaatatttcgaaacggagggagtatgatgctagcctctaaatagcgtagagctcatacctgactctacttttatacatgcccttagcatgtaccgtctaatcggtacgcgtaacacacttgctatatatttcccgcgccgtggcccgtccgtgcctgccgcacctgcagtcctgcacacgcattggcccgtcaggacaccgggcggcggctcgacgggatgcgctcggtttccccccagaagagagcagcaaatcgccggcttgtggcatggtggcctttcgcctccgccgacgtgcggaccgcgacgctgagcgcggtgaacccgcgccccgcgaatgtaaggcgccggcccaccactgccaccccggtgcgtgacgacgggctgacggcccatgacggtgcggagcccatcgaccgagcggatgcgcacggatgcaacgcggcccaggcgcacgctgttgcgtgcgtgcgtcgtccctgcggttagctcgcttgctccgtgtccgcgtgtcacgtcacgtggtgtatcacccggttgcgagcgtcgtacgcggacgcggtgcgtagtacaataccaattctactacgacggattaggccggaatcaatggcccgtgcctgtcagcccaaaagattcacctggccgtgtaaagcgcctgccacctgcagctcatgctccgacggctgtcgcagggctcgcctgacacgtgttgagcccggcgacaggtatattcagatccgctacctagctagctttgctatcgggttggactctctgcaagtccggcacatgcatgatattcaaccgggggctcacacgatctcttaaaccgttcgtgtagattattagtcgtcgcctactcgcctgtagtactactccgagtatagattaattaatcgaaccgctgcaacgacactcgcgcacaacacatgcattcgctggacgtgtgcgtgggtgtgggcggccgggaggcccggacaccggacacccgcgcgcgtgcagcgaagaaacgcgagggccggccgcatgcacacgcacgggcgggcgcaagatacaggagcataccgacgagcaaccgctttgttgggtagtagcttcgtcgccgagagcacgtacacaagcatgcatgcatgtaaagaggtggtcctgtatagcctaattttgtctcagctccttggacggagccgtgcgacgaccctgtgactatccgatcgtaacccagattattataaaaaaaatcatatatatctaattaagctacgcgcgtaaccgagggagttaaacgtgtacgtgcaccgatcacaggtaggttaatatactgtacttagtaaaaaatcactgcgagggagagactaacatgtgtgtgtacgttttgtttttacttttcaccgctgcatgcacgatggcgtccggtttgacggtcaaagcttcggcaggaagcgcgggaaccgagcgcccggaccggtcctggcgcccaatattctactcgcgcgccgcgaatactctactggtgccgtcgtactacgcactacgccgaggaggatcccatgcacagtagcgccaccaccgcacacgcacgcacgcacgcacgcatatgtgtgtgcaccgcatggggaaccggcctgcccggctccccccccctcctcctcctcacgtgcaccgtggaaaacaccaacaccaagcatcccttattgcagaggaccatgccttgcatgtgtcaaccgctgcatctgcatgaggcaagacagtgagttcagcagccagccagcgtgagacaatctgcatgctgtgcccagcaaccgacattttcctctctctgcagggcagaatcacggaagctagccctgtgtatttacattgatcaatgctagattcgcaagttggtaggtagagagacctgctgcatatggttattcctcttctgcgtacgtgtagagctacccagcgtaattggtaaccaacgaggaatgtgaaaatagcgtggctgacaaacaaagcttgcgcagagtactgttggtaagtcctgccaatacacacacacacacatgatgggtttggatatgacggcaagcatgcaatttgtagttctatacctgcggagatagactcatagaggagcaagttgttggcagatggtatgatgatcgaggtcacctgttgtagctacttatatcccaatgaccagcctagccattagctaactatagctagttgcaagcgagatagcattattaacattctccctgtaatcatgtatatgcatggtcctggagctctgcacatgcacggctagctccccggccggggcgtgatatgagggatcgaggagaggacgggaagctggggctgatcaggcaggcatgttccgtagaaacgttcatggcactcctctcctagctctctctctctctctctctctctctctctctctctctctgcatatgctgcgtgcgtgtaggcactgttcattcctccgtccccagctggtgtgtgtgtgcatgcccggaagacaagggtgtgtgtccttgtagagggcacagcttgcaaccccagctcccctactttattcggggtcaccgtgacctttctttagggttaacctttctcgctctttggggttagctgggcgtttctcgatacggagagagagaagagagagagagagagagagaggagaggcccgagtgatgcggggaagacagtgggtttggatcatttgattatagtaccaaggaatgatcaagaaagataaacagtggagtgaatataatatgctcagagtgagattcacaccagattgacactttctgttctagtcttgcattttcagaatatagcaagtaggttttcaaatgtacctgtacgtgcatattggatagatttctttaaagagttctataagaaacattgatgcttttgcattagccttgaagttttacgttttcacctattcgcttaagaatttaatatctaaaataaatcacctcattttttttgaaaactatcaaatataactgtagtttaattgtagtataattacaatctaactatacaataaatgtatatattataacttagtttcatataacctgtacatataagttttataaaatttataatgtaattacactatagttataatgtagtagctgtgtaatacagttatagtacaatgcagtatatttatatttgaaaaaaatacctaaaatattgtgacaatttttagcaattcacctttgcttagagcgacatcgctccatgcaataatggcagaagaaccatctccactcccttcaggggggctctttttctattatgggtggccatctagataaaaaaaacttatgagagatatatggtgattttctctttcaatttgttgaaaggagttgaaggtttttgttccactcccttcttttgttatcgtaatatttaataaaaacaaaaaagtattttaacctacatatatgtaaattaattgcatattatgcctaacttaccaaatgccttaaagatacatagacgaaaacacaatagtagcttacaaacactcattgcacatatgttgaagtgtcacatcacgcaatccaaggggcatacaaatacacaagttagagcaagtttaatagtatagccaacttgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaacaaagtgtcaaccagcccccaatcgctctgggatcggatctggagaaggccttgtgtccaaaagtcctctcctatctaagtgggccaagtgtgagccaacctctcacttgttctaggttccgaatctggaaaagatcatcctctttccccatgggcaaggtcctccttttatacttcaaggggataccacatgcacccctccttttcaaactggacttttcttcccttcataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccacgcgtcagcctagcaacgtgcatgttt

SEQ ID NO: 10499 - DNA, 18640 bp, Oryza sativa
tggtcacagaccggataatcgagtgcactgcactgtatttcatgcggcgtgacacgtttagccgaggcgcaataaatgcgattaggtgagaccccgctgtgctcacctaacccatacacgcggagtagaacccgcgaggggtcggggcgcctcggccctcgggggcgaggcaggagtggtccgaccgacccccccctcggggagaccaagaggtgggtgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttctcaagggaagcggtcgggcatgacgccactcctaaagcctggtgacaggtgggaccggtctccatggttgggcaaaaacccaacggtctcaaaccatgcacatcggtaatggtaacttggctgtcaataatgggcggtctcttcaagactgccacattacctgaacagcgcacgaatctgggcgagccgatttgcttcgcctggagatatggtgatggtgcttttctcggagccatcagaatagcgtatagcatcttctgggcctgagggtatcgggttttggcgtcccggagggcctcgctaacaaagtagacgggccgctgcacctttcggcggggccgatcctcttcgctaggggccgcatctccagggcgctcttcctccgagaggcagcgcggggcgccctcggcttctgcgccgacgacctcggggtcggagggcgacaggcgcggccttcccgcagtggccccgaggctatcctgacaccgtcggacaagcaagtggagggccaactccggccgtcgggggccttgggccgccgttcggcttgggggcctctcggaccctgacttctccccgtgggcagcgctggaagagttcccttccggaaccgaggacggcgcacgcgcgcaggtccgggacgccgccgaccacatcgtccacagcttcgagggtacggcccctcggctcgcgttcgccctcgactccgacgaggagggcggtgacggtggtgcggacgacagcgacgacaaggctggtgacccgggcgcgtcagagtgagcccccaggcccccgccaatcttgaataactttttctttcttcttccgaggccttcgggcccccttcttgtatagactaatttaatctgcaaccaaataaagaggaaatttctatgtcaattctatttgttgtgtgtatgagacgaggatggtctatgcctcggtccttctgtgtcttggcttgaacaagggctcgtgcccaggtcctagtcctcaaatggctcgggtcggggctagtgcctggggagatccacatgtcgaggctggccaggccgggaacgtggtgaccgagggttatgggtgacccgattgtgggtttttgccgattcccccccggagttcaccacgtcccggggcacggctcggttctgggccccgtttggcgattttagccgacccgagcccccgaggacaggatcgagcacgagcgtgctaattcaagccaagattcttcaaaaggaaacaatggcacagacacagtccttaggaaatcgaaaatgcttttattgaaatacggaagagaaaaaagataagcccccggccaaccctgcacgccccggggggggggggcgcggggttggcccgagcccaagacctgacacccgacccccactaggggtagaagcgacgagggtgttcgatgttccacgggttaggcagctctgtgccgtcacccgtggccagccgaacggagcccggccgggggacgccgatcactcgatacggaccctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggctcgaagggccgcgcgccgccttcgctcttccaagtagccgaggtcagggagcgtcggcttccttctttttgtcgctcgcaggcctcccctttcgggtggccagcgaaacgccctcgacgacgtggacatgaccctcatcgtcggaataggccgacctcttcttcctcctcctgtctcgccgccttgtttgagcagcagatccgggggcggccgaagctgccacaccggaatcggaggggttccaggtccatgcttcctccttacgagccactcggtctgcgagctgaaaaagctccgcagtagtctggggctctttggaagcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgaccctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccgacaccaccagccgggggcacggagggcaggtcctcacgtccatgtcgaggtgacactctggacgaagaggcgccctccgttgcgcggggagtacgccggctattacgccagcgctcgatgtcgaggcgggcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctcctgcatcacccgcgactggcgatgctgcggatttttcgacactctcgagcgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacagaggagtacgagagctcagaaaacacacgatgagccccctacctggcgcgccagatgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaacaaagtgtcaaccagcccccaatcgctctgggatcggatctggagaaggccttgtgtccaaaagtcctctcctatctaagtgggccaagtgtgagccaacctctcacttgttctaggttccgaatctggaaaagatcatcctctttccccatgggcaaggtcctccttttatacttcaaggggataccacatgcacccctccttttcaaactggacttttcttcccttcataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccacgcgtcagcctagcaacgtgcatgtttgcccttcttcacacaacatcttgcctgtaatggttaggatgaagcctggcatatatcgatcggggctaacgtgccatctctgggatgtaacacgctagctccagctggggacgagtgcctagaagctctcgtcttgacgggatggggcgaagcgtgcgtcagaccgcctgtcgccacctaacccgcgatttgaccggtctgtgactggtcacagaccggataatcgagtgcactgcactgtatttcatgcggcgtgacacgtttagccgaggcgcaataaatgcgattaggtgagaccccgctgtgctcacctaacccatacacgcggagtagaacccgcgaggggtcggggcgcctcggccctcgggggcgaggcaggagtggtccgaccgacccccccccctcggggagaccaagaggtgggcgcacacatcaccctcgggtccgacgtcccccgagggtgccaggccacgtgggcgattgtgtctgcctcaagcctctagtcatgatactcccggtcccatgtcaccgacacaactcttagctccaaatcatctatagccaatgtaattgtcaatttatacaatagttgcttactatactattaatatatggtcctacctgtcatacacacattacgtcttagagtctgtgctacagctggctataaatctgtagcccgctgctcttctctctctttctttatcactttaaaatatgtttatagctagcttatagcctgctattgtacctgctcttagctagaaagagtgcgtggttaattgagtcaaattaattttgtcttctcacgataaacacctatagaaaaggggagtgtccagattttaggtgactggaaattttaaataggtattaatagttgtattaatggcttatggtctgttaatttgtactccctccatctacttttgatagtcatatttcatcttggcacacagaccaaggataagtaattctacttattatcatccatttaaacatgctactccctccatctacttttgatagtcatatttcatcttgacatacagaccaaggataagtaattctacttattatcatccatttaaacatgctactcccttcatctacttttgatagtcatatttcatcttgacgcacagaccaaggataagtaattctactcatcatcaatttaaacatgatactagtcattcctcgtaaataagcgattcattaatatttacatttctcgatgctcatgtagccaatcttgtgtggaagaatgaagagtcatgcattaaatacgagaaagttattaagatgatagattgttgaattgaaatatgcctatcaaaaataaatttttcagatatgaaaatatgactatcaaaagtagatggagggagtactagttattcctcgtaaacaagcgattcattaatatttacatttctcgatgtccatgtagccaatcttgtatggaagaatggagagtcacgtattaaatacgagaaagtcattaagatgataggttgttggattaaaatatgcctatcaaaaataaatttttcagatttggaaatatgactatcaaaagtagatgaagggagtaatatgctaatttaagccacttatttatgcatggtgatatgttctaaactcttaggggatgtcatcactggttcacctgcacagttaaaaatgcaacacagatattttaccaaaaatcctcattttttttctaacatctcggtgcattaagattcaaaaaattataccatatcttaaaaaaaatcaactccatatttgtgaagggaaaaaagaagataattaaattgtgaattcacgaccttctatttcccttcttgtgtggatcgagttcaaacactccaatactttagcattccaactaccaaatgtgatcccatcatctcatcttccaagatcatgttcacacacaccgccggatcggagcggaaggtaaggtgggcggccggtttgcatgcatgcatgcaattgctaaaaccagaagtcgatggacgctgcaaaaacacagtcaatcaggcggctgggcatgcagggtcgtcataccagtccaatccagcgattcacctcgaaagcaccataattatagatcagcgggcaggcctaggcgcgcgcccttggctagccttgtgccctattatcggtggtgcccgccgcgctgcaatggctggttggaactcggaagcagtggagagagaacgagagagatgggccatgggcgcgagacgaacgacgatgcgcacgcgcgcgcgcgcgcgtccggcggcacgacatgtcagagaagagagaggcgggttggactgattttttttctgcacaggtgtgcgtgcgcggcggtttgaccggcgttgttgaggcagcgagcgtttcgtctctctctctatgctctcggttatttttttcttcttttctccggcgcgagcgggaatctttcgctggattcgtcgccgttggacgggacgaaccgtccgcgcgcgctaggacccgagcgtgaatccatccacgcgtgcgcgtgcacgtacatacgtcgtatatacatacatagtagtgtggcgatcttaacttgcttgcttgcgcgctatcggatccaagctctgatcgagtaaggtctaagatagattgattaagatccaaggatatgtcgtccctgatcgatctcgttcttgttaagcttatttattcggctagctagctctttcccgccactgcttgcattggtatatatatttggattgatcgagctcctcgatctacatgtcatgcatgtcgtcttttgtttgggttcagattcatactaattaaaaggagaacttgatccatgctatatagtactatatgacaataattcaacaaaacaattgtcatatcccgtatggtttatgaatgcctgaacttttcttgatttggtaggagttaaattgctctccatatgtattaactgacggtaaacaactgctagctccatccgttctcaaatgtgaacatttctaatatttttttgcccccttcagcttcagaatcctgacgaaacaaaagaaacataactacttgctagctaccagcacaacgtctaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagactagtcttctgctatactctgttcttaacttataaatacaggcctcctagaacatttcccctcctctcaggtggccaggatattttttttcttggcctctctctcctgccatcttcacattgacccaaaatgtagtgcatcccctggaaaagctatacctcccccgtatcagcttccaacttagtacatccctcctctcatcctcaccaatgttttcactgctgctctgatcatcagcaagaaaaccaatcccactgttctatcagcttcttctccccctgagatggcttctgcaaacaactggctgggcttctcgctctccggccaagagaatccgcagcctcaccaggatagctcgcctccggcagccatcgacgtctccggcgccggcgacttctatggcctgccgacgtcgcagccgacggcggccgacgcgcacctcggcgtggcggggcatcatcacaacgcctcgtatggcatcatggaggccttcaataggggagctcaagaggcacaaggtatgcatgcacgcgtgtgtctctcgttttctagtagtacatggagtgatgggtgtttgatcttgatatttgatgttaacgcagattggaacatgagggggctggactacaacggcggcgcctcggagctgtcgatgctcgtcggctccagcggcggcaagagggcggcggcggtggaggagaccgagccgaaagctggaggacttcctcggcggcaactcgttcgtctccgagcaagatcatcacgcggcggggggcttcctcttctccggcgtcccgatggccagcagcaccaacagcaacagcgggagcaacactatggagctctccatgatcaagacctggcttcggaacaacgggcaggtgcccgccggccaccagccgcagcagcagcagccggcggccgcgggcgccgccgcgcagcagcaggcgcacgaggcggcggagatgagcaccgacgcgagcgcgagcagcttcgggtgctcctccgacgcgatggggaggagtaacaacggcggcgcggtctcggcggcggccggcgggacgagctcgcagagcctggcgctctcgatgagcacgggctcgcactcgcacctgcctatcgtcgtcgccggcggcgggaacgccagcggcggagcggccgagagcacatcgtcggagaacaagcgggccagcggcgccatggattcgccgggcggtggcgcgatagaggccgtgccgaggaagtccatcgacacgttcgggcaaaggacctcgatatatcgaggtgtaacaaggttagaacaatattggtttgtctatgctactatggctagctacatgcctacatactgatcgatgatggattgctgattcctttcaaatggaaggcaccgttagttagaaaattaatgatctcctttttgagtcgaggcgcgatcgatctatcgagaacataaactatcatcagatctatggttctatactagatagctagctaactgcaatcgaatttagataaataataatgcaatcgctcgatcgagacagtggctatatatgcaactttgagttagtatatagtttatgtgatcctttggaaaggtaattgggtataggctatatatgtagaaagttcattgatctaagaaaaggaggacaatgaaattagatgttgatgatacggaattagtatggagttagactaacttcgttaacaagctaaatatacgattgggaagtaaataattttgttcacaagaaataggagccacactagtattggtaattgttgatagatacgatattactaattctggtattgcccatattctaaccaattgaaaaaagatcaaaaacatgctaatacttttgcttattaatttttctcactaatgttctattgcacacatatgcgcttagatcgaacatgcaaggatgtcaaccaatgtttatatttttttttcagacgtgattttgaatcttaatagcatgcatatgagctttagtaaattacctgctcttgaaattgttggtttcaggcatagatggacagggcgatatgaggctcatctctgggataatagctgtagaagagaagggcagagtcgcaagggtaggcaaggtaatgcaaaatgattatatatcatctcttttctccctccagcataacactacgtatgtatatatgtacacttaatttacagtactgattaagcattctttcaattcgtctgttccccatcgcctaatgactctatccggaatgacaccgttatgctccgcaatgcgcagtttatcttggtatgcatgcaaacgccttcagtttttttttcattgtatataactatattagtgactgcacaatcattatacttgtatcacgactactcaggtggctatgacaaggaggataaagcagcgagagcttatgatttggcagctctgaagtattggggcacaacaacaacaacaaatttcccagtaagaaattaaacatataagtttgtcgttttagttttctagctagcttgttaatagatcatagttttctacacaccacttataatacagtatataaaaattaaattgtgcacttgttgattgcattttcccttttttattataaaatttcactgcagataagtaactatgaaaaagagctagatgaaatgaaacatatgaccaggcaggagtatattgcatacctaagaaggtaactgatgtttcaccatatggaattatcactcccagaatatcagactatcacactgagatatgatttcattaattaaatatgcaggaatagcagtggattttctcgtggtgcatcgaaatatcgtggtgtaaccaggtaattaattgatttatgttttcttcctagctagtagtatacaaaaaagcacgcaatgtactagatgtgcttgttgtccttatttatatgtattatgaactactaatctctaagctatgtcaacatatatgtacacggctcatgttaactgtatatgcttaaattttgtagtgatattttggtgttccaatgttgtaatatagattaacatataatttttgagcaggcaccatcagcatgggagatggcaagcaaggatagggagggttgcaggaaacaaggacctctacttaggcaccttcagtaagctgctacactgatcttagacctgtctcatctaaacttaatcgctctcctaatgaagatccttaaaactaatcaatgactagtcatagtgttatatccccaagatctaagtcatcgacccgtactaatttagtccttttttcttgaaatcttcgtacgtctcgtagaactgaagattagatattctatatgttgccctatggcgcataaaatagtagtactcccagttagcgcattaactatgtccgaaatgtacctttcaaagtttttgtctcaaagttgtctgagaaaaccggggcatggagtcaagggccaagtagaaaaccctagcccctttgaattttaatcacacagctctagctttgccctttgcttgcaccgtccatgcgtgcatgcatgcatgcaatatggaacatgttgcacacatgcgtttgggaaacaaaaaccctaatcatatgcatctgatcatgatgataatcgttgcgtataggcaccgaggaggaggcggcggaggcgtacgacatcgcggcgatcaagttccgggggctcaacgccgtcaccaactttgacatgagccgctacgacgtcaagagcatcctggagagcagcacgctgccggtgggcggcgcggcgaggcggctgaaggaggcggcggaccacgcggaggcggccggcgccaccatctggcgcgccgccgacatggacggcgccggcgtcatctccggcctggccgacgtcgggatgggcgcctacgccggcttgtaccaccaccaccaccaccacgggtggccgaccatcgcgttccagcagccgccgccgctcgccgtgcactacccgtacggccaggcgccggcggcgccgtcgcgcgggtggtgcaagcccgagcaggacgccgccgtcgctgccgccgcgcacagcctccaggacctccagcagctgcacctcggcagcgccgccgcccacaacttcttccaggcgtcgtcgagctcgacggtctacaacggcggcggcggcgggtaccagggcctcggtggcaacgccttcttgatgccggcgagcaccgtcgtggccgaccaggggcacagcagcacggccaccaaccatggaaacacctgcagctacggcaacgaggagcaggggaagctcatcgggtacgacgccatggcgatggcgagcggcgccgccggcggcgggtaccagctgtcgcagggctcggcgtcgacggtgagcatcgcgagggcgaacggctactcggccaactggagctcgcctttcaatggcgccatgggatgatcgatgaagaggagcaacaggagctagtatagctaattaggggatcgatcgattaattaagctagatcaagtcaagtttaggttagacgaatcttgatcacggttgtgttgcaactcgtttggtcgttgatcaggttttgcttgactgggtgtgagtgacacacacgcaaggtgctgccttccggaagctgggtaatggcaggtaagggtataagctagtaaagtttgtgttgtaacttctaagttaatatccttgcttgctgttagttttgggtatagtttcagaaggatcatgccaatcctcagaggagatacacactaattaatctcgtgcaatgacaataactccatcataatatcttggcgctcatactttatttagttgtcttaactcttatcattattgctctatatagttcttagatcaattgccatttagacaatcactagtatttatctatatctataaaaattgggcaatactcgtacctcccacgtgttaaaaagaatggtaatttagccatccttagaaatgtaatggaaagtatagaagtacattttctagtataaaactcaatacctccaaatacttggtactttgaggtactaaaatttagtataaaatttagtagcttagttgttttcttaagaattgtaaaaaaaaattaacctggaagatttggttagtaagtgtgtggattaatatataggttgtaactaatgtatataccgctatctaaaataacagtgataatattttttaataatatgtataattaaagtttggataattataatatcaataacaataacatgtgcaatgcacgggctagcttggtttgtaattatagtatatattattgttatcgataaaaatcctgacaatagaaactttgtatacatgtgtcatgtttgtgtgttatcgagggaatgccaatcagacaaggtacgatttttacacaggtttaagccctccttagagtaataatcctacgtcctgtcagtttggggaggttgctttatttatatatggagaacacaagtacaaaaggggtgtatgtgtctatcataagcctatctactaatcccgtagagggttttgatgaatggtggtatgatgtatgtatgaaagttggactccgctggctctcgatggatcatcgcctccacctcacagccttacttccctcctccctccacatcacggtgggccgatgtgggtcaaacaactctctcatagactccgtcgccaccgctgtgtgccccgaaatcgctcagcctctatcatgcatccttgtctgctaggttcctcgagcgccacaatggttgcataggaaggatgggtgttggtggtggtggtcgattcgatgggccacagaggaggggtctgagagctgaacccattcgatgacatggatgtcagcgatgagctcgtcggaatgccgcttgatcgaccacatcatcatgcttgttgacaccgttggcaatggcggaatgatgcgcggatctggaggaagagggaagggagtgacctcgccgccgtccctctcttctccaccgttaccgagttgggcggttttatgcgacctcacggccgtctccgatgtcagctgccctgtttccggtcgttcctgagccacccccaaccccactccacctccttgctgccatggttgcgatggcagccgccaccaccacatcgcatctcctaaccatccccaagtcattcctacccgctgggcgctgttccttgccagaacacttgatgcatcgaactccagaggaatgagggggagagatggagagaaagaggagaggtagggggggaggtgagtagattgtagatgacatgtggggctcacttttatttttgccaaataagcgcttggtcagcacgagtggaccgggtcaacttgccacgttagcgaaaccagccatagatactgtcgaagtacctactttaactcggttttataagttagatgttaagatttctggtattgcaatttagggatgtgtttgaaactcgatctcaaatgagggatcaaaagtgaacttagtaccaaaattcatcgtaattaggatgctgggccctaataggtgaaccgggcccaatgccatctccctactcggttcatagtcaatctccccgtcgcctcgtcttcgactccccgtgtccgagcgagtccgcccgccgcccgagcttatctccatcctacgagcagcggcgccggctccggcgtcggcgtccccctgctccttccgccgcctcctcgctctcgccggtgagcatccacacgtcctgttacccgcatcctctttctcatctctctccgcccattcttcttctcgaattcgcgttcaaccctagctctcttattagatctggatgcttttcccttttgcgttacccttagtaagtactaatagcagacagtttgttccccgtcaaattggggttgaaatgatcatccataccccatctcaggcccgtccctggggaatgcccagctgaattcaatggctcaagttactgcgaccgcgaatgctcgggtgctcggttttcctgccgccagccgccatggtggccctgtaggatcgcgtgctgggccggcgtttctgaatctgcgtgctcccgcacttcgtcatgacagtaaaaagcatcctttgagaggtactgattttcttgcatatgtgtaattttgcattggatgacaatataagctcgttactgcccatacactaacaagtggagaaaaactgaaaattgttatgcatacaggggtgaaatcctggatgatggtctttcaggaaaatgattgttctgagaagttttatttttattgggatacaagtttacaattaccatagttatagtgaacgcacacttgatgtttgtagacttgttactctatcttaaacggtgcatcaattgtgattaagttacttatcagcttcttttttctttttttaaggtgtatgaattcatatttataacatgttatttctttgtttcagttggtgctgcctcttcattattcacaaagtatgatcctatcaaaggcatcaaaccattgctgtcaattgacaagttacgtcctagaactcaagttggctgtcgagcatctttatcatcattcagcttccctgagttggagaccaaacctagatggtggtggaggaccttagcgtgtgtcccctatcttctgccgctgcacaacatgtggtcctttgcagatgctgtgtaccagcttcatccatacttgcagcagtttgggttgttctatgcattcatcgacacaatggcgttagtcccaggatggctctttctgatgatcttcatgaccgtctacttctttgtggtcaggcggaagtggttgccacacttcttgcggtatcacgtcatattggctattctccttgatactggttctcaagctctggcgaccatgtgcaactggaatccaagcattgtttatcagggtaaaccaatggtgtttttctggatgacgattgccttcattcagatatccacagttcttgagtgcatgaggtgtgctctggcaggcatgtatcccagcgttccgtttgtatctcaaacggctttcatccactctgatatgagtatgttcaggtagttggttagtgcaatatgcatctttgaatataagaagcattaagggatttttatacgagagatttgaaaactgctgagacagtaaaatgttgggaattatgagatacaagaggtggggatgcaaggggatgaaatcagaggcaatgcttatttgcagtgttggcacttctaatatttgtggcctggagagttacttgatatattgtttaggttgtgttttgtttgattttgaataggatgaccattttgaagactgtgagttcagttttatagccctggaattttctttttttatttttatccttggaggcgcccttgaaattctcttaaacctcttcaatgttgctgtgttgtgttgttgacatattgacctgttaataacgtggtatgaggtttgatgtctgcaattacttggatgcagtccatagcagcataaggctatgagtacgaggttatgaggtggaatgggcttactggagccggtatacatgaaaaggaccagtgttgctcagccacttctccaccgactccacgtgccataacatgatacattgatactgccaggctaagctggaatagctaatatcaaagtgaagaccaatcgattttatgtacgcagttagtaaacggaacatcacagctgaaaatatctttccatcatatatgcagttactcaatggaatattacaaattaaattatcgtcgcgcttagttcctgccatattctgtttgtctggtatgaatttcagttgtacagaaacatctttaaacttaccagaaaaaaaaagaataaatcagatcgtggtcttctcaatgctcgctaagcaatggagctgtaaaaatagtgaaacaactttgtttcagaccttctggtcaagctctgattgtgatgacttctgagttttctcgctgggcaccgagtaaatctgcctctctttgcctcccggttttgacgaagcattcccgtaccaaatcatgccaatcacagcaagcatcatgccaaggactacgtgaaaattaaggccctcttttccaaagaaaagaaaacccaaggtcaatacaagaatcgtcttcatatggcctagaacttgaaatgagacagctgtgaatcttccaatgcatatgaactggcttagattggtcccaacagcaattgtgcacgacaatacaatgaagaactggaaattaagtgagtgaagaagaaagcattagtcccagtttgctcatgtaaggaatatgtaaaagtcaagggaacatcaggtctgcactgctatgataaaaaaccatacatgtcatgctcattccataaaattttattcatagatagaagaaacagtgtaggcaactaggtatctcttaatctccatgaagtatatataagaagcaaaattgctattgtgcaacaaagaactattcatatacttctgtactatttgaaggagggaccatactgtaaaaacacatttcaagtttcaactgtaatgtgcaaggtagcttactaactactagcagttaggtggttgatccattatagagaggtaatgaacatgcacaaaagggattgaaaagaatcactgccagtactctaatatctaataacacttggataatacaatgttcaaaaaaaatatctttaaagctgctgtaaacttatatcaaaacagaacttaaaatattcctttccagcctaaatcgtaattcatggaccaaatccaggagataaatctggtggttacaggatatggtaaactcttcatggtcatcagtatctaactcaaaacggattcatctacagctatgtacagtttataatgccgaaatagctgcatagagccaaatgggactgtaatgcaacaagttcacaagagaataagcagagaactgattcaaaacaagaatcacataccgtaactattgttgtgtaattgaaagtatcaactcttctattggtcagccagaagtccacaaaaggccccagtattaacagggatgctgcctgagctggagcagtatgacccaataggttgaatgagccaagcgagtacttcttttgaaggtgatgaacgtactgcagcatgaaagaaaaataactggaataaaacaagtgctaattatccaaaacctcaccattaaaagtgaaaacagcagcgagggacaaaatttctgttagcagataaatgagtaagactaaatatttgcaactcttttagatacaagttactattgaacatttcctttgaacatgagtaatcagtacagcagttagaagcaagcaaatatcgacagaaatccagattacagaatgagataaatcagactgaattcacacgaacagtttggaaaatatgtaaatgtaatgtaccatatgcgacgtaatttgaactgaaactgctcattcagaagccaaggtatttaaaaaggagccaaacagagcagttatcactagggcatggaatacgtcaaaatgtgcacaatcaaatactcacatgctgctgtagtgctgtgctccaaactgcaattacagctgctagcagcccttttgaattcacactaacatcagtcacagtacatacagcaactcctactaaaacaagcactatactgagttttgtattccttgagtaacggactttgtcaaacaggatttccagaatgcacaagactggaataatacacaacttggcaatctgaagaggcatgaaacgaaaattagtatgtgccctccattctaacattgaatatagaaggatttaaaattactcttcccacctgatagaatccaacagagttccacatcaaactaacattcatcccaacaattgataagtttgcaaaaaagacgaatttaacgagttctggcaatggtaaataggatggctgaatatgtcccaaccatttcattactaatgtcatcaaggttgtggttgcaaaatgcaatccagtcaatgttgtagctgcacaaacacacaatggaacacatcattagcacaaaaaatctgactggtttgctgcacaacgatagttcggtttag

SEQ ID NO: 10500 - DNA, 20879 bp, Oryza sativa
acatgtcacaccagtacaaatcagaatcaacaattatctgcaacagttcatatccttccaccagatctaccgctttgtataaaaatacaacggcactgacataactaggacagtcgcggtagtctctacccgacgtgaaatcccaacaaccttgccctgcacactcacactcccagttcagaaccgagtggaacaaccccgagcggagagaacaccccaccctctccgaaatccgatgccggagatcagcgcagtacgcggaactcggattccgcggaggcagcggatgcgcggatggaatggaaggaatcctccccatcggcggaggaggggaggagaggagaggagaggagacgggagagagctatggcttcgatacctcctcttctccgcagcgggccgcgtcgggcgatggaatggatgggccccttctcttcctcctcctcctcccgtctcatcttctccgtcctcacgcgccatcacgcgtacgcgcaggggggaaaaagtcgggtcgcgtcgcatcgcgcgtggccgcaagcgcgagtgcgtgcgcaccgagccaccgaggtgttgtggtggtggcctggtgcggtggtgggcagcggcgccgcccatgcggctcggctcgacttgggcttccgccgtgggatgggatcccaaccgaattgggcccccggtgaaactaggtgactagcccaactcaaacccagccatccaggcatccccgaacgctgcatatgctgctgcaggcgcggccacccgccgggcggtctgccgtctcgcttccgcgacgacgtggccttcgccgtcgacggtgttgggtgtaatcccacatcgataattgacgatagagaaacacgacttaaaagataggaatgatgctcatccatcagactagtcttttgggttgtataggcctagaatctaaagttataactccggttggacctgtggtggaacagatctaatgtgactgtgacctaggtgacccatggttgatgggtcaggatgcgcactttaacttgaaaacgtgtcggggaaatcacgatgttgtgatcttgctgtgtctacgcagtggcggagtcagcatggggggaggggagggttctttcgaccccactacccaatccatatatctattgaagggggttaaaaaccactacccaatccatatatctattgaagggggctaaaatagacttttgtctgatttttagaagacccaaaaacccaaaagactgagggcctgttcactttgatgccattttcaaccttaccaaatttttgtaaagttgcaaaaaaaatggctatatttagtttgctgctaaattttgataactatataagaaatcctaccaaaattttggtaactctgcaaaaattttggcaaatgctaaattttggtaaggtttttttttggcaacaaagtgaacaggccctgagaagcctccactataattttatcctgtctccgccactgtgtctaggtaggatttatttcgctggacagctttttttcaacgaagcagagtagtaaatttttctctcaacttttttttttgagggaaatttctctcaacttttggcgactggtccatccaccggacaacagtttgatgaaaagcactgttatttagtggacgatattaattaggcagaagctcaattagggtgcaaaactgacggtgattgatccatgacagacagcctaaccggctaacccccacccttcttgacattgcaaagaccacgcaaccacgtcgagagaaatctgctagaggaatggctgtgcaacacacataacttgtgtgacacaggacaccatctgaaacgagtgtcaccatttccgaaaacaaaagaaaacgcccgcaagattgttgagcctgaagttctgaacacgacaaatcttttcttcttttttttctaaatggagaaatgctacacaattggtgttcctgaatgattgtgattatggaataactaatgactgctatactttatttaatcgctaagcatggaagtatggaacacaacatttatttcggatgtaatgtaagcatagagcataaacatgcgttggtctaattcttcccattacgtacctttcatttgcaaatcaccaccaaatccttatcttagtagggttttgcagtgtcgatttgatcgctcatcagccaatgtcctgtgtgcgaaaaatactacttgctcacagtctactactactactacaccaaggctcaagaaggggtttggtgctgagtttacttcacatgacccaccactgggtgaggtatgtctgcactactgcatattgtgctttcgctccattcccagatgttacatcttagcttcccaccgatgcaatcttccaactgatgataaatgcaggatagctttgccctttttcaagcaggttgtgcatcctacgtcactgtctaattccatacagtatctagtaactagttcatccggtgctcgaactgtactatatggtatagatggttttctggaccaacgtgatgacccttttcattgaaaccgtattctatatgtgcgtacctaatctatagaaaactggtaagaatgtattgtgatgcacatttctgtcatgctaggacgacgatagtgtatgacttgcttcacttccctagcagcgtgataaactgacgtcatgtgatttatggtgcagtgatttggtctaaaacctcaaaagctgacagaatcattttaccgaattgtgttcattagcttaacaccacgcataaggtggcacatcaatccccatatggctaggtagttcagattgctcttctcaggcctaagaataactgcacaagattttctgaaagcaaaattacacgcattgtgacattttacgaacccatatgcaccagtcatactcatcttggttgaaacagtttctgcatcatgagcaaacatattgcagacagaccgaattcagaattcaaatgacaaaacacaactaatgtaaggtttttaaaattagctgcaaacccatgtaatcctgcatcccggtagaatgtcaagagagtgggacatcattcttgagctggaagtggagcaggaagaaaaaccacttccagtgggggcttgtgtgtgtttcggttcggacacagaactcaacagcccaaccgctccagttgagtttgacagaatgctggaaccaccaaacttcccttggttgccttcttcatcttcttcttcctcccctttcccgcgaaagggccactcccgctgcatcctcgacgcctacccagctatcctcatctcctcctccattaaactccagccctcgccccctttttaaatccaccgaccaaacttcctgaaccttgccaacagtacagaggcctcgcttgttcatcttcgtctcggctctgcctgaaccttagcgccatggacggcagtggtgtgcgccggatttaagctttgtttaggctgatgggtcttcatgcttcggttcatcttcgtctcggctctggagttcttgtaaggtatggtaaccatgtttcggttttgcaatgaatatgttcattagctgcttctgttgatgaaatttgctgggttagtcatatgtattctgcacttactagatatgtgcagtataatggcaaggttaattctcttagtatttaggaatcatataatatgatttgctcggtataataagttttcacttggacccaatttcgatataatgatattaatcctgcaatacaatgagctatacacttaatccttagagaccttggggagatactagaaggtaccatttttttttctttttaataaaatttagtacctcctagtcaaatacagcaagaccattctaatccttaatacttggaggcaaaaaaaattatgttcatatttgtggtttgttttcataacgcaaactgataaaattgtatccaaagctcaaatgtctgaggttaaattgatgaactgataagcaattgagatgttgagtttcatctagcaaccaacaaccactaatcatggttgctttagaaattagaataccagagaaagaaaactcctttagaagagcttgacactagagtcatgtcagctttagaaattagaatactagagaaagaaaactcttttaaaactctttttataaattacaaaacccacttagaatgaggcatgtcatctttctaggattagtgtcatctactcatcttggtacaaactgattgtgtatatttgtatgttctgtacttgtgtatggatattgtcgcaacaccctacgtctgcactatgctcaactaataagctactagtgtaaccaaatacattgtagttcactctgagttacaactttttcgaaagaatgctatgtgcataagatgattcagagactaggatacttattccatgatctaaaaaagatactccctccgtttcacaacgtaagtcattctaacatttctcacatttatattgaagttaatgaatctagacatatataacttcaatatgaatgtataaaatgctaaaatgacttacattgtaaaacggatgaagtaattttaatatttaagacttgaatgctccatcatttgcttttcagctcatcaaccgcggccaaaatttaaattaaaaaacttaaattcagagttgttttttatgttttatcgtagttatattggcttttaaatcacgaggaacacgtttaaaaaatttacacataaattattgttttcactaataagtgttacggtttataatcagcagtggacgaaacgatgaaacttgaagtgaagaactgaagatcctgttgagttggtggttggtacatttcaagtgaagaactgaagaatcgtagagggaacaatgtcggagatggaaggagctctgagatcctgcatggagcagctgctcatcgccagggaggagcgggagcagatcatcgtggaggcggccagcgagatctcctcggagaagaagaaagcgcgggagctccagcggaagctcgacgccgcgaccaagaaggccgcgaagctcgccgccgagaacagcagcctcgccaaggccctcgacgccaaggacgcggcgatcggcgagctgagggagtccaagtcggcctccgacggcgagctcgccggcgcgagggcgaggctggacgcggcgcagaagcaggcggcgtcgctgcagtacgaggtgcggatgctgcagaaggagctggagatcaggggccaggagcgggagtacgacctccagtccgtcgacgcgtcgcgccggcagcaggcggagagccagaagaagatcgcgctgctggagggcgagtgccagcggctgcgcgccatggtgcggaagcgcctcccgggccccgccgccatcgccaagatgagggacgaggtggaccagccggcgacacccagaaggtcgcgctccgtggcgccgatgtcgccgcggtccgtggcgccggcggcgccgatgacacccatgtcgacgtcggcgcggccgatgactcccaccatgtcagcgcggccaatgacgcccatgtcggcgcggccgatgacgccgcgccgtgccgccgcggcggagcacgagacgcccgcggcggcggccaagctgcgcgccgtcgaggacgagaacaaggcgctgaagcagacgctggcgaagagggacgccgagctgcagttcgtgcagatgaagtacgccgacgaggcgtgcaagctctccgtgctgcagcggcagctcagcgagctgaccgaggagaacaagcagctgagcgacgcccatggccagacggagtcgtgggcctccgcgctgatctccgagctggagcagttcagggccgcgaagctgcagggagcagcagcatctgagatgagcttgctcgacgatttcgccgagatcgagaggttggagatggcttcaggtggccaaggattgagatcgcccaagaatgcgcattcggaagcgatttcttcagagaagaatgataaagacactgtcctagaaaatggtatctctatctccaatggccagcctgaatgggttcaggatatgtgcaagcttgtgatgcagaagcatgaaaccagtggggaaaacattgacacaattcttgaggagataactcgtgcattggatcagagtgctaataatcagaaaggagatgatttgaatggatcatatgactggagcataatgaaggaaatggtgttcagcctgactgaaaagatcacctctgttattggcatatctgaagaaggcaatgttgcaagttctcaaaaattgctgcttgacaggtctgaattttgtgctcgccttgagcatttggtccatgtctgtcatgatctactgcatggtaaaactgaccttgaaaagtttgtgcatgaggtttgtttggttctagagtatataatcaaccagtacaagaatatatcattccaagaacaaccagacactgtgaataataatacagagaatttggatggagaggaatcatttggtaacatgaatggtggatgtgacataaaaagtccgaaatcatcatctgctccagacatacaaactgaagcactggaagaatcaattcagtcggtagaaggccgaaaaacagatcatattttggttaaccaagaagagagtcaacttgatgaagaactcacaagagttatactagaccaggacgagaaaatcagtcaggagaactcagcatcctgtgagatagaaaggtaactaacactgaacacatttaataataatctgttcatgtgcaattaagttagatgagaatggtgaaaaattgtgttaccctttaaattactgagaaattaagttactgcaattaagttagagtaccaattttactgctactgagaaattgtgtcccatcatgccgtttttttaaatgcagcccccatgatcatccaagtgctgaaaccctggcagagaaagaggaaaagcatttagcatcagtaagtttctctgttgctcctataattttcagtaatcatatgcatatcaatcatataggtatctggtatgcttttttcaccattctcatccatacataatacgttcgtcagaacttaatcacaaaatttgagcttatgcagagttcagagatatcagcagcggctgagaagcttgcagagtgtcaggaaaccatcacaaatctaagcaggcagctgcgagctctcaagagtccggcggtttcaggcaatctagacagcccaatgtccaactccagaccaagctcatctgactacaagccccagtcacttgcatgcattcttgctgaaggggaggactccagcactgaggatgccatttctcctgcaaccaaagaggtgcactccaagaaagagcctgatgctgcatcacggaaaagcgtagcacaagatggtagtgttaatgctgccctcaaagctgtcgaagaggaattaacacaaaccgttgttcatccgatcttcccagagccatcccaagagattatttctgctgatctcaagaagaagagacggagccccagcttgctgggcaggataatgttcagaaagaaagtggaaggcagctaggtcatgctgctgatctggtggatgcactgtgctggtaaaagcttgcaaaatctagtagcgctccaccactatgctgtcactggagatttcgactttgaacgaacgagcttgttctgtttgttgagcattcctgttccttagggtgcaacctttttggacacgtattctgtcacagagactgatgacttgtggtaagagactctgagcacatgatctgtatcggttttccttgacatggacaaattttctttttgtatttatggcctccatggttgtgtaaatgttaatttaataagttaaaaatttgttcttgttcactggaatacgtacatgcaattctttttttctgtctgagcggctccaagtttcaagacctctctatactgtttggaaaaatccatacaccgacatgagattacaggtacagaagtagagattttggaaaaaaaaaatatatcacaaattcacaaataaaaagcattggagatggattgcttctgaattctgatactgcagaggcagatatccattgtgccttttgaaaccacaatagcgatctactgttagttgccccgtagttgtagccatttgaatgcaaaagcatttcaagattcttttaggtagggtgaggtcgccaccagtactcatcccaagaaggattctctcatcacagggatgtgaccttctgactttgcatagtatactactactatatttactttataaacagctgaaaaataccaatcatgctttcctttcaaataaataaaaaatcatgccggtgattgtcgtaatcatttacgaggtgtacagtacatcaccggcccagctgatctcaacagaaagaagcacaattggcgtaggcctcatcatctagaagcaatacgtcaaaacttatcccgagtcagcagcacaaaggatggccatattcagatattctaaaggcggccgtgacaggatagaaggcaacaccatcaagccactggggtttccagacgctgaccgatcccaaaaacaaacaaaagtctgaagcactaatatacttgcgtcaaatacaaaagaacggcatcactgcgtctgcatgctactgacaattttctcaaggctttatattcctcgagtcatttgcgttgcagttgcagacacctggatgcagttctgctccaataattagattatcattcaggttgcagacaggaactcatccaggcccggtgatgcctgggacggcaagagcttgtctttttctttcattttttttgtgttatttttctgctgctgatagactgatgatggcaattgtttgtcacttgtcagtcatgtactctgccttgtaccttttgttgctggatagcgttattcggcaacgtagccatgttatcgtgtcttatcctgtaatacatccgtcccaaaatatagctatttctagcacagtactttgttctaaaataaagctatttttctacctaccttctcctctcaaccaatcacaactattctttttttacctattttctcttttcaaccaatcacacaccttcttcaatcattctcatctactttcttaataccgtgccaacctcaaaaatacttacattttaggacggaggaagtaggctttctttgggttgtaatgcaggccaaatggcaacttgtagaatggtttcagatccttcacgccgcgtttggtttctgaaggggactgagatttcgtctccttcccatttggttatagttatctgtttatcaccacaagtttactgtttgcttgtgttcttggtccaattcagactgctgcagtgctgctttcttgacctgcagctcatccaaattccatgtatacttttcttgccatggttatcctttgtaacactaaactgtttctgcgcctgcgttgaaagttgatctgcgtgtgacgcgttcatgtattgtaccttaaacttcatcacaaacttgtttcactaatttgtcaaagttttgctttttgcaagtttgcaaccgtaggaactgatagtacaaatgatcaaggacagaagaagatgccattctcagccatgcaattttgtacttcaacaactgagtcttttatttttttgaaattgaagctcttccccgatccttttctcatctttattccagattatagttacagaatctacctccaggctccagccctacatctttacaccccaaagaaaaagcaaaaagaatgaaaggggagaaaaaaaaaaagaagaacgaatcagaagctctgttctcaaaaaaaataaataaatcagaagctcactatataagacaaccttttccatccttttaatcttttgacctttttacatgtttacatctaggtaacaacatctagaagatacaaacatccatggaaaactgcagccgcgatgtcctaactcctaagcatattgtcagaatcagccattaactgctgctaattcctgtttgacaagtgagccacctgtccctctcatcattgcttatgtcagtctcgtaatgagatctcgaacaggtcggagtcggcgtccgggtcgccggccgacgcgccgccgccgccgccgttctccttcctgctcttgctcatccgcgacgccgtctccagccagccggagtcgacgcggcccatggagaagaggtcgccgctgtcgtcgaagtcgaggcccagcgaaccgccgctccggccgtcgtcccccgccgacgcggcgcggaggaagcacgggttcgccgtgcgccgcgcgttcgccggcgcgtaccggaacttgccctgcccgaggttgaccagcgccatcacgtcgaagctggaggcgaggaccgggtacatcggggtggagaacgcgtcggcgttgcagctcacggcgtggaccagctgcccgtccaccgtgaagaacaccttccgcttcgccggctcgaagccgcagcccaccaccttgtccacccccgcccacgacgacttctccgactcgtacaccagcttcatccctgccatcaaaatccgcagaattttcagctcaagatttccacggttgcaacgcgagaaagagaattcttgttaccgtcgaggtagaccgcgccgttggagtggaagccgatggacgacgcgtacgttccggccagcgacggccgtggcggcgcggcggacgcggcggtggcgaggccgaacgacatgaccgtgtgccgctgcttgtcgtggtgatcgtcgactttcgtggcggctctggtttcttggaccgcgttcttggcgtccggtgcaaagctgatgagcttggcgcggtcgctctcgctggagccgtccctgccgcggcggctcgccctcgacgccgaccactccggccgccgcgtgttgaggtagatgatggtgatctcgaagtaggcgtcctgcgggaacggcgcgccggcgaggggcgggccgggcagcggcaggctcatcctggcgaggcacagggcgctgctgttccccgccgcatcgtggtcgccgccgcggagcgggctcgggatgctcccggggagccacttcttggtggacgccgagacggccgccgccgccgcggccaccaccgggttgagccgcaccgcctgcatccgctccgacgaccccgcgggcacctcccacgcggtgtccgccatgtcgcggctggtcccggagtcgcaggcggggcagagcccccacagcggcgacgacgacgccgacctcgtccgcggcggcgccacggcgaacacgaactgcgcccacccgttctccgccgcctccgtcaccagccgcgggtggtccgcccactggaacggcccctgctgcgcgccgccggcgccggcgccgccccggtgatgatgcctcacatcgacatgcccatggtggtgatggtgcaactgctggaaccggagccccgcgcggccactcgtggcgttgtacctgatattcagcttccccaacccggggctcaccgccggatcccctcctccaccaccaccagccacactctccggcagctcaggctgcgcgttccgcgacgacgagctccgccgccggtaaacaagaacagccaccgcgaccagcgccgcgaccggcaggaacacggacaagaacagcttcagccacagcgccatactctcctaattaacctcctcgcacctctcactctcacaccactctactcgatcaaatcatcctgcgccaccggagctgagtcggcgaggtggggcgaggtcatggacatggtggtcgtgcctggactgattcgtgtgacctgttgagttgtcgtgggggtttggtttggtgagtggtctaggaaggcaggcgcggcaagggaggaggctgactggctcaacggaagcaggcgaggaggaggaggaacgggagggcggttggagatggaaaggtttttaagccgcgggaaagcggggtgcatttttggggtgatttctctgtgggtgggtagcccgtagccgacgggaggagggctaatctgcaacgggtacatgggcacgtcatagggttgttaggttagtgacgtgatgtgagaacgccttatgttaataacacaggcgaaagtgttccgcaccaaatctctgtttcctgagtatgaacacttttcgggctccaaatggagaaatgtttttgcgttccattggctttatagcactcaataattaattaaacatttgttagcatacagttgtgagactaaacatttatcaataagcgtagcatatatatatccacgattctatgatagagacgccaattgtagtaaaccagtaaatttagtacatatttgtatttttaattttaatatagtcgtctttgtcattgtgttgttcttaaaccatcgactcgttcaactagatatattggctaaataataacaccttcacacttttacgcccccacattttttgttgttagtatattacttctgtgaaaaaaaaatgaaatgcattgaaattttgtttcggcatataaaagttaatgatcagtataaccttgaatacgacgattataatctttttagactaacgagattgattgataggacaagcctaagtgttttaagacaatggataaattggtcattgctttaatagaaactacaactacttattacaagctaaacataagagccttactgaatgaatgattgaatgaatgcaaaaatttaattttgaacggaacattttgttgtggataagctagtagtgtgtccttctctcacttagtgaatgtggctcacaactttgatataaaatgcattcccagaattatgtatgaatatatgatacatttttttagaactaatatatgatacttggagtagtctagtagatgcagcactgctctcaacgaaatgtcactatgtggtatttgtgacaataagttgtagttggttagttactatcactttcccaatcactatgataaactacatgacgttaccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaacattacttgttttgttgcgacttttaccattaaaggtgctctaaacatgtcttatgttttatactaaatttttaataaacgaacgatggaaacatgaataaaagtaaataatgtcatatatttaaaaatagatgtaatattattttgctgatttcaccaatgtgaaaaaaaaactgtccctaagaatcggtcaagttatgtaatttgtgtaacctcccccctccctacaaaagaaactgatggatgttggcagtacttcttttcagctgaaaatttttcaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagcaatcaacagcacgtgatttggaaggggctcacacgtggggaagcatcgatctgggacggtgtcatcaggcgagagtcatatcctgttcggtctgtgcaggaacgagttgaatttggtgcttagtatctgtcttaatcatggagctatgcatcttttgtcagctcaacttgggtgcttatttttagtcccatcatgaaagtgtattactactagtttcttgttatggacagcttgtcctacttttaaatccatctcggctcaaacagagaatattggctttggacataaccttgatttgggccttgcaaagggaatgcatttcgattggaccaatataactcagtgaagcaattgactaggacggtacaggcccaaagacgaggtggaaacagtacaaaaggcatcaaaatgcctgtgtccacttgcttggagactggagagtgctttaacctgagaattcttttttgtgtgtggagaaaaacctgatattatgtaaatggatattacctagggtaagcctctcatttgcatattcattcagattcaaagccaacaaactagaaagatagaatagaatgatagaactccagctcctcgttgggttcacgactctacccacccgctagagaactctagttcaagtcctggtgtcgataattatgaccgtgtgcatctgtgattagtgtagatgctggaatgtatagaaaaaaatcttattaaattcaactagcattgtggcctgcgcagattgcgcgactaacatcattatattttctctcatataatagcatatatgttttctcattatattatttaaatatattaaaatgacaacataattttaaattttaatatgtaatgttcctattgtattttatatacgtgttagttatgaattatttttaatatcaaattttagttatttgtaaattatatatattcctatatagactctagactcatcttttaatatatctttttaattttgaatttttattatttctaattgaatttctatgtggactctaaacttatctttcaatattctttaatttttaatttcaaattttaattacttctaaattgtattcctatactgactttaaactcttcttccgatgtttttcttaattttgaattttagttatttataaattgtatttttatacgaatcaaaacactacttttaattttattatgtttattccgaatttttgttagatttaaattcctatatggactctatactctacttctaatattccttattttttaattccgaatttctattttttttcttaattgtatttctatataaatctatactctacttctaatattctttatttttaattccgaatttctattttttttcttaattgtatttctatatggactttatactctacttctaatattccttatttttaattccaaatttcagttatttcctaattgtatttctatatggactctagtttcctctctaatattccttattttttaattccaaattttaacgatttctaaattgtatttctatatagactctagtctcctcttctaatattccttatcttttaattccgaatttcaactgtttctaaattgtatttctatatagattagtcgattagtcgagctgttttaataatataatagatagatagatatatagataggcattgctgcattcttcactccttgatctaggaagtagcttagaaacaaaagagaacaaaaaccttgaagagaattttctgaaaacatcaagggcgtactggccccagcccaggttgcttcggcccagccctggacatggtggctccttatcggcttctttcttgggccatgtatatggcgtcagaactcagaagtcgattccgcaacaggaagaactcatccctctggttcctcttcccgcacacaaatttcccgtcgcccgggtgcaaaatcccatagctggcggggcaaaattcacacttcgtcttgtagccgtgcggtttactcttatctgttgatagagtaggaaaacagaagtcataaattaggatccttgttatgagagtaaaatcattagcagctgacatcagagagtcggcatagcagagagtgacataaattaggcaccaaaccaacacacgataaatgcagtttatgaaattcaataaatccgtaacatgagccgtgacttaccgatgatggtgcaggtcacaacggtcgcagagtcgtagtcgtcgtagcgtagctcggcgaagaactgcttgtcgggtgactcgggaggagccctgttgcgcttgttgcgggagcgtcgcttgcggcctcttttcacgtcggattcgtcatcatcggcagcagcagctgctgcttcatcggctggcttcaccgggctgctcctcctgcgagccaggaagctgacatgaacccagagcgcgcgtctgaagctgacggacgcataacccagagccttgacaggtcgaactcggcgccctggaaaaatgttgctactatgtcagtaacatggtttcgtttaagtacattgctaatcatcggttttgcatccatacatattcagttgttactgcagttatgtacgtagtgaggtgcttacaggattgttagcgttgtagtgatggagagcgcggttgacatggtcgacgatcaaggagagttcagcttgcctgcaattgcaagtgcggaattattgttaccgctacatatactcctcatcttaagaaaatgaagaaatatgcttccttccaaaaaaaaccctatcactgctcgatgcacttatattgttaaattcaaaaacaaaacgcaattcgaaaaagtatccaacaagaaattagtccagcaacgagagtaattctaaattttacgcaacctttcgtgttggttgtaaggacatttttttttcgttctcgtctgtgttcttttattggcctagggtggtcggtcacgcttagcagcggccgatccagtgctagccttctcccagatatgtgtgtttgcgctgtcgatatgtggatggtggtatatatttttttctttttcctggttatgaccttccagtattgtaatcttgtattttttttctgctctatcaatagaacttcgcaccgtctcgtgcgagttgttaaaagaaaaaaattacgcaaccttagatattatggtctaattaagttgtacaaaatcacaaaggttttggcatgtatcacataaccctgggttggtattatgggctataaagtttcacgaaactaaactatttatcattttaactttgatcggagaaacacctaggggtttttcggctagctccacaaggtggtgggctaaacgacctgggttcgaagctttaccccttctaattatttgatattaggccctttcctaatatttattttaactttgatctactacacgtttgaggtctacaatcaacaatcacatatcaaatttatgagtttttttatctgttgtatataaatgttacatccatataagtaaagcttcttaaaattgtgatataaaagtatgtcaaatttgttaatgatgtggttgtgtcaaaatttatatagttttgtgagactacaatagattgggttttataaaaactattctctctctctctctctctctcttaaaaaaagttcttttctatgaccattatgctgtggcacacaacaatatatcgtgagaggatttttttttaatggaatcgtgagaggaattgcaagttcaattttccaaacggccccggcccgagccaaaccgcttgagatctaaacaatcaatcaacatagggaaaacttgcagatcgatcgtgacgagctagctgtagacgatgatcaatggaggcgcaaacatggcatgagaattgagatcgaagacgtaccgccgttcagggcatgggaccccgcctcccctgcagcgacgaatgtcgcagccgcagcggcgcagccgttccaccgcctcgtcgatcaaacgctgccgccgtactagctccccgcgcgacaggttgaatagaaagggcagcctcgtcgtcgtcgtcggcggcggcggcggatcagcgtcctcctctctcgcttgttgggatcccatgtcgctgtgatccagccaagatctaatgttttacaagaaattctcaaaaaaaaaaaaagagaaaagctttacaagggaggctaaagtaaattcggcccatttaagtgttcaggcccatttaagacttttaggtgctgacgtgggctgcgcgtcgtgacccaatggaacgggctggcttgcaactccgtctcctcgcgcttcctcccgacggcgtcccgtcctggatgccccgaggtggccgttcgccattgacaggagtacgaggagctacgtgcatgggggtgagtatgtcgatcgttgtttccgaggagattggatatcgtcggagtaagtactccttccaatcttcttctttttctctctttttttcttcccgaaagaaacatgctttggatctctagttactttcttgatttcatcggatcaaatttggattctgttgaataaacacaaggcgaataggtttctctaaacgatcgatcgatgcacgaagcttcagattcagagtgggcgggcaatccggtcaataggttggtacaggttcagacttcagatttcttaccagcgaacagtgggctggttggaggcttgcagcaagctcaatcagccggtgagtccgtgactccgtgttggtgacttggacgaaagaagatgttcgacctcaagcatgccgctgtcgatagccgacatggcacggggagctcgctccacagccgcaggcgagaagataagaagcccaatttgcatggatgattaaggtaataaatagcgtttatagcgcccgtaatagcggccactatatagctgtagcggacctctaccgctacagggtagtggactgcaaatagcgtattggaacttaacggccgttatagcgcttcgcggccgctatagcggcccactattgactttattagatcgctattaaacgtgtagtctaaattttaaactttaactaaaacttgatgttaatattgatatacagttatttttcttaattttgctcttggaacttagcatccgcaatagcacctactatccgcaattcgctattcaaacactaatccactaccaacccgctatacgctatttattatcttgtggatgatgcatccttgagctttcccttcccgaattccagttccagctactgagcaagataagtcagcatgtcatttatcaagacggcaacagggagaagaggacgtatattgtactggacttccggggacgtacgacgaatgttaagatgcctcaacatctcgtcctttgtcctgtatgactggatttgtatgtcagctatcagcataagcggtcaatccacggcacggcgatttgagaaacgaagcacgcggatgtaatgcaatgttattttcgaagtgtttttaaacccttggccatggggcctggcacaaccacacacgagaaaagactcgtatatactctattttaggaggcaaatctccgggggggaagaaaatctgccatctagcttgatcgctccaagaaaggtaattagtttttttaacctttacttacggtgcttaaaaaaagttttctaaacataatttcttatacatctattatgagctatggaatgattacaattatgaaacatgtcaggattaatttttcgttgttccgatgtgccttgcacgggcaccattctatgcctgattttcaaacatatgactttttttattgtttgatttgcatttttaaaatattgttgtagcgttaggacatgcatattactagtatatatatattggagaaacaacttttactgtgatatttatggatattataatcaatctaaattttccatattttctcatacaatgaaataggccaatttatcctatcaccttaatcagtagcccaagagtataaatgtctactcaatagatcaatggattaggtcgttgccgttggtagaagaacaaccttgcacagactatttatgttcatgagaatgtttttggcttatccttttcaggtcataaaagagataccaagcccttacataacaaaacataccatggttgttccatcggcattgctgctgccgctgccgctgctattgctgtgttacggatttggaaacatccattgctcaccagttcataggagcagcatcgatctccactcgctgctcgacttcaagcagggcatctctagtgatccaaatgaagccttgaagtcctggaacaccagcacccactactgtaagtggacgggcgtcatgtgcacccaaacgcgaccatggcgcgtctcagggcttaacctcactggtctaagcttgggtggccaaattagctcctctctcggaaacctgaccttccttaattatctggacctctcctataataatttctttggcccgttgcctcttcttaaccggctccaacaactgaaaaaccttatcctaggaagcaacagtttgcacggggctattccagtctcacttacaaattcttccagcttgtcatacctggacctctccacaaaccttctagttggtgcgattcctgcgaacataagcttactttcgaacctagagtatttggatcttgatcagaacaatctcaccgggaccgtcctgcaaaccataggagacattacgtcattagaaatactttatctttttcaaaatcaactaagtggaagcattcccgataagatttggcaattgccgaatcttatgcaattggtgctcggtgaaaataatttgtcaggtggaataccacaaaccctccataatatatcttctctacaaagattaggtttggagtacaatatgctaagcaaagcattgccacctaacattggtgatgccctctccaatctcgaagtacttgggtaacaatatgtttgaaggtcaaattccagcttctttaggtaatgcttcagggctacaa

SEQ ID NO: 10501 - DNA, 4791 bp, Oryza sativa
acgaatcaagatccaataaatcagacctaaccgggatagtacgagattaatgacaagtttaatagatctaaataagctgatagactctgtataaagtgattgatatattgaatctaaccaagatagcaaagcaatccagaaacgagccaatatatcagataagaaacgcaattaagaacttaattagaatattggacttaaccgagaaagtactaattacattgatacaagcgaagttgacggaacttatttctcaccggagatcgaaactgatgcaacacagctcgaaactaagaactcgtagaaaactaaattatggtggtgatgcgccgaaagttatatatttatctggtcatagttaccaagactctgggcatacatacttataccctcgggctaaaacgagtctgctcgaacatgattcgactggcttaggattctatctccttaataaaaggaaaattaatacatgtcttacctatagaaataaatctaaaaaaaaatctaactaaccaaacctatcctagattttccaaccgtaccaagccaaatttatagtgtcaacttctccttttgacttgccttgactaacgacaattgtcaaattttgccgttaacagtttcttacaatgatctagctcgagctacatcaggcttcttcgagtaaaacctaataggaagagaaatctatggttcatagttactgacttagttctaagcacgacttagtagatcaaacttaactgatgcatcactaagtatgaaaagaaacataatatctagacaatcaagcctttgattgattttcagggtggtggataccttagttaatctaatctagcaagataatttaaccgataccagtataaaccctaaaatgaatctcagccgatatgatcaaattaagatgctaatctagattaactaagatatatgataaataggtaggtaaatatatcaaccgatccagagtgatccaagagggcgaagtgatgtaaccttgaacaacatcaatgtagctgatacaatctctagggccggcgaaatgtaggacttgccccttcaccggagatcgaactgaaccgatgcagccttgcatcaggtgacaagtttcgccggttgataagtaaaaaccttgaaaaagagggtggcgatgcgccgagagtagttgtattgatctgtgagatagtttacaatgactccatgtgtacatatttatatccatgggtagatactagtccttattggataataaagaaacttttctaagataaaaaggaaaacataaagtccttatcggacactaaacacactctcctaaagataacaagaaactaatggactcttcctaattaatagataaactctgcatcctccttttgaactcggtctcttatggataaatttcctttaattcaattaatttccttaaccgaacccatcaagaatcagactactggcgactgttagtgcccatcggccgatttgtcacaccccaatccggcaccgccatacaacggcacctgacaagagcgtgtcgtaggaaaaacggcgcgaaccgcttcatacgaaaccacgatcttagtaccagtcccaggacatagcgctggtacccacggtgacaaatatgaatcattgcaatccttaaaataaatagaggacttatttaccttaacttaggttgcagctcagaacagcccgagaatgcaacagatgacccggacaaggaaataccaacaacagcagcagcagcaacggaaccaacggactaacacccaacaccacagacgatagctaggaaccaggacgaaaccctattcttcacttcacttcatcttcagcttcagggcggaggaactatatatatatatttatatagagcaagggtgagtactttcgtactcagcaagccatgggaattaagtgtttaatgcaggcttcaaaggaaaggctgttgtttttgcaattgattttagttaaactcctttttgaaacaactaagtgagtgcttctcaaacgacacagatgagacagtgcgtctcgttcggtcggagtatgtgcaatgtatcagtctttgaatagattcaaggttggcacccggccaacaactttcaaacggccacccgggcctagctgatcccatcagccacagagattttcccaaacatcgaacccattccacaacagcaatttcacaaagtagtaatcaaacaaaactacactaggaatcacctcacgtccgcccatgaccgtgggcacggctgttcgaacaatttaataacctctgcagagggtgtacactttacccacacgacgttactagccttggtcacctaacccgtgcggatcaaacacgtctggtgacttggggctttcacgacaaggcatttcgaaagccgacacaggttcaccatatgccaacgagaggggtcccagaccgacaacaggttaggtcccagaccatactgtgccaggaagcccgagggttctccccggcaccaccccgttgaatccacatgtctcttggcatcatggttctcccgattagcaaattactcagctaggggtgtcccattccacccatgtggtcgcacttgagacttatgttcggatgaaattccaagggaaccggtccttaagtgcaagagcgggaaaccgtactcccggtaggtcccccggtctgtggtattggaaattcatttagtttgcaaacaccaaccctggtgtcgggttttccaagtttttttgtaaaaccccaagttttacccatcattggatattttaaaattgaggggaggtgttccgatgcgcatgcccgaaggcccgtgcatcaaagcacaacagttgacaaaggaggtttaagtgttcaataattcaaggagggtaattgcagcaattaggattggggccggtaggctatctcgcaagccgcggccgaaatactcgtgttaatcctattcatgcaatatttgcggaaaagaaatacttagatttaaattataggtgcaagatgatcaaaggtcacttgccttgctcaaggccttcattgagcttcacgaatcttcaagaaaacccgcgatcgacgaaaatccggtaatcgcaactatacgcaaacaatcgaaaacctaaaaaaaaaaccaaaagaaagatcctatttagactggttaatagtgccattaaatagatctcaattttatggaattactagaagcggaacggagtcaatcggatgagcagctgagaagatattgaattttggaagtttaattggaatttctgggcgaaggaagatatttgtggaacaaggggaaattgatttatgaaatttatagaaataatattctcaagaatattattgaccgtcactgacgtgcgggaccaaaggaaatgatttataaggaaatgattcatggaattttggaataaggaattgatttatggaacaagggaaaaaggatttattgcatttactggattaaggaaatgatttattgaattcatggaaaagaatattcccaagaatattctttaattactcattgacacgtgggaccaacagggggaaagatggacttttgtgtaggggagctgatttgatggagggaagaaatatggactttagctcatgagggatgggcactgggcttagagggagggactgaaagtggactttagaggtcggaccgagggagagggggcacggcccgggtgtggaaggaatggcccacggccgggcgggcgaggccgagccgggccaggcatgcgcgcgggcgggcgctgaccggtcaccgcttgacccggtcaagcgggaccggcgggctgaggtggcatccacatggatgccacggtggcaaggcgagaggggaggaggaggcgcgcccggagatcggacggcacacggcagccgatgggttccggcgagcagcggcgagccggagggggatgcgggcaccggtagatataggaggagatggggaactcattccacggctcggatcgaagagaggaggcgcgacggcgatcggtggcggcggcgaagctcgtcggatcggggatgtggtcgcgcgagggaagggacaagggggcgcgaactcgggcctagccgaaccggtacgcgactgcgatgcgcacgcggtgacgcgggacccgatggtcaccggcgacgcgggacccgatggtcaccggcgacgcacgcgcggcggcgttatgcggcggcggaagcggcgacacagcgcggagacaaaggagaaggccggcggccttggggcagccagggggaggtcaaggggatccccgggagcatggcggcgagaggaatcggcgcgagaggagccgacaactgtggattgcggcggcggcaatcaccggcgagcaaaaggggaaacacgaggagacgacgagggttcgattcaaggggggtgggagcatctccggggttcaaggaatccgtttccggtgtcagatggggcagagcggcgccgtggtggcgcggcgacgggaggcggcctcagggagcggtcggcaatggcggcgaggccatgccgggcggcggcggggattggggtggcatccatgcgtgttcgggaggctagccaagctaccacgcgagctagagagggagagggcgagcgagaagggagaacggagggtggcactaccgagccgggacgggcgcagtgacgagcggccgacggcgcgggagcgagctctccggcctcgggctgaggaaggggaagaaggagggtgcccggagtcccgcgtccgcgcgcacacactggctcccccggagct

SEQ ID NO: 10502 - DNA, 2489 bp, Oryza sativa
agggggctcggcattgggttttataggtggcgaggatggagcttcgaggggaaggaaggagggctcacgggcgtggtcaaagggcgtgggcgacgagctggctcggcgtcagctgctcctctgccatggcgctggaaacgagcgaggagagctggcgtcggcccgagaggggaaaggggaaaacggagggggagaaagggggctcgcgccttgccgatttcgggagagagagggatgggagcgagaggcgctgcctctcggttttggacggacgctggtggagcggcttgggcacgcgctgcagagctcgcggcaggcagcggggccgagcggcagcgcggcgcaggcgctgacgacggtggcgaccgggcggtcggccacgaccggcgcatgcgcgggaaccaaaggcggtggggggttcaaatggcggcggcgggaatcggcgccagggagagaggaagcagagagagcaagagagagagagagggtggcgctctctctcggctcgggcacgacgcacgtgcggaggggaggggaaacgggctgagaggagggatgggccgagggagaggaatttggcccacaaaacagagggatgcaaatagacttttgcagaggaattgaattggagagaattggagtttggaaatggaatttggatatctttggagtcgggcgaatatttagcaaggttttgagatttggaatttgaatttcgaatttgattacttggactcagggaaacagggaggggtcaaggaatggattcaaggtggactcggatatttgtggaatcgagacaaatattttggcgatgattcaaaggaggctattgacctttggaaaaattgaatcggaattggaatcttgaggtggaggattttgatggcgatgaaagggaacaacaatggagatttgaattgagatcttggcacaacttagactctcacacaaagaacgaaattttcacatataggattttgccgaattagtttttaacgcctcgcgaaaagcggagcgttacacgattctaggactctgaagccgatactgagtctaggctgatgataactcgaggcttaccaaattttggcgttaacacgcggccgaacgaactgggttggtgcttggtggggctagcttgggttcattaggtgagacgtcgttgccgaagcaacaagcaagcgcaatggtaggggtcggcattgactcggccgcgacgaagcacccattcttgatgaacccacacagcagcagcaatgtcgacgttgccgccgtgtagttagctatccaccagcacggcagcaccacgaagcatttcatgcattcgacggtgccaatgcagcgttcagcaacttgagtggaggaaggctaggggctctgcctctcgcgcttgccgttgctgcagcagctggaaatggtgaagcaggcggaggagctacgggtccgatacgacgtgctctacttcaactagcaacagcagcagacatcggtggcagtgtcggtgcagcagctctcaatagcattgcacatccaggagatcgtcggtcggttgatcgcggggaggagctcttcggtcgcgggctcgcggagtcggaactcccactggccgccaccacctggcatgcgaggagtgagaataggaaaagagggatgtgagcaaaaagaaaaagaaaagatattagtactgacatgtgggtcccatgagtgtcacataggataaaaccgatatccaaaatcccaagggactcgattagctccgattttcgaagatggaggccttatatcaagtattgtgaaccgttgagggacgtgaatctatcaggggcaagaattgaggaaggtaaaatagacttgttccttttgtttgggacataggtcattgttaacaatggaatttggcatcatatttggagaaggaaaaggaagatcgaagcggatttggtgttgaatcgaactgagcttggagttggattgcgcatcggctggatatcgtatcggctgaaaatagggtatagagttgatcgaggttgaagaagccgatggtcgatacaagccgatatgacatgacttgggctcgatatgggtctagattgggataaccgtctgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaatataaatagaggacttatttaccttaacttaggttgcagctcagacagcccgagaatacaaccgacgacacggacgaggaaacaccaacaacagcagcagcagcggaaccaacggactaacacccaacaccacaggcgacggctgggaaccaggacgaaaccctaatcttcacttcactttatcttctcttcagggcggaggaactatatatatatttat

SEQ ID NO: 10503 - DNA, 8104 bp, Oryza sativa
tttgaaaatgtatttggcgaggattcaaaggaagggattgactttcgaatttagatttcggagacttgaattgggagaggagatttgaggcggaggattttgatttcgatgagagggaacaacgggatttgaattgagatccttggcacaacttagactctcacacaaagaacgaaaattttcgcaattaggattttgccgaattagtttttaacgcctcacgaaaagcggagcgttacagatccaccccccttacaagaatctcgaccccgagattcgaaggtggaccacacacacgaaaccaaaaagggatcttcagacttcttcacagcttcagactctgctagtcgttcttcaactttttgttgcgtgcttgccgcaaaacggtctggtattctgactcacttagcattcttcatcttactgtggctctgctcttgcctgtggaacctgttcttctcctgctccttcaacttgctcgagattcacaacttttccatttgtttctacttgcacatggttcagatgactttgtccaataggcggtgacgtcagtgagatagatccactgttcggtgccttcaaactttttggtctagatacgttgggaaggcctgtcgttggttgaactcgctttgacttgactttctgagggcaataccacgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaaccatttgaatgctgagatgctttctgatagtattgtgctggcgagtttgtttttcgacacaaatcttcttttgcttgaatctctagggacattactttgcgtctcttgtattcttgcatctctttttctgcatcttctagtaacaaggacttatcgaccatttgctgaaacgtcggaaagtcgtgagccaaaagtttcactcgcagtttcgcgtccattccttttaaaaattttctgatcttctttttatcagtgtctacatcttctggggcatatcgggccaatctattgaagcgactcaaatactcgttgatgcaagaggatccttgcttgatatttgcaaattcttccttcttcaaatcaattatgctttcagggatgtgtgctgagcgaaaggctcctgcaaactctgtccagacgatggtactagcatctgtatgggtagcacagtagttatcccaccaatctgcggcaggtcctcttaactgatgtgcggcgtaaagggttttctcttgcggagtacactgtaccagatttaatttcctttccatatctttaatccaatcatcagcttcaataggctcatttgtttgggagaactccggtggacgagaccccaagaaatcattcagttttgatttgccatcatcttgaaccatatggggttgacgctcttgtgtgtgttgttgttgcatagcaattatattctgaaccattccttgtattatatgcgtttgcatggccaggatttggtgaaggtccacgggtgggggttgattacctcttgcgacatcattaactgatccggaagcaaccgtatgatcactctcggcttcttgctcatctgtccggttaactggttgatcggggatttctgactgaactagctcttcctcaaaaccaaagcggttaggggcacggatctgacgggtggagcgacgtgccatctgcttctgagggactgagatctgactaacgcagaaatgagataagaaaaggaggaaaacaaaaacactacatcaaaacggttttcgaaatcacagaagacataggtggtgtgttccagccggtaacccaactggtctaacacctgaacacggactaccaaacaaaactcacacacgcacttagttcaccacaactcctaccgagcgggtgacggcactaaggttagcctaccaacaagggcttaactaagactcctagaggcttgagcacacctttctttaactgggcgtgaagacaggtttaccctaagataaaagtcaaaacgaacgactagctcctacttttggacaccaaagatctttcgcaaaactagagcaaaaggggacaacgacaccttagctttcacaaatagtttttgtattcaaataatgccatcctattcaggggtttcgatcctagggccaactaatgctctgataccatctcttgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaatataaatagaggacttatttaccttaacttaggttgcagctcagacagcccgagaatacaaccgacgacacggacgaggaaacaccaacaacagcagcagcagcggaaccaacggactaacacccaacaccacaggcgacggctgggaaccaggacgaaaccctaatcttcacttcactttatcttctcttcagggcggaggaactatatatatatttatagagcaagggtgagtactttcgtactcagcaagtcacgggaacttaggtgtttaatgcaagcttggaagagaggcaaggttgttttgcaaatcttttgtttgaaatcattttgaaatcactaagtgatttatttctttctaagtttgggccgaaaagagacttgcgtctcgattcgactttaagagatgcttttcaacaactcaattggtaatgtaccgacctcccgggtcagatcattacttctcggctcccagagccattccacttgattaatcggctcccagagctttttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaataaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataggccattttaggcgtgcacaaatcaaactccaaccacctttgatcggtaagtgagcaagcttctcgtccttgccttacccggaacccggtttgtccgaccccgccccggcgttcccaactattggcatgcgaggtttccctgaaccgactagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacggataccgaagtaccacaagggtggagcgacaaggattcagggtagtacgacctacagaaattagtgcgactactgggtaggtccgtcggtttggcacgcaaaccgaggccaagcaagttaagtgtgtgaatctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattattggaagtggaacggagtcaatcggaagagcggttgggaagatatgaattttggaagtttaatttggattttctggtcaaggaaaaggatttattaaatcctttggaaaaaggaaatggacgagggatgtgaatcagacttttctcgggtggcattggcgcggcccgagggacttgcgcagctcgggcgagcctaatgggccggcacggcctgcgaggagggcggcccaatggggcgcgggggagagagggacggcccggtggaccgattccaccgcgcggggtcccgggtggggcccgcttgtcggcggcaaggttcacggtggggagagcgcacgcgggtacggtgctagggtttggtgggtgcggtgtgcgggcggtgcgccgggtggatcggatggcagcgggcccacatgcagccggttggcgcaccgtggaccgtgcgcgcgaaggtggggaagggaagaggcggctgacccggtcgcagccgacgtggctccgacgtggctgccacgcgggccaacgggaggaggaagaaggggaggccgggaatgaacggcggacggcggccgagttcaccggagcaaggcacggcctcagtggaaaaagggagcacaccggggaggagggaagggacgagacgaagcgagccgacggctcggattcgccggaggatggccggaatccggcggattgtggcggcggcaatcgccggcgagcaaagagggaaatcacgacgagacgatgagggttcgattcaaagggggtggagcatctccggggttcaaggaatccgtttccggtgtcggatggggcggaaaatcactgaggagggctggcgacgagcagcggccttcgggagcggacggcaatggcggcgaggctgtgccgggcggcgacggcgctagggaatggtttggggagaccctagggagctcaaggacggtggtggtgcgaggtattggcgagagggcccacggcggctcgcgggcgggcgcggcggcggcgaagcagagcaacggcggggcggcatgtttaaggggacgagcgagcaaccgaatggctcggggcttatccaagatgatgcagatggcgagaatttgggcgaggagctcaccggcgtgcgggaacggtatcggcggcgatttggggatggaaaggggtggaaggccgatggcggcacgcgaccgagcggcggcgcacggcggatgacgccgaggcggcgcggcgtcgaggcgagtgcgccgggggagaagagagggagaggtggcgcccggagctcctcgtcacgcgttcacgctcgcaccggctccctcggtgctcggcgacagacggcgacggcaaggacagcgggaaggcaacaatggcgcggtgaaggcgagggaaaaacgagagggatatggggaggaggctcgggctttataggcgcggggaatgtcggtttggggagggaggaaaccgacctcgtgggcggtcaaggatgcaagggcggcgagctggcggtcgttgacgcgtgcagccaaggcggcggcaggtgatgacgccggcggtgtcgggcaaaaggaaaaagaagggggaaaggggcttgttcccttgccaaaacgagaaaaaggaggagggtgagtgaggaggaggaggagagggagagcagctgcttctcccactcttggacgggtgcggcgtggagtggcgggggccatggatgacgttgacgatgacggcggcggtcggtttggcatggagcgggggcaaggcggcagcgcgtggcgtcggcggcgcaagggctgatggcggcggcgaccggccggtcggccacctcgcgagcgcgcgcgggaatgggcgaaggcggtggaggttttgggcggcgacggcgggaagcggtgtcggcgcgagagagagaaagagagagagagagagagaaacagcgagagcgagagagacagagagagcgagcgacggctctctctctctcggctcacatgcgtgcaacgcacgtgcgaggggggggggaagatgatgggctgggaggggagatgggccgggggaggagaatcggcccatccaaaatcacagggaggtaaggtagacttttacagagaaaactgatttggatagaattggagagatttagggtttggattcgagttcaaatttgatactcgaactcgagggtttagggatgtatcaaggggaattcaaggagaagtcatgggaaagattcaaaaggaaaacttgggtatttgttctcgggaacatagggtggagtcaaggaaaggaaacaaaacgggggtttggacattttgggatttggaaatgtatttggcgaggattcaaaggaagggattgactttcgaatttagatttcggagacttgaattgggagaggagatttgaggcggaggattttgatttcgatgagagggaacaacgggatttgaattgagatccttggcacaacttagactctcacacaaagaacgaaaattttcgcaattaggattttgccgaattagtttttaacgcctcacgaaaagcggagcgttacaccgtcattgccaaatagagatagagctcgattaaggcaactgtatctaataattagggtattgagtcggtttgttagagatttggtaagagatcgccgtatatggtcttgtttgtttcttaactttagaaatgtttgagtcgtgtccataatggactaagtttgtactcgaggtataaatatgagccccatagcattgtaatacggaagccaatccaatacaactttggcgcatcgccactgttttacttttctcgttttccagcgagttcttcgcaagaggtaactcgtctcaatggcccgcgctgacgtgttaggctcgacatcgcgagtcattgctgtcatatgtctttaatctattcttagcttctcaatttagctctatcggctgttgctcacttcagggtttgtgttggttttagttaaattgtcttgctagattagattagctaaggcacctaccatcctgaaaagtgtctaatttcttgattgtctacactgtatgtttcttttcatactttaagatgcatcatcccttgcatgcttagaaccatgcaaactagcctacaattaggcataataaggatagtatcgggtttcagccgatcttacctaatatgcatgtttcacccccctgtttcatgtatattcgccacttatatagatagatcgttttatataagcatatcaagttttagtcagtatcggctagattcctacaccttcatgcttgatttatatttgatatgtttatatggaccaatctgtttatataagtttgtactagagtattagctagtacgttatttttcttggtctaaatattgtcacatcggctactttcataatactgtcttaaatcaatctattgaattccatagattgtattacagtcgattgggcgtgtttagggtttattattatttcatatatccagattatagccgatttggtctaattctatcggctgagaccatcaacgatatgctatcatcctatcggccgatcaactatcggtcgattgattatgcttttattcttttttgctgattgcaggattaaatcagctggcacacccttgacacactcgaggctagcattggacctgcactggagttaagcagatctcccatgccaccgtattttcacatcaaaagtcgtttactagtccatttcaccatccctgggccacatcctattttgcccgttcgtgctatgtagtgcagtcattgagttgtaatctgcgataggcagcctattttcaccagtagatatggggaatgttacatgatagtatcccattcggatgggatgatacctagctaggtataaggcgatacctcgaaagtatcatcttctccgaacgagttatcagtcgatacctactaggtatcagacgatctct

SEQ ID NO: 10504 - DNA, 8827 bp, Oryza sativa
  unsure (1)..(8827): unsure at all n locations
cttaggagtctcaaaattaagtgtactgcatacatgtgaataatgcactaaggaaaaaaaaggcaaatcatatgatagaatcagtggctaacactgtgccttctttcctttgtatttttgcagcttaagttactcaaaactcggagaggttacctgcatacacgactgtacacgaaatgcttatcccgctgctgctactgttctacggtgttggcaacatcagtggctcaacgcttcctgataacagcacagatatgctctctcttcttggtttcaaggaagccatcaccaacgatccgtcaggagtcttgagcaactggaacacaagcatccacctctgcagttggaacggcgtctggtgcagccccaagcaccccgggcgagtcacggcgctcaacctcgccggccaaggtttgtccggcacaatcagcagttcagttggaaacctgacttttgttcgtacgcttgacctatccaataataacttctctggccaaatgcctcatcttgccaatctccagaagatgcaagtccttaatcttagcttcaatacactggatgggattattccaaacaccctcacaaactgttccaacatgaggaaactagatctctatacaaacttgctagagggtgcgattcctccgccaataggtcggcttagaaatctagtttacattgacctttcccggaataatctgactgggatcatcccggcaagcctaaaaaatatatccctattagaaacaatctatcttcaacgcaaccaacttgaaggaagcattcctgatgagcttggccaattttcaaatatttcgttgatggccctaggggcaaacaggctatcaggtaatatcccagcaagccttttcaatttgtcttcccttcgaatactagaattacgtgcaaatctgctaggagggattctgcctagtaacatggaaatcatctcactaatctacaacacctcttcatgggccagaacatgttcaaaggtcatgtaccagcttccttaggcaacgcttcaatgctagaaacaatagttttacaatctaacaatttcaccggcagaatccctacctccctcgggaagctatcaaatttgtataagttggaccttgaactaaacatgcttgaagcaaaagatactgaaggatggaaattcctggatgcgttgacaaactgcactgctctagaagtgctcgcattagctgaaaatcaactacagggagttataccaaattcaatcggtagcctatcgaacactcttcggtatctcgtgttgggtggaaatgaactatctggcatagttccctcgtgcatagggaacctttctgggttaattcaactgtcattagatgtaaacaagctcacaggttcgatcagcccatggattggaaatcttaaatacttggaatatttaaatcttggaaagaacagattcactgggcctattccatattctattggcagtcttacacggctgacagagctctatctggaaaaaaatgcatttgaaggtcacataccaccctccttgggaaaccctccactactcttaaagctggatcttacctacaacaatcttcaaggcaccataccttgggagattagtaatcttagacaactcgtctacctgaaacttacatcaaacaagcttactgggaatatacctaatgctttggaccgatgccaaaacttagtgaccatccaaatggaccaaaactttctcacaggaaccattccaatttctcttggcaacctaaaaggcttgagcgtactaaatctttcccataacatcttatcgggcaccatcccagcagtactgggggatctacctctactcagcaagctggacctttcttacaataatctccaaggagaaataccaaggattgaattattcagaacatctgtttatcttgaaggcaataggggactatgtggaggagttatggatctccatatgccatcgtgcccccaagtttctcacagaaaagaaaggaagagcaatttgaccagattgttgattccaatagttggtttcttgtcactcacagtgctgatatgccttatataccttgtgaagaagacaccaagaagaacatatctatcgttgctttcttttggaaagcagttccctagggtttcttacaaggatatagcccaagctacagggaacttctcacagtcaaacttaattggaagaggaagttatggttcagtatataaagcgaaattaactccagttaaaatacaagttgctattaaagtttttgacctagagatgagatgggcagacaaaagcttcgtatcagaatgtgagatcttaagaagcattcgacatcgaaaccttcttcctatcctaacggcgtgttcaacaatagactatagtggaaatgatttcaaagctctgatttatgaatacatgcctaatgggaacttggatatgtggttgcataaaaaaaataccgctgttgcttcaaaatgtttgagcttatctcagagagtaaatatagccgtggacattgctaatgcactgtcctatttacaccacgaatgtgaaagatctattatccattgtgatttgaagccaatgaatatccttcttgacagtgatatgaatgcatatttgggagacttcggaatttcaagcctcgttcttgagtctaaatttgcctcacttggacattcctgtccaaatagcttaatcggattgaagggaaccatagggtatatagctccaggtatatatggttattgccacatcttcaattcatgaaaggcaatttgttttctgaattaatacttagacgttgcattgtactaattagtgtgattttatcttttcttttagagtatgcagagtgtggcaatgcatcgacctatggggatgtttacggttttggaatagtgcttctagagatgctgacaggtaaaagaccaacagatcctatgtttgagaatgagctcaacattgtcaactttatggagaagaacttcccagagcagataccacatataattgatgctcaactccaagaagaatgcaaaggcttcaatcaagaaaggatcgggcaagaaaataggttctataaatgcttgttgtctgtagtgcaggttgctctttcgtgcactcatccgatcccaagagaacgaatggacattagagaaatagctattaagctgcaagcaatcagaacatcctatgctgaagcgaccaagcgagacgatatgcttcgaagaagggagttacaatgtaccattgaacttgtgtaattgtgttgtctgttggctttgaatacaacgtgcataaaacatgataaattggccatcagcatacactggatgtgtgtgtgaggaactactcttctgtactgcaatatatagttgtgggttaattttatcatccttaaaaagatattggaaagtaacatattttgtaggtaccttgagttactttctcaagaatcgtaaaatttctcatagttatgtgtgcgactatggtggaaagcagtattggtacgcactgtgcattgacactttgatttgggtttcacaaatttggggaacggttcctacaggctacagtttatgtaactgggataatgggattgtgcatgaaggatatatatttttaagccgggccggcctaagataggcggacaaaatttacttaagaaaggagtatggattgtgaaggatataagctaggtggttctttggacagcttatcatggcgattaatatttaatactccaggaacataaaccaaaatctgcataattggtgtcagattgcatggaacaacacagctaatccgcgcttatcattcaggagttaggactatcacaacctaagttgggtcgatccctaaatccaaatcccaacctgcagttactgatcactagaggagtatataagattgaggaaaccctcgggtaccttacctgtaccgtgcagtggtatatgcccattcgacgaaagccgatccgtgcgctgccgcgacgtcttcctcttcccgctaggagaatcgacggccttagccaggacgaagtgtctgattccggtaacgatgagggcccgccggagcctgcgcccccagccaaagcagaatgcgtctcccgagctcaaggggaagaagaggaagacgccgccgcgcgaggtcggtgagtcttccgcccggcgccaacgtgcaccgccgcggcgcctccatcctcagctcctgcagggttgctcggctgctgatagctttgctttgttgggccatatgtatactacttgggccgttctaccacttctagcaggaatcctatcttacgcagacgcgctagcaaactaactcgcgcacgatttggatccactaggcccaccctatcctaggctgcagttgttagcatttttttctctttttcccgtgattttctctcctcgtttcatgtgcaacctttttttctcgcctgatttttttcttttttattgcgcgatttttagctctttttttttgcaagattattttttccggtgtgctatcaggctaggtactcattttattttcaaaaatattgatgcaaaatttaaaaaattctaacacaaaaattgaaaggttctagctcaattttgaaaactttcaactaaaaatttgaaactttcaactgaaaatttaaaactttcgatcaagatttgaaaactttcaactaatatttgaaactttcaactcaagattgaaaactttcaactcaaaattgaaaaactttcaaatccaatttgaaaactttaaaaactttcaaaccaaatttgaaaactttcaactaaagattaaaaactttcaactcaaaatttgaaaactttcaaatccgatttgaaaactttaaagttaaaattcaaaactttcaaatcaagtttgaaaactttcaactcaaattaaaaaaaaccatatccatttttttactttcaggtctaaattgaaaattctcagttcatcttttaaaattttaattctactaatttgttcgttattttgctataaataattacgcttttacgctaatctaatcgtgtttagcgctaagcgggcgcttagctacgtgtggcatggcgacgcgcacgcgagttactttagcagcgcgtatgcgtgagctagtcgtgccccacttctagagccacggcgcgtgcaaaccctgcgttgtaacgagcttggcaccagggggcaacgccaaagaggaatgagttcactggcctcttaactttacgtcgagtttgcatgacatccttaatcccaataccagaaatcttcacccctaaattatacaaaaccgtaaaatttaggtcctagggcagtatggtctctggtttcattaacgtggcatcctagtaagcaaaataaaaaataaaaaaattacaggatccacatgtaagcgagtaaaataagaatatggggcccttatctcttctttctctcttttcttctctcctcattttcttttctttcttatcttctcttctcttctcttctcttcagcaatcttgggaggcaggtggcgtgagagaggggagatgtagctggtgagcccggccaagctccgccgccttgagcgccttgcgacgggaggagggaacggggtagaggggacgcggccggtatgagatgggaggggagaggcacggtgattgggatggcgaggtgataggggacggggggcgcgtgcacgacgacagggactacgaggcgatgggggatggagcgtggggcaggcaggcgttgtgatggcaactcggtgcctccttcacgggggagccgtggtgattgggacggcaaagcgagcggcttggtgacggggaacagagtgtgggacaggcgagcgagcatcatgaaccagcggtcttcgtgggcggcgacctgttgctcgaggtggagcggcggtgtgacccgcggtcaccgaggtcaccacctgcttccaccaccttttcatggtcaccgtacggcgtcgtccctaggcgtatactatgagatcttgcacgggcacatcgcccgtggcttgctatagtctccgtagcccacactagaggatgactcgccttgcggcttcagtgtttagacgggcaccgatagcggcgacgcctgctgcgcctcgncggcatggctccggctgccccttgtgcccctggtcccatcaccaccacaggcttgtcgagggtggtgaatggtgctccatgaccgcaccttgccacccactacacggtgaccatcgtcgaacactatcgagttgtggatcatctgtgacatgccacattttccgctggatctgcggcggtcaccgtgtccaccaccaccaccacaacaacaatcaccacaagcgtcggcgtgtcgtagacagccatgggggacgacgagaagggcggcacgaagcgcgcaagaggagcagcctcagcagtatgaggcgatgacgaaggcccctccatggtgcagccgctccagagtgaggtggcctcggcggtgaccgccgacggcaactcgcagcaggtgcagcagtggcctgcgcccacaccgggctgatgttccggctcgtcagaggagtcgacgacgctgacaccaagtgagcgctaacatgtggggcccaccgtacaccacgtcagtgaaaccagggataaattgggtctatactgcctcaggaccctttttacatggttagggatagttgaggggtagagatttctagcattgaggattggggatctcatataaattcgatgtaaagttaaagggacgtcaggtgaacttattccacgccgaagacgcttcctcgcgagaagcatatgcagccactagcccactaccttaagaggggaaaaagataagaaaaggaaaatcttcggcggtcctggcggatttcattcccatttccccaacacgcaaatcagagaacactggcaagaggacaaactactggcgacgaaaaatcgaagtaaacagtaaacaccaaaggagtcgctctctcttctcttctcttctcttctcttagcaatgggccatggcagtggatgcaacactgctgtagaggccgtggaactgcgttttaaaagttctgtatccaggggcctaaacccgctgtatatgcaagttaattagtatctctagtctacggcaaaccgacgattacagggagagttcgccgtggcggtgctccctgttcgagcagaggttcgttaactttctcttgttttgttttctgattagactgtatgcataaagcactgcatgtcttatttactgcgggctctggcttgaataggcctaaccactcctagttcccgtctacctacaatgacaatataatacttgtgtgtgcttgacttatgtgatatatctccacagataacgatgtgagagagaacgacggaaatagtgacgggagtggcatggttttaattttaaaaatttacagtggctactagccgataacgtaaacagtactatagtagtgacatttttctgatttgtcacatttacagtggcatggatccaattaaccctatacagtaccatattcactcgtagattttattatgagacagataaagcaatagcgaagctttcttttctagccgtatgtgttttacttgggccgtacaaccactgctggtcactttgtacgttacgcacgcgctgtgctcaacctctttgtggacaattgcgcgccgcgactgacacttcgacggtaactgctagatatctgcagcatgtgaagtaaaactttggcaagaggacgtaatactggtctactgcctccggagatggaaaatctggatcggtaaaagcggtcgagaactcgagatacggcagagaaatggacgagggcgccagatgtgacactgctgtagaattgtgttttttaaggccattgtccaaggaccaactgcccaatctggtactacttgtcttcggcaaaacagatttacagggagaattcgcaaccgctgttcgctccgagtggagattcccgtcgattcctatcagtatgccctacgcactgcctcagcgatttcatattgtgcacatggacataaaatacatcatatgcctattcattcatattttgcaggtgatatgtgttccgagcaagagcaacccgtgaaactcgccatgtttatacaactggtgttgttgctgctattttatggagttggtaacgtcgtccattgctcaactgtccacgagttcagcatcgatctgcaatcactgctagatttcaagaaaggcatcacggaaagatccaagcggagccttaagttcttggaacactagcactcacttctgttggtggaaaggtgtcatgtgcaccactgcacggccgtttcgcgtctcaacgctgaatctctccgcccaaagcttggcaggggaaatcacctcctcccttgcaaacctcacgtttcttcgtgcacttgacttgtcctcaaatcgcttctttggtcggttccctctccttaaccacctacagcatctgggttttctttacatgaatgacaactcactcgatgggattatttcggacacacttacaaattgttccaaattgacacaaatagacctctctaataaccagctgcagggtgcaattcctcctagaataggatccctagagtatctgaaccttggcaataatagtctcactggaatcatccctgcaaccattggaaaccttgtcaaatttggatatttgaaccttggtatgaataatctcactggaatcatccctgcaaccgttgaaaatctcaccctgttaacagttctcaggcttgaatacaatcagtttgaagaaaaaatccc

SEQ ID NO: 10505 - DNA, 1362 bp, Oryza sativa
cttttggcaccaaactttggctatgccctccaaagtatccaacaggtaaaacaagtttgaaggtcacatttcagcagtgttactgagcaaaacatggcatcagtaattcagaatcgtcgcagtactaatgtgctcccaagtgcaaatgcacctataattttaccatttgaatcattgcaataagataacatctataatcctcaggaagcttacatccagcaagaccctttttgtgatgttatcatgttttttttcttgaatggaatcagcacgagattatgctatttcattaaatatagcgagagaaatgtacaacccccctaggagaagaaaggaaaaggctatacaaaactatacgtgtgaaggatgaaactctctaagctttttagctccggccagaacccaagttcatgcttcttcctttattttggccaacagcctaggatgtgttattttccatggtttcccaacccatctcctttgtttttcgcgtgtacgtttttcaaattgctaaacgatacatattttacaaaatgtttatatgggaaagttgctttaaaaaaaatcatattagtccattttcaagtttttatagctaatacttaattaattttgttttaatctatcgctccattttccgtgcggagaggaggggtttccaaccccttcaaaagaacacaaccttaaacttatgttcgaaaacacgctgatttctctccttccttgatgttatcatgttaaatatgttcaaatgacaacacctagagaagtagatctatcgatattggtatatccatctattcgtctcctagtgacaaaattctggcataaaatcgtacccgttcttttcatctctaccctattaaaattctatagaataaaaacttgcaaaaactttgaccacaccaaaaattccagtggtgtgtttggttgggttgatgagcctgtataggagatggtcgtccgagtttttgtagtgtttggttggagggcatggtggatggagcggtccagaatagggaatattccctcaatatgctggatgagtgcatccggccgatttggctggatgaagccatccagttttggactaggtgatgtgtcctattccgattggttgtggttggtttgatttcctgttaagcaagctccaaatgattttgtctcctaaatcgtttatctaatttataatttgattacaccattatatttgttatagttaaatctttaaaacaagatctcggatgattatattttgataaaaaatatatatgacaaacgggtcccactaacttttgactttttccatccatgatatatctctccaaccaaacaagaaattggattgttatatccatataa

SEQ ID NO: 10506 - DNA, 3613 bp, Oryza sativa
atccaaatttttatttggtttgtatgaatatgacgatccaatttcttgtttggttggaggaatatagcatggatgggaaaagctaaaagttagtgggacccatttgtcatatatatatatatatatgatacccatataggactccatggtgctcgggctccaaggtataaaacacacaaattctctcaaatttttaaaaattttcaaattgtgagtatatacctaggtatatgaatttgattcatacaaatacctaacaacaaaacaactcaaactcaattttatttcacaattcattattacatacctaacgaattatatgtttgaatgttatatacctagaaccgaaatctaacaaaaaaaaagttcaaactcagttcaaacttgtttgagcttgttagtaaagaagttaatgttcatatctaaacatttaaaaaaatttcatacttattcaaattgggtatatacttaatttgaatcttggagcccatactccatgtagcaccagttaatttacctatatatatatatataatcatccgatatcttgttttaaagatttaattataacaaatataatggtgtaatcaaatcataaattagataaacggtttaggagaaaaaatcatttggagattgcttaaaaggaaatcaaaccaatcacagccaatcagaataggacacatcacccagtctaaaactggatggcttcatccagccaaatcgcccggatgcactcattgagggaatattccctattccgggccggccctatccacccttccctccaaccagacactaaaaaaatcggatgatcatatcccatcaagtccacctaaccaaacacacccggcatcaaagcaaaccaacccaaaatctctgtccctgtccggttccggatgaaacatagagatggaccaaaagtaaagatctctgattgaaactggacatgccacaacaaacttgccagctcaaacagtgacgagcagcgacgggtgacaaggtgaaattttacaacaactggcaagtttgacggactcaaggtcttcgttccaacggcggcaaagctgagataaggcttgagcttgagtgcttgaccatggcatatgcaagtcgtggatgtgaggccgctgaaaaaccagttttaagcccctgcaccctgaggcgtgagccagattagtacccaactcaaagttcacacttcacacaccacccagccaaacaaagcagaatttccatcatgtgcactctgggcaagcagaggggcagaggtgcgctgctcttttatgcctggttatttggttaatacttggcttttttactccatcatctttagttagtacgtattaaaattagttgttgcgagtgagctgtgaaacatttcagaaaaaaaatttagaggactttcagaaagttgcaccttgtttttttaatgaagtactttctccgttttatattataagactttctagcattatcctatatatgttaatgaatctagacatatatgtgtgtgtctagattcattaatatctatatgaatgtggacaatgctaaaaaatcttataacctgaaacggaggtagtacaactttgtgtttcaaattacatttagactgcattcgtttctcacttctcccaacctctactctctcgttttccacacgtacaatttcctaaattgttaaatgatatgtttttttaaacattatctataaaaagttattttaaaaaatcatattgatctattttttaaaaaactaatatttaattaattatgtgctaatgagactctccgttttacattcgctccatttgcagcatggtagggactaggacttgcgaagttgggattgtaagattaccagagttggagcattggagggtagggctgattgcgtaaccatgaagtagctccagtagcgatcataatatgtcgcaatatttatgtttcactaattgcaggcagcgagggcctgatgtctgtcaacaaaacggtgaaactgaccatgcccgttctattggcattgttgctgttgtcctatggaactggaagcattcgttgcacgacgatcgctgggaacagcacggacgtgctctcgttgctcgatttcaaagccaccaccaacgatccaagaggagccttgagctcctggaacaccagcatccactactgttggtggagcggcgtcaagtgtaagccgaatacccgagggcgagtcacggctctgaaactcgcgggacaaggtttatcaggccaaatcacctcctttcttgggaacttaacggaccttcacacacttgacttgtccagcaataatttctctggccaaataccccctttaaccaatcttcagaagttgaaataccttcgtttgggccagaattctttggatggtataattccagattcactcacaaattgctccaatctattttatttagacctctctaataacatgctagagggcacaatccccccgaaaataggtttcttaaataatctctctgtattggccttccctttgaattttctcaccgggaacatcccctcaacccttggcaatcttacaaacttgaatataatgctcctcgcaaataataagattgacggaaacattcctcaagaactggggcaactgtcaaacttggggtggttgtccctaagtgaaaacaacctatcaggtggttttccgcagggattcttcaaaaatctatcttctcttcaaatattaagcattcagacgaccttgcttggtggcacattgccatttgacattggcaatacactccctaatctcacaaaacttttcttggctgataacatgtttgaaggtcatatcccagcttctttaggcaatgcatcattgctacgagggatagatctatccttaaataattctactggccatattcccaactcttttggacggctttcaggtttgtctacattaaaccttgagacaaacaagcttgaagctagggacaaccaaggttgggaattcttagaagcgctcagaggctgcaacaatttaaatgtgctctcactagctgacaacctgttatttggggacgtaccaaattcaattggtggcctatccatcaacctgacaattttattgttgggcggaaacaacctaacagggatagttcctctaagcattgggaaccttcaaggcttaatttcattggggctagataataatggtttcagtggtacgattgagtggattggaaaactgaaaaacttgcaatctttatgccttcgaaataacaatttcactgggcctattccatactccattggcaagcttacacagctgacagagctctatctgcgaaacaatgcatttgaaggtcacataccgccctccttgggaaaccctcaactactgttaaagctggatcttagctacaacaaacttcaaggtaccatacctttagagattagtaaccttagacaactcatctacctacaacttgcatcaaacaagcttaatggggaaatacctgatgcattggggatgtgccaaaacttagtaaccatccaaatggaccaaaactttctcagaggagacatgccaatttcttttggcaatctaaatagcctaacc

SEQ ID NO: 10507 - DNA, 1383 bp, Oryza sativa
catctgcttatctcgatggcaattcaagactttgtggaggagtgacagatctccatatgctctcatgccctcaagtttctaatagaataaaaagggattctgatataacaaagagggactacaatctggtcagattattagtaccgatatttggctttgtgtcactcacagtgctgatataccttacatgcctagcaaagaggacatcaagaagaacagacctattgttgctttcttttggaaagcagttccctagggtttcttacaaggatctagcccaagctacagggaaattctcagagtcaaacttaattggaagaggaagttacagttcagtatatagagcgaagttagctccgactaaactacaagttgctcttaaggtttttgaccttgaagtgagatgtgcagataaaagtttcttatcagaatgtgaggtcttgagaagcattcgacatagaaaccttcttcctgtcctaactgcatgttcaacgatagacaatagtggcaatgctttcaaagctctgatttatgaatacatgcctaatgggaatttgaatatgtggttgcataaacaatttgcaagtgttgcttcaaaatgtttgagtttagctcaaagagtgaatatagctgtggacattgctaatgcattgtcctatttacaccacgaatgtgaaaggtctattgtccattgtgatttgaagccaactaatattcttcttgatgatgatatgaatgcatatttgggagacttcggcatttcaaacctcgttattgagtctagagtcacctcacttggacattctagtccaaatagctcaattggattgaagggaactatagggtatatagctccaggtatatatggttatttccacatcttcgattcatgaaaggcaatttgttttctgcattaatacttcaacattacattgtttaattagtgtgatttttatcttttcttttagagtatgctcagtgtggccatgcatcaacatatggggatgtttatagttttggaatagtacttctagagatgctgacaggtaaaagaccaacagaccctatgtttgagaatgagctcaacattgtcaactttgtggagaagaacttcccagagcagataccacagataattgatgctcaactccaagaagaacgcaagagatttcaagcaacagccaagcaagaaaatggtttctatatatgcttgttgtctgtattgcaagtggctctttcttgcactcgtctgatcccaagagaacgaatgaacactagagaaatagctattaagttgcatgcaattaaaactttctatgcagaagcgaccaagcgagaaagtacgctttgcaggagagagttagagtgtgtcatggaactagt

SEQ ID NO: 10508 - DNA, 4831 bp, Oryza sativa
gatctaagctttgattctctttctgaacagcttgtcatggtaattaataatacgaaaatgaatcataatatgcacatctgttgtcagattacatcggagaacactgccaatcgccaaatccactttttttcacttagacctaggactatcacatccccccggcataaaaataaggactatcgcatcctactaagttgggtcgatccctaaatccaaatcccaacctgcagttggtaatcactagaggtcagattgaggaaaccctcggcctcgggtacctgaaccctgcagcggtatgcccactcgccgaatgcccgtccgtgtgcctcttcgctccgccctctagcgaagtgcgccgccgctgcagcgcctgcgcgcgagacgtggactgtggagtggtcgggtgctacggtgctacctccgcgtccgccgcaacgtcgtggagtcgcgctgttaagtggaaccaaacaagacagggcaaagctactccttccgagttccgtcaaaaaaaaaaataaacatgggagggatgtgatattttctaatacaatgaatctggataaaaggccatccagattcattttactagataatgtcgcatccttgtctaggttatgtttttttaacaaaggaagtatgttgcgacgaagatggataggctcttttaggctcctagtagaatggcagtttggcaaggaaaaagtccctcaacttatcatcgagttacaaaatcgtcccccaaccacaaaacaagatatatagcatcctcaacttacaaaaccgttcactttaggccattcggtggttttgaccccggtattgtccgacgtaacagctgactcggcgtgggacccgcatgtgtcgcacatgtcagactgccctcgtcagccacttcttaccctcccccatcaactcacttcctctcccctcccctctccatgggcggtggccaacggagagcagccaggacacggcaggacggtgtggcgggcacggtcggcgctgcagaggagcacatcgcggtcgggcgccgccatggcctcttttgtcttcgtcatgccttcgtcgccgctatggccttccttgtatcctctccccaagggtcggcggcggcgagcacggcacgccgcgacgtggtgtgccctgttgaagtcaccccggtcgacgaggtcggcacacgcgagcggggaggggcgtcggtggcaggaccataggggcagagcgaagggggagctggaggggaacggtggtggcgaggtggaggaagagggcgccgcttcgacgaaactcccatccagggcgagggaggagcggaagacagagaccgcggcaacgggagggaggtggggatggaggcggcgaggagagagtttgccggttgacgcgctgtcgtcgccgccgttgtccatcctgcccttgctcatccgcgaggctgtcctcaacgagtcgccgcctaaaagtgctttgttcatagtttctagatcaaaaaagagatctatgagtccaggcataccaaaggcgtggccgccgctcatccacatacgccatcagtcgctcatcacgcgttcacgctccgccatccagcgacggggcgaccacgtcaccgcctggcaaatccaagaagaactagtaggaggggctgaacaaaccgtataaaactatagtcccctcttctaatgaatgtatgacataataaaattctagtggggttttatggggcctcttatgattacaataccggaagtggaggctcgagaccctatagcccccatggtagatccgcctgcctgcaagcctagatcgagtgtggcggtcagcggagtttggtcaggtgaagcatcgatgaatacaggcagtgtcgtttcttctgggcttggtgatgctgcaccatttctccctggaaaaagtacaccgaaggtccctcaacttgtcatcgggatacaaaaacgtcctcaaaccgcaaaaccagatacgcaacgtccctcaactatacaaaaccggtcacaataggtccctcggcggttttgatcccggttttgtcttacgtagcggctgagtcagcgtgagacccacgtgggccccacatgtcagtgtaatccacgtcatcaccctccctctctccccccctcttctctcccttcctcaaatctctctctctctcacttatctgcaaggtagccgacgcgagacgggagaggaggggggcggcgccgcgacagcggcggcggtggcggccgccgccgccgcagtggggaagcatggcagaggcgcggggaggccggcgagctcctcccaagtacaaatccgacgtcggcttggcggtggcggcgaggcgggaggaacgcggtgaggacggcgacgccatgagggcgctcgaggaccggtgccatgacggcggggaggcgcgggaaggccggcgtcggcgtcggcttgttgatggcggcgaggcgggaggaacgtgtcggcgccgggagccggagcggcaggaagcaggtacaggcgcgatggcgacggctcgccaggaccaagcgctgtcgtcgctgggagctggagggggaggagctcgcgggagttgttgaatcgaatgttcgatggcgagcgcgccacgacggggtgatttcgcaagtgttgcgtgaagacggcaggtcggtttatatagagaagggtcgcttgatcagggcgctcgcacgatctctactgcgcgtaaccgaaccggataagtcgcgcgtaacttatccggacttcacgccgtttgcacgcaccggatttttcggaacgtttccaaaacaaaaacgaatccgaatttgtagcaaaacaaaactgcaaaaggaggctgcatctgcgcaagggtgaggagccaatttttcggaccattcgacgcgtacgtcgtgcacgcgcgccgccggcccggcccggcccggcccggcccggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctgatactagaccgtctgtagactacccctcgggtggagcgtataagtcatactcctaggtctttagtaagcttcctagaagattcacccaaaatcttcatagactgcgaccaacagtcaagctcacaaaggtgagttctttcaaaaatgctctgcaggacaacatcttcgctaattaaagccaacagaactcattaaggcatagccaacctgccttgcagctcacgagagtatatgcatcttcacttggagagggtatatatattggtactctcctttagtttattaatggtttgttcttcccaggatctaattcacgggatctccgatcacataaactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgccgttagctctgcttccatggttgacctcgtcaaaatggtctgtttgcaatacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccaatgatcatctcccggattagaggtaaatcggcttaacttgctcacagcaaaggagatatcaggcctagttgcactagccaggtacatcaacaagccaatgatttgggagtattccagttgattcctagcaattctcttgttcttgcgaagcaacaagctaggatcataaggtgttggagaaggcttattatcaatgtagccaaaacgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgacctt

SEQ ID NO: 10509 - DNA, 1571 bp, Oryza sativa
ttcgaaccactatgtgtatccttcattgggaaaaagctctcaaagaaggtagcattacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagacttgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtgcacatagcaaaatctagtagcattatcaatcaatgtcatgaaatatcattttccacctttcggcaacaccccattcatttcacaaagatctgaatgtaggagttctagtggtgccaagtttctctcatcggtagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcatgttcttcagctgcacgatcttttccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgtt

SEQ ID NO: 10510 - DNA, 13085 bp, Oryza sativa
  unsure (1)..(13085): unsure at all n locations
taagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctatacatgtaaactacacagtataacatgaacagatcaaatatgcgcaacatattgaacacgtaccgaggtgacgtaaagaccggttgcttggttgaaacttttcgcaggtgtctacgaagacacgaaacacgcgagcgaagaggaaggcgagccgtcgcgaacaaacagggagcagtcgcgcgaagcgcttcccaaaaaccttattgccgccttctcccggtgcaggacgtcgaaggcagaggttccggagacctgctctcccgatcgccggtgcacgccggcgagcgggatggagtagtctacgagcgacggcgcagtacagagtaggaggcaaaccccagattgatttcgcaagtgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagtcaatttttcggaccattcgacgtgtacgtcgtgcacgcgcgccgcctgcccggcccagcgaggcgagcgagcgcgcgcgtgtgtttcccctcttctctccaccacacatgcttcaagtggctaggaggacatcctcccttttaaggagatccccctctcctagaataagcaaggtggtactaaactccacatgcatgccatcccatgaagtgggcttttgtgattttccaaagaattaatcttcgagtgggctaaggcccattcattaattccaacaagaggtacatcgagcactacgagaaggagatggggaagcctgtgttcgccgtcgggccggtctgcctcgtcaacggcgacggcgacgatgtcctgaagcgcggacgccgcggggaagcgggcgctggcgtggctcgatgccgtcgacgagcggcacctgctgctgcacggccgccgtcgccgcagctgttggtatcagctcggcgtcgcatgaacaccacgcgacaggaagccgtcgacctcggcggctgtcgacctcagcggccgtcgaccacgcgaggaggttgctcctagactgcagcgcggcgcggaggtcgatcccaatcccgatcccagcgccactgtgccaccgcaacgcccaccgcggcgactgacgggggagcccgcgcgctgctcctccccccgccacccgcgcgccgccatcccccgccgcccacgcgcagctcctccccccgtcgccagcgcactgtcctctgccgtccgcacgccgccccttccccgccgcctatctgcaactcctcccccgccgccgtctcgtgggactcgtgggtggtggccggcaggggagcccgcgcgccgctcctccccccaccgcccgcgcaccgtcctcaccttccctcccccaccaccacctccaagaaatgctttccccgccggatccccccgcggcgcggtggccggcgtcctcctcctcctccgccgccgcatcgacggtgtgccccactgctccctcccggccgcctccgcggtgtcgtccactcgtccctgcaagtgtgagagctgagagcgagaggaaggaaagagaaacagagaaagagaaaggggaagagagagggtgacgtgggcaccttacatgtggggcccacgtgggtctcacgctgactcagccgccacgttagataaaatcgggatcgaaaccgccgagggatctattgtaaaattttgtatagttgagggaccttgcatatcttggtttgcggtttgaggaagttttcttatctggacgacaagtcgagggacattgagtgtactttttcctttctcccttgattttgtgggccgtttgtcgttaatatggcccattatttgttggccagttcgttggctgggccttggcctgggtcataaggccagtttacctgagtgaaccgcgggcggcgcctgaagagtgaagacaatcggcagtggcgtgacacggctgaaacttcgccggtgactgtttgctttccgcatcgcgtgtagtagtaaaattttggaaagcggacagaatactggtctactgctactggagatggaaaatccgagtaataccgattctgatcagtagaagcggtcaagacacggcagagcaaggcgctagatgtgagtcatgtgacactgctgaagagttgtgatttttgaggccactgtccaggggcccaactgcccaagccggctgtactcgtcgtaggcaaaacatggccacccgctgttcgctctgagtagagaggatatcttcgattcttcattggtagtatgctatgcccaatgccctacgcacaggctcagcggtgttcatcttgtggaaagagatataacatggctgttttattcatattttgcaggtgatatgtgttccaagcaggaacaacccgcgaaactcgccgtgttcgtacaactggtgttgctgctgctatgctatggagttggcaacaatgtcgtcgtgacgtcgtccattgctcaactgtccgcgagaacaacatagatctacaatcgctgattgatttcaagaagggtatcactgaagatccaggaggagtcttgctctcttggaacactaggacccatttctgttggtggaatggtgtcatatgggtggtgtgtggtcataatagtactggacaagtagccgtatagatgaacaaagagcttaatccacataccagttaacatgggatggaacgccacggctattctacataaactccctagcacaattttaaccaaactaaaatcaatttcctaattcaaatttagaatctgaagcggctaatcacgaacgagtaaagaccgatgagatctaggaaccacggaatacctttgggaggcggatggtcgttcgctggcggcgtctcaccgtcttccctccggcgacgcgcgcccgcgcgcgcgcactggcagtggcggatccacggttggggctggttggtgccccagcctcacctctaccctgctcctaattaatcattaacaagtctagttagtcattagtgaagaaatttccagatggcaaggatgcaggctgctgcctcactgcttctactgcccaaactgataaaacaaaacatactccgagtatacataacaacataatcacagatagagaaagtattgggaatattttaatatagccaccaatcaaaatagagaaagttcttttgatcgtggttttcattggaaaatactttagttgatatatctttatttgttttaatcatattatattttttttacactagtaccccacaatttaaatctggattcgccactgctcactgcggaacatcgcgcggcagtgcggataacaggagaagctccagttattcgtgggaagtggccagtggtggcgacgcgtgggcgtggcagactgtgacattatgggcctgtggccttccaatggacctgttcgtgtggtctggttgctgtccttatttgggccatcagctgcaacaggcctcctgagtcctgacggcaaccaaatgtctggactgaattatacctgcatgtttttttttttttgaaaactattacttgcacgttctagttcgacatcaatcgtgacagaagaatgcagagtctagacaggaggaatacgattgctcggacggaaacggcatctagagcgagtagatcacgaccaacaaaattgatctttgtcgttgtagagccgtctcgactttggcctgttctgtattgcggtcaagctacggcaaacgttaagcatatgtcggacaagggaattggataacgaatttacaaccacacgctcagattctaaatctaaacaatctagctttgtacaaaattgcatgaaaaatcagctgaactaatacggccattgcaactgccgttaattgtaggggcgaaaacagtgaccgagccactgtccgactagaccgggcagccatctaggttcgtcggtgaaaactccattaaattttaatattaactaaaaaaacacacatgcgttgcaaacttgcaatatgtgaaagattttttttttacaaaatcatatgctgtaattaggagtacgattgtctcaagttagcatgtaaatttgtttaaagagatttcttatacaactctttctgtatttctaaaagcgtacgaatttaaaaaccgaatcaaatatggatatgtatttccaaaagaaaatagacttcaaaaccaactcaaacacggatgacatactaaagtactgataaaatattttcagtttttataatagtaaagatgagtaaatttatgatgaaatttttataataaataataattatattgaagtttgactgaactcaaaaattttctagctctaccaatgagcacaaagacaaaatatacacttcctttcttatctttcttatgtcactcatcaggatagcattagcataccacccaccctgtttcctgggtgatgtcggtgatctatctcggtatgattcccagtgaccactggccagtagcccagtagtagttggcaagaccccctttcgtgctccgcataaccgagctgtacttctggatgttctccagcacgggaacgcacggtcaccgaccaccattattggcgaacaacctctcgttgcagtttgagcctcctgtacgtacgtgtggctgtgcccattccgaaacactcggggaggtctccaaactgatcacggccaaaatgatctccctcgcgcaacatgggcatccgcacatgcggacggcgagcgccggtttgcgcccgccatgcgtacaatgattgggaacgtacgttcgttgctccccttgccgccggagcaccgcccgacccgtgaatccgtgtcgcgacgagtcgcgaccaactggcgtctgtcgcgtagtgctctcccgtgtacgtacgagtatagtgggccgaatcggcactgtgccgcggtacgcgtaagttgtttattctggtttctccaagattgggattctagcagctttggggtgggtacaacagtgttctgcacttgttctctcgtatattcctacagtacatattctgttctccggtacaatatgtgattcaattgtggggctacttgcacgcggtacacaaaaataataccctgaacaagctgctggggaaatccagagtttggacaatatgttttaggccctgtttaatttcccaaaaaaaaattacaccttgtcagatcgaacggttaaacacctacatgaagtattaaatataggctaaaaaataatttattgcacagattgcgactaatttgcgaggcaaatcttctaaacttaattgttccatgatttgacaatatggtgctacagtaaacatttgctaataatggattaattatgcttaataaattcgtctcacggtttactgatggattatgtaattagttttttttttattagtgtcaaaacaccctatgcaacactttatataatatccgatgtgacacgccaaaattttacaccctaaatctaaacacccccttattcataggtacacctggcataacatgcatacccactagggtactaggtgttcctttttaatgacgatttaatggatcatggacatgtattatgaagctaaaaattatggttgatggattatgtgtgtgttattggtgccacaatttcaaaatcaagatttttatgcgcatgattaaacataagaccttaaaattaaaaccacacataataaaatgtcactacactatcaggtgtgtatcggaagctcagagaccatatccttaattccatttattgatctccagtctccacctaagcctctctaaattcttcattgttgtatacctcgacaggcacatcacgttgaaattgctaatgcgcggctagtcgcgcgcgccctcccgcgcggcgaggcacgtggcgcgcgccgagagggccacggcggcagcgcgtgcgtagggtggggcccgcacgattttcttttttttttccttgttcggtttctcctttccggttttctttccttttttttctttcccttttttccttttcggttttttacatatacgtatacaaactttttatatatatgtatacaaagcttgtatacgtgtatataaagtttgtatacgtatgtataaatcctttgtatacgtcatatataaagtttgtatatgtgtatagaaactttatatacacgttcgtatctaaggtttgtatacttgtatacgtatacacatgatgtgttttttttattatttttaatacgtacatctacaaagtttgcatatttcatatacaaagtttgcacacatcatatacaaagtttatacacattgtatacaaagtttatatatgtgtatatttttttatacataaaaatatatatttgttagtagtagtagtatagtagtcctagtagtaatagtagtatagtagtactactactagtagtaaatactagtagtactagtagtactagtgtactatactagtaacagtagtagggcgacgcgcgcctaccccacgcgcggtcagtcgcgcattaggcgcccgtagggtaatcctaatgggcggtgatcgctcactcccctccccagtgatcacgtgcccctccacctgtactactttacctcccctttttctcttactactacaccataaaaatttaaattaaattcaaatttgaaacgggtatgtaaactttttacttataaactttgggtctataaactaatatttgaatttaaatcaaactttagctgtataaactttagatgtataaaaatactatatatagaaaatatttatatttgaattcaaattcaaatttgaatcggatataattcaaatttaaatttgaatcgggtatgtaaacttttgacttataaactttatgtgtataaactttagatgtatagaaatactgtatataaaaaatatttgaattcaaattcaaatttgaatcggatatacaaacttttgacttactataaactttgggtctctgaactttagatgtgtaaacttgaggtgtataaactttagatgcataaatttactaaaataggaaagtaatgcggtgccaaaaaagaaaaccaggtggagggagggaaggggagggggggaaacgaattgatcgctatccccgtcgccaggcgagcgatcgcccattagccgtttcgcattacgtagacaccaatctattaagtttggcccaaaataattttatctggccttgtgcaaattaaactatgtatggaagtctaatgacattctttgccttctaacatttttttaatcaagtttatgccttaattaccactaccaataaaataaacagttacacatattcatcaattgaattttttccgttactttttctttcatctccccttctgatgtcctcaattcatcgtgaaacccgtttctagccaggcaggcagcaatgcaaatcatcgtggaactagttaatagctggtgacctcaatttgttttcgcgcgcgaggcagaggcattattctttctactgaagttaccatcacgggctgtcaccgatggttttcttgatctttcgctagctaccgtgtttgctcctcatatggtgcgtaaataactccttccctaggcttattagtccattccaataagttttaattttactcatgaataaatactcatatgctactattttgtcccctcttcatgtgttctttgtttctctggtcttctaactataatctgacacacttcaatttttgcctatatcataaacatatatatatatatcttgctgatttttttatcaatgttcctacggagtaggagtactaccttaatcactgcaaccaataaaatatttttttcagttaattctcgagtaatatatcttgctattttttttatagaaggcctgaaaagcctaatttataagcatggaagtgatgaatgtcatcaatctttctttctaatgacctggctcaaaccaagagcacttggaaacacattacccaatccaaccagcaattagaatttttcaaagttatagaaaaaagttgaaagatatatttaaatcacagctattagttgcacctaatgttcaagtgatgtacaaatttagaacaatatatacgtgtatatagtacaagcagttagatgcatgttacacctaacgtattctatctatcatacagaagtctcgcagcaacacgcgtgatctctcactagttatcctatacaatccattgcaccaaggtatgacaaaactactccctccgttttagactataagtcgttttgactttggttaaagtcaaacaactctaaatttgactaaatttgcaggaaaaagtagtaacatttttaacccaagacaaatatattataaaaatatacccaattatagatttaatgaaactaattaggtattgtacaatattacttccaaacttgataaaacttagagtgtttgactttgaccagagtcaaaacgacttataatctgaaacagagggagtacataggtaaagattttgtattgtaactcacggtgaatcttatactccctctgtcccaaaatataaccatttttagcatagtgtcaagtcaactatttttaactttgactattaataaaaaaaataaaaaaatatcaatcatgtgaaattgatgttactagatttatcattaattaaactataataatataccattctttttatttaaaacaccttatttttatagatattattggttaaaatagcatctcgaaaactgtgtcgagtctaaaaatacttatattttgggacggagagagtaagttttttatttcatctttttttctaaagaaaacaaacccatgatcctcctacggctgccaagttcattgcggtggcaaaagcactccttatggtgcccggccacgttatgttgcagcgatggcatatggcacgatggtagtgttcgagcacatcatgaacgttgctttgggggaatggtctacttggtggatttcagtttcaatgcgtgcttaagcgtggtttgcgccaatacgataacacatattttgtgctatgctttgttttatttcgtcaaggaacgagatgatgcattggatcggagatgaaataggatggggttgaacaactttcattctgatgtttaatttatagttcggtttagcctttttttgctaactggtttttctcaatttagaaataagttacaataacctatcacttcataagatattttataaaactgcattaatagcaaacaattttatcagaaagcttatactagtaactagtgtatatatccctgtatatatgtgtatatgacacatgtgcctaacttgcagaagcatgcatgaatattgcatatgtaacatgtaggtccaaacttgtaaaaagaagatgtggtcctatgataaatactgttgcttgtttgaaatgtcttgcaacaaattgatagttttgatgaaatagttgtagttttctaaaattttgacctaaatttcctctgtagtgaatggttttggcatggcagaagctaactaaaatttgcatatttggacacatattatttgatattttagattaatataataaacattgaatccatgaggatggtggggtggacaccagcatacctaagaaaataaaaaagaagttatggtataaactatgtatcaatggcccaaaagatttgatgggatactgcacaaactgaactacaagaggcacgaaccagctttgtgggcataatagcaagaagaaaaataaatattaggcaaaatataaaaagaaaaatattaggcagatttcacgagaaaaaaagcaaaaatattcggccttaaattttcgaattaacttggtctaattttttttttgctaccattatatatggcttatgatggtttaaaaaaacgtgaatattaaggaaagacctaatatcaaataaatataagaggtgatgtttcgaatctataccaactagtccactaccttgtgaagctagccagaagatctctgggcgtttctctgtcttacgatggttaacacatcgtcgtcatggcaccaaaattagctagacaatgtttgctctagtcactcgaaattattatcctaatagagaaaaaaaagaaagcattatatcgtgtgatataaatagttcatattacaatctggttgatcgatttatataattgtatataagatgtgattgtacttaatttagttagcataatttacatgatactatctactacctaaaatagatcttaacacgcatttgcacatgccacgctgctagttaaagtgatacaataacaaaaatatttcttgtagtgtaacacttaattgaattcaatctccaacttgattgtgaagtacaaaaccataggtccagagtagtgaaagcaatataagggacttggaaaaaaaaaaccaccctcgaaaacgtttgctctagtcactcaaaattattatgttaatagagcaaaaaagaaagcattatatcgtgtgatataaataattcatattacaatctgatagatcaatctatatataattgtatataagatatgattgtacttaatttagttagcataatttgcatgatactacctactacctaaaatagatcttaccacgcatttgcacaggccacgctgctagttaaactgatacaataacaaaggtatttcttgtagtgtaacacttatttgaattcaatctccaacttgactgtgaagtacaaaaccagagatccagagtagggagagcaatataagggacttggaaaaaaaaaccattctctcgccttttcttctcctgtcattaatatgaacttgatttttataaatgtgatgaactacgccaagactatgcacgcaactatttccagacatctggtattgatttcatattcaaaccaacgtgctttcgacctgttcattgggttggtggtcacggctgatatttcaccacttcctgagatattcatataatcagtatggtgacatagccgtggatgacacggcattcgtatgtagcactgctatccaaatcgaatacatacaagtttgctagacccgctgctctgtcaacgaacgaatcctgaccgcagaaacaaattctggaagaaccaaaatgaatttgtggaacgagaatcttgaaaggtaaaccgttcatgtgctcaaagcttatctgcatacaagccttcgagaccggtcgcggctgtcgcatatcagcgcagaatttctctgtccggttccggctgaaaagtagggggatagatgaatagtacggccatcggattcgaggttcgagctggacatgccgcaacaaccttgtccagatcaaacagggacagcagcgtttggtgatgagccgacgaggtgaaaagttgcagtaactggcaggtttgacggactccaggtcttgcctctagtggcggtcaagctgagataaggagtgacaattaagtgagtggatgcgacaatgctgtaaaaccgtttttaaacccccgggacctgggagggctgctgagcaaagttcagagttcacaaaccaccacacccagcggcaccatagacaccaagcagaacaggctgctgagctccggccgaccgaaggtgctccattctctctcctcatcattattgatatttgcaggatcgatcacttgaggtaaatcatagaagctcaaagtgaagtgcgaatatttttgaaaaattgagttttgttctgcttttaagctttgaaaagtcagatgtgttcgtggatgatcacataagcgaccatttgcctcgatcggttagcataggcagcatgccataatgttcatggttgtatatttttgcaggtaacatgggcctcacgtgtgatacacaaactgcaaaactggccattatactactagcattcatactgctatgtcatgggattggcaacgtcgattgccgtgggaacagagccgatcagctctcactgcttgatttcaagaagggcatcaccaacgatccatatggagccttggccacttggaacaccagcacacatttctgtaggtggcaaggtgtcaagtgcacctccactgggccatggcgcgtcatggcgctcaatctctccagccaaagtttgacaggccaaataaggtcctctctcggaaacctatccttccttaatatacttgacctcggcgataataacttacttggctccttacctcgccttggcaatcttaagcaacttcaggcactctatctgtataaaaacaatttgacagggataattcctgatgaactcacaaattgttccagcttaacgtacatagacctctcaggaaatgccctaactggtgcacttcctccaaatttaggctctctgtccaatctagcttatctttatctttctgcgaacaagctaactggaaccatcccgcaggcccttggcaacatcaccaccttggtagaaatctatcttgatacaaatcgattcgaagggggcattccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10511 - DNA, 26773 bp, Oryza sativa
cggggttaccgtgccccggcggtaaacacggttaccgcgcggtaaccgtggtaaccgtgaaaaaccgtacgaaacattgtttaatttatcaaaaattcaaattattttttaaatttatttgaatataaggaggttactgcggtatttatattactgtacccccgcgataagcccggtaaccgcggtagtcgcgcgggtaccggcggtaaatcgaacactggcaagattgaccttactaaggttggaggggtcattgcaccccgatagtaagcttggtaaccttgcagttatgcaatgaataatggaaaaactagctaggtaatatttaccagaagtttcaaaatttcatttcattttctttttatagcatctcggtcgtaagcttggttaccgatcaaaggaaaccctaggtgaggaacgtccctctcgtaagtcgtaaggatgaggtaattgtaagattgtttgtcagcctcaactttagtgtactagcagtccgtaagctgttttgtcagctcatgacatgatgttttgtcgtgtcatctggtacgttgacattacaagtttcatcaggaacgtaacaaaattcaatgggctgcgtggtcaagatggaagggttaggtctcacggagctaagtcagctagcatgaatatatcattcatataattaaactatgagttgactatagcatgaattaatatagcccaaacttttctaggggagttctgaaatctgaagtatgatagagttgacgagttcccgtttctctgtatgattgccgggtgtatgcaattaacgtggactataaaatacagcttgcaactatatgtattttgaaaagaactatgtattttattccacagtagtactctctctgtttcaaaatgtttgacaccgttgactttttagcacatgtttgaccgttcgtcttattcaaaaaaattcgtgaaatatgttaaactatatgtatacatgaaagtatatttatcaatgaatcaaatgatatgaaaagaataaataattacataaattttttgaataagacgaatggtcaaacacatactaaaaaggcaatggcgttaaacattatgaaacgaaggaagtataatactattggttacatacatattgacactttaaaatatatttaggctcccaggaatactggcgccgctgggaagcctccattgatacctaataatttgcttatatattagcccctctcctctgcatatgctacttatttatatatccacgtttggtttttcagcaagcaaagtctacaagaggcacaactctatctgcatagtgttacacattatacaattgttcattattgtggcttccctgcttctgaaagaaactggaccagtcttcatcagtgtcttcagatcgatctcattgccattgaaaattgataatatgtgtactatattttttagatgaaaagcccagtaccgtcctcatgcatgcatgcatggactcgatccttggcttgtgcttgctggcgacgatttccacttgttttttttatggctagtaggtgcagttgtggagaatacgcaacctacacgtagtaccgtttttttttattggagcatccatcagagtcaaacttaaatgcttatttgacctgaatttattttcggcttgaattttgtgttttattaatgtgctatatataggtcaactgtacttatgcaaacctgatggcatgagctgatgagcccccttttttctttcaaaacttctgaagaaaatgacacgcggagctatcttctgaacttttcagttgaaaaactgaagctcgtttttctgcaaaactccgaaacaatgatttgttatttcataacaatagtgataagcagtcttcgctcaggactttcaggttaattaacatactacaaccggtcaacttgaacagcattgcaagtagcactgtggtacgagtgccacctttttattagaacagtacaaatgctgactaatttagcttttataattgttcagagttctaggggcaaataattgaccggtgatttgacttgtcattgaaaatactcccttcgtctcattttaagtgtacctatgagttttcgtgtccaactttaattatccgtcttatttcaatttttttatgattagtatttttattgttattagatgataaaacatgaataatactttatgtatgacttattatttttttaaaaaaaatttcaaacaagataaatgattaaagttggacacgtaaactcatagttgtgtttgaaatgggagagggagtaacaagggagtagtttacaatattacatatagaccccgttcttttctccaacaagagttggatgaagattaagattttcgtgtggcacgtttttcaaactgctaaatggtgtgtttcgtacaaaaactttctatatgaaagttgttctaaaatatcatattaatctattttttcaagtttataataattaaaactcaatcaatcatacgttaataacacctcgttttgcataaaaaacttaatttttattttcatctttatcttcgggagaaaagaacaccaccacactgatacggagcatactgttagccaataagctggacacgtggcacccgtcattaagttgctcccaccaggtaacttcctacgtcccttgtttggatcaccctggcgtcaactgttcgttttgtcaaaccatggcgtcaaataggtgcagtccgaaattcttttggctatgtcaccactagggagtaaattcttagcactttggagtcaaccctcctagctataataacaggagggaaaaattttctttttccacgcaaataaaaagatttatgtataatttgtctttaaaatagatgtagatgaaagtctgggcattgctaaggaaaaattatccgatagtaactaaacgtgaggtacaaagtaaatttgctttgtagttaaactttttgccttcacgtactttacacaatcacatcttgccattatggaaaaataccaatgattcaaatgttaaaaacaatacaggtagtttgataaaaaaaacaaaaacaattgagatgttgtacgtggattcatgctagagacgaagggaacgatttgcaccataaatgaatgatcaaagggttgaaaataattaaagtgatgtgtggctttatgagagaaacgataattatcattaactatactcagtgatgaataactttataattaactttataggattcaaaatgtaactttacacttttgaaacttttcaactcatgttttaaaactttacaaaattgtacgatagtaactaaactttataggagaaaagactatttatttattgttttatagtagaaaattattaaacaacaattaatcgagatacactgtttgaacgaatttacatgtacgtacatgatttatccctggtacaacacacgatggaataacattgtttgttacattatgggttatgtaagctgttgacccacaggattatatcggaactaatctcatatataatacaatcatgtcacatgtgttagagagtactctctccgtcccataaaaactaacctattggatgtgacacattctagtactacgaatctggacatatctttatccatatttattatattagaatatgtcacattcagtcctagctagattcatttcgtttgggacggagggagtaaggacgactattatgttgtagacccatcatataattgtaattgtgattgatgacatgattcaggattctgacaatatattggaaacaacgaagtggatggagtctgttcctacccatggaacaaaaagtaaaggaacaaagggtagggtgtggttaatgggtgatcgatcccatccccctatacgctctctcccccatttctcctccttttcttctttttctactacaccataatttttttaaaaaataaaaaaacaaagttggaaaaacgattatgtatagaaatactatataattttttttgaatttaaatttaaattttaaaccggtatgtaaacttttgacttataaactttgagtctataaactaatatttgaattcaaattcaaatttgaatcgggtatgtaaacttttgacttataaacttttggtatataaactttagttgtatagaaatactatataaaaaaatatttgaattcaaattcaaatttgaatcggatataattcaaattcaaatttgaatcgggtatgtaaacttttgacttataaactttggctctataaactttagatgtatagaaatactatatattaaaaaataattgaattcaaattcaaatttgaatcggatatataaacttttgattgtaaactttagatctctaaactttgtgtataaactttagatgtgtaaacttgaggtgtataaacttttaagtgcataaatttactaaaataggaaagtaatacggtgaaaaaaaaaaaacaggtgtcggaagggagggggatccgtcctagcgatcgattcgcgtgcaacgtgagcgtgacctagcgcacggggcacatgcacggtagcaattccttttggcatggcccatcataggcgaggggtagatttcaagcccattgtctcattatccctatccgttgctgcatatccaggaggtttgggccattcaccgtgaataaagtgcaataagttcactttaggtcctttaatatattgctaagtatgaaattcatccctaacctaaaatactattaatttacaaaaccggatcactcaaggtcctacacaatattatgcccagttttagctgatgtgacatgctgagtaagtgatgtgaaatctggcgccgcgacacacgaaggcatgggaggtctacttaatttcagtgcaggttctaaatcttgatgaggttcggatgtgctagttaatttaatcttgcaactaataaggatgacagaaagaattgaaccaatcaaccgatacagatctgcatcgatccaatggttaaaacgtacatcgactggaagtccaatgcaggtagatttgagtgtatatcgattaaataaccgatacatctgataactaaatcttaaaataatgataactcattggctacagcctcgatgaaacattgcaaaaaaaaagtcctattggcttagggcatctccaacagagggccaaataggttcctaaaaattattttttaggattttggttaaaactaggcctctaacagattgtcaatcacggttctaaaatttacccactcctaaaatcggtgccaatctcatcagaatttgggaagctgtacgccctaccaatcccaccaatcgcgcccattttttttaccgtccgcgccattttttttccgcccgcctcctttttcttctcgctccttcctcgcgtcgttttctttctcgcgagaaacagcgcccacgccgccaggctagggttatgggagctcctcgcgctagctccgtcccgatcgccgtcggctgcctatccaggtcaccgcaagccggccgtccaggtcaccgccggccggccgttcaggtcaccgccggccggacgtacaggtcaccgccgggcgtgcgtccagggctccgacgggcgcttatccgggggattgccggactgccagccgtccatccaggggcagcgtcgccggccgtccgtcaaaggcaccaccacctcgccgtcgaccgtccatccaggttgccccgacgcaacgtgtgctgttactcattcacttcaaggtattttcagagaaacaactttattcttttcaagcttgaagttcctgtactgatttccccacaccgtcaatcccccacatagccatctagttcacagggatatctcccaattttttgatggagatgcaaagctcctcccttaaattgtttaccaaatcactgccacatacctcaattgtagtacttatcttctgaataatgcaataaaaaactgttgtcctgtcctcttcaaatgatttccaatggatcaggcatcggtaaatgaggtatgcggcaataggccttgcaatagagaaacccagatcttcagatatgcacttgatcaacaactcatggatattcagaaaaatatagaagaaaatgttgaggcacaacacctgaacgaattgtgatactgcttgaaaagaagttcagaattactaagcatcatacctgttgctgcttctcagcttcaggatcattcaggccagtcagttgagaattgttctcctagattgaaattaacttttgttaaataaggaactcattttacgaatatactgatcaaatataatttgaggattatactaacatggatgtcacaaaagttactggcctataccaattgttaattcaacagtgtttgcttgcgtttgtgttcagtcagatgcattcttcttcaggttgtatagcaccctaaattaactaaacaatgagcttctatatgtgcagggttttgtttgcttgcagcagtatttgatgaccttttcttagataatttaagtgtttgatgacctgaccagtcagctgctcattggctagatattgctattagcttctagtatcttctgaccttaactttttagccttttgtaatggattcagtgaacatgtctgaattaaattgcagagtcccaagatgctagtacttctacaaacgtattagtagtactgttcttatctgactactaaattaaacaaacatgtactattcgtaggtcctattgataatggaagaagaaggattctatactaatttgatgaatgagggcaacgattccttagattgggatagtttgagtagtatgcctgtggaggatgatatgagtaaccagcttgatgagaatggcatgagtagcgagcctgtcacgcagcagttcccaactgctgagaggactaccgtggctagaccaaatcaaaaaagatcgaagaattttagcgaacaagaagataagatacttgtgtcggcgtggttgcatgtaagtttggatccagtgctaggcacaaatcaaactcgtgctgcatattggactagaatatacgagcacttctacaaaacgagtaaatccacaccagatcgcagccaaaattcacttatgcatcgttgggaaactatacaagagaatgtcaacaagttttgtggatatctgagccagattgagggtagaaggcaaggcggggttagtatacacgacaaggtaatacatagttatgtagcttgtgtttttatgttactttataaataaaaaatgtgatgtttgctaactacattcaccatacttgacttgtgcagattgctcaggcaattgctgtatttaaggagttggaaggaaagccctttcaattccttcactgctggtctctcttgcggtcacaatctaagtggcatgataagatgaagcaaataacatcccagaaaccctgtgccaccaacagacagaagccaagcatagatggttcagcaaaagctacacccacaaatgatgaaactaccaatcatgttggtgaagataatgaacctacagagactgaagagccaaagagaccgatgggtaagaagagagctaaagagcatttgaggcgtggtgaaacatgcacagatgcttttgatcatttgtgggagaaaaaaaaagaagctgatgcagagaagaagaaggagagagatgagaggcaccaaaagtcatatgaactagataagcagaggcttgagttagataaaaaaaagggtcgcgaatgagacggatgagatacagttgaagaggatgttagaagaagagagaattatgacaatggacatttcttccaagcctctctcacagcagcagttctacaagagtgtacaagatgagatcatcgctcgtcgcatgaacagttccggttgataggtttgtgtttcataacagtttacattcagttgagtgcctgtgttcatgcatatacttgttcttgtgtccatcttgttgaaatgctgcctttgcacagttgcactacaccatctgattcttaaatatgttgcatgatccactgatacatgggactacatatatttttaaatatgctgcatgatgcactgccaaatcttggtctgaaccttggtctgtacatgtattctgattcattttcactccatctcattgctatcaacagggaagccaccagatcagagaatgggagggaaggagatggcaatatttggtggcaatcgtacttggagttcagattagttagaaatttacctaggtttactaagtctgtgcaatacaaactatttatattcgcaattgtgtctattttttgtctctaaattaggtgggtttactaagtctatgcaatgcaaactatttaaattcagaattgtctattcagtagttgggtaattccctcatcctgctgtcagtaatgcttctgtctttgttgctgttgacagagtcagaagcctcatatattttgaaatttgtactaatgatcggtcatcttgctgacaagctgatgcatatcttgcaaattatatataagctgaactgtacctatgactaggttgacaagttaaaggaagtgcacttttattaattctcctgtactattcttaaaccgaacagtacaccatttattcaatacatgaaaaacaaattaagatgatttggcaaatcctcacatgtatattatttattacatggaattcaaacatataaataaaacctcaatatttatccggataatgttgccacaagtgctccactaggtcttcacgtagctggtagtgagtttcgtcgtcccttatttttttgtgcatctggataaaatcatcaagatcaggtatttcatcgtgggacactgacattttctcccccctctgggaaccgttcttcccaatcaacttctccctcatcttcaataatcatgttatgcatgataacacaagctttcatgatgtatcctaaggtcttttcatcccaatgtcgagttggccctcgaacaatggcaaatcgagcttgcagaaccccaaaagctcgttcgacatccttccttactgcttcctgtgctttggcaaaatattttctcttgttgccatgtggttctggtatggtcttcacaaatgtggcccaagaaggatatatgccatcagcaagataatatcccatcgtataattgtgaccatttatactatagttcacttcaggagccttgccttcagctagctttgcaaatagcggggatcgatgaagtacattgatatcgttatgagacccaggcataccaaaaaaagcgtgccaaatccagagatcctttgaagcaacggcttctaaaattattgtaggctcgtgcacgtgcccttggtacataccgtgcaattctgtagggcagttcttccacttccaatgcatgcaatctatggagcctaacataccggggaaacctctgtcctcccaagttcaagtaatcgagttgtatcgttctcattgggtgatcttaagtattcatgttcaaaaacttctacaactgctttcacaaaccttctcaggctctctatagcggtactttctgcaataccgagatattcatccaaagcatatgctgctaaaccataagccaactgacgcactgctgcagtgtccttttgatgacaactgaacccaattaaaccagctgcatttctcttctgcacaaaattgtcatcgtgatcctctactgcattcattatgtcgagaaacagaggcctgctcattctattcctgcgaatcataactaatgagacatgcatatctatgcatataacaaaaataaattatataaaatttacttatacaaacctgcgcctgaataaaactgggccataggtaggattatcggaaaaatagtcttggtataatctcaagtgccgtgcttctctgttgcgatcaatcacttcatgtcccatgacagacccaccatgtcttggtgcattgacagagtgccaatagctatggacgatttgtgccgtggcaaaaaaaaaatcatcgtcatcgtcagacgatgattcatccacgagctgttcaaacgaggagcgaggtcgactcatcttggatcaaatcaaccgccaaaccattattcatcataataaattaagtttttccccttgcgacgttgtcagatcaaattaaaaaaaatgtgattgaccttccgtttttccaaatatttattcatcatatcaaattaagtttttttttccatcaagacattgtcagatcagaaacataaaaaaaggaaatagaacaaagtaaaaaacatggttgctagcaaaattttgctactcacgcactgcacaagagcttgtgcctgtcaccaatcgttgctgcttgctgcagttgcctgattgagtgaagtgctaacatcgccggccctgacagaggaagagctctgattgagtgaagtgctaacgccgccggcgctgacagaggaagagctctgtgtgcgtctatagcactgtgtccttcgatcaatttcgtatatcgctgcgtctgatatatagcctcgccaacggtatcagttgcgatctcgcgcgcgactaggatgagcagccatctccttccgtccgcgtgcgtcgcgtcgaccatgcccattcccctccgcatccgcacgccgcgatctcctcctcgcctctcacgcgcgacgcgatctccccctccgctctcgcctgtgattttaacgagcaggtagaaaattagttgggaagggcccactaatgatgatgtggaaaaattttaaaattttgggaaccaaattttagtcatctcttggagaagggggtgtattttaggctaaatatgttcttggctgtctccaatacaggatttttgggagtttaattttagtcatctattggagatgctcttagtagaatcaaacttattagtagcaatataatagatcggacctaactgagacagtataatattgaaaataataagaaaaagatctagttagccgatagatctacaaaaccatgatggatatatcgaaccaatctaaaacaacaatgtgattggaaaaacaataacttactcagaatatcggacctaactgcgagggagtcctaactaaaccgatacgactctaaataacgatgtagttaaaaaatagaaccaatgtatcagatagacaacgattgcaacaacttgaatagaatgtcatacctaactgagaaagttctagccataccgatacaagcgaagttgaggaactacttccttgttggagatcgaaataatgtagcccaactcgaaaaagttctagccataccgatataagcgaagttgacgaaactacttccttgttggagatcgaaacgatgtagcctcacttgatactaagaactcgtcggaataaaaagtggtggtattacaagtggagatgaatagatgatttacaaagaccacaagtgtacgtatttatacgcttgggttgatacaagtcttgatcggacaatagataagacacctaacaagaaaatgaaaataactaatcctttctatttaaaacatataatacacatatgaaactgccctaccgtggttttcaccatatgatcagcttggctggtaccgtgctcggcctagcccattactagaatctagtccgtcgacgtgaagtgctgaaagcttgggccgtttgcctttaaattccgtccggatttgctgaatcaacaaatgcattcgctctgacgccctgctgtcttgtgtgtgcacgtgttcacgttgatctgtcatctttgcagaatttttcatctccatatggaatttcagctatttgttgtgttgggaaaaccaaaggaccatttctgatactccccctattttatattataagattttctagcattacccatattcatatagatgtgaataaatctatacacatatatatctagattcattaacatccatattaatatgtgcaatgttaaaaagttttataatatgaaacggagtcagtaccaaatactgagtcccatgaaacaactcagaacacatgggcatatcggcagggagcaaagggaggctattattcaactgtactcactgatctcataatcacttggctaaaataaaatcacggagaaaaaggcgtgctgctgatagtagaacacaccgactgcaaccgaatcgccacaaattagcaatcatcaacatacaaaagtatattcacgaaaacaagctaaatatcccagaacacaataatttggagaaaattatctctcaaaatgcggcacaacggtctatcatcagcaatgttcactcatgccggccgcacgtacggccggagggagggaacagccacgtccccaagctacccactggccgtaatggcgtcttgaggaacagctgcgaccggcgttccctcatgtcgtagatggtgcagaagaactccaccgtccgccattgctggccgccgtagccatcggcgccacgatcctgcaagaagaagatgcggtccccaatgttgtgtgccttgccctgatggacgtcggggacgacgtggacagaccgggatcaccagcgcccgacgaacggcacgcggtcgccgccgacgctcctcaccttcctccaccgcgaccccgccatgtccgccgcgaacacctcgaacttggtctgcaactctatctgttcggcggaatacaaagggacgtaggaatcgtcgtcgtcgggatacaaaatgacgttggattgttcgtcgtcggagtatgatccctctctcgtgctgtgattctctttgcggaccatgagcaatgcgccgtcggactccaccaggtagagcggcggctcggtgcggcggccggggcttatccggacgaggcaatcgacgctggacacggtcggctcgccgccggcgtggctgccgtcgtcgtcctcgctgatggagatggagaggaggtctccgctgttgacgagggcgtggagctttccttggtaggagaccatgtcttggatctcgagtgcttgcaatctgtcatgcctgcacgaccacgaggctgaccccggccggcacagcaacagctggctcggcctcttgccgacgacagcagcgacgagggtaggcgaacacacgacgagcttctgcagcggcggcggcgtgtcgtgggtgaccggtgggtcggtgggcatcctggggagcaccatggtgttggccgtggagaacgggctcaccagcgtgtacgcgccgtcgcggcgctggaagacgagccactcgccgcaggagctctgggcgtgcggcagctgctggtggcggtggagatggagcggcagccgccggaaggcggagtttggcaggctgtagaaggtccggtcgggcaacgcgagcatgggaattgccggggcagtgggttccgccgcgcgctgatacgccactggcggcagacggcgccgaagcggacgcggtcgccgtggcacaggatgcgaccgaagatctcaccggcgaggtccgtcgagagctccgaccaagatcgtcgtggcgcgtcctctgtcggcgacatgttcggcgacgccgaagacggcgagatataggtttcccgtttccgtgtgtgtggactgtggatggatcgagcgctgacgagacgcgatacgtgtgccgcgcggatacatcatacaagtcgcagctcatcacgacacgcgaattccgatccgaggtcaaattgggagtgctacgcgggaaagtagtttatacatttaggtactagtcccctcgtctcataaaaaaccaaccagtattggatatgacacgtgctaacacatactacgaatctggatactagtatgtgtcatatccagttctagattcgtttttttcgggacggagggagtacaacactaggccagccataaaaaattgaatattcatgacacgttttttaaactgttaaatgatttgttttcatgcgaaaacattttatatggaagttgtattaaaatatcatataaatatatttttcaattttatagtaattaaaactcaattaatcatatgttaataccaccttattttgcgtaaaacatttaatcttcatctacatgaggttcaaataccatgtatgcatgtgatttaggcagctatataaagatttcataaaatttaaaaagttagattataatgatataatatatatactatacaaatgtataagtctaaattcatatataaagaaataaaaataataaattttacatatattgtataggtactatttattgctttgattttattattttttctctagttcgagactaactttagccttgcatatttgtttatagactcatattatcctaattgatgttattactagtatttcttaattcttttataattatctgaatcgcatataaataacaggttgccatgatatctgggagtgggtgtagaaaaaccttgtccactgctcagcccagcccagcccagccgagatagaaggctagcccaccaacgaaggcctgccactttgagtggagtggtggaaaaggagtttaccgaagggcgaaggggacgaccggaggggggaggcggggagtggggagatcgggatcggcgggggggatggcgtcgccggcgaaggagcgcgacggggatgggaggcgggcgcacgcgacgatggttggggtgcagttcatcaacgccgggtaccacgtcatcgccaagcaggcgctcaacgtcggcgtcaaccgcgtcgtcttctgcgtcttccgcgacgtcctcgccctcgccgtgctcgcgcccctcgccttcctccgccaccgcgggtcgccttcgcaggcccgcacgcctctcacctggcgcctcctcgtctccttcttcatccttgggctcacagggtaaaccccacccactcccaacatctcaggtcactgaggtcaggaactcggtagtggagttctgaagcaatgcagctgctatgctctgaaaaattcgtacttcgatgaatccactatgtttttccctgcagcatcttcgccaaccagcttctcttcttgttcggcctcagctacaccaatcccacatacgccgctgcaattcagccttccattcctgtcttcaccttcatcttggccgccctcatggggtcagtctctttctcactggtttgcgacaatgcatatatgttcatgcttctgtttgtcaaggttaagcattcttgtttgtttcagcactgaaacggtgaacctgagcacacatgagggcagggccaagattggtggaacgatcgtctgcgtgatgggggctgttttcatggtgttgtacaggggtcctgctttgttcggtagtggcgagctcgaacttgatgatgctcatagtcatggtgtcattgctgacatgtcacagcctgagccagtcggacccttgtccattgtgtttgggctccaaaagtggcacattggagtgctgtgtttgacagggaactgtctttgtatggctacttatcttgctttccaggtattactgatttttcagcttgttaaagctcaattttgcttgcactctttgatgttttttttttggggatattgggacgcctggaaactttaatttatgataaaagatatgagtagagctagttctgtaagctaagattactatttaaaaagggtgactttagaaccatgaagtttgtcaagatcattttagctggataaatttcagtgttgacaatttcctcaatcatcatagttttgtccctcttgaaatttaggctatttttattcacttcctaaaagggcacatcctaattagccactagttttaaaaaattcttgtatccctctctttccacacttgccaccaggctctgatgattatgccatacaataatctcttcattttattgtcctgttgctacccaaacatgttctatcaatcacacagggttactgattgtgcgtggtcgaattgtctattttaatagattgacgaaattctgcaaggtgatttgtcatgggctgatcagatcatcagattatacttcaccataaaaacaaagactagtcatttacaggagaccatctatctcactgtactttgaaacttatgtttgtgtggtattcaacttgactttagtatcttactcctgtttgagtactgaaacttttatgcgatcagcgtgctctaacctttcttgtttttatacttatcatattcatctatttctttttcaggcgccaattttgatgaagtatccgtgtagtttgtcattgacagcgtactcgtacttttttggtgctgttttaatggtcatttcaggagtttttgcaacaaattgtaaagaagattggactttgactcgatctgagtttggtgctgttgtatatgctgtaagagttatctcaaatttatttaatgctctgacgtgtatgttcttagtgtgcattttgcatggcttaatatccctttggtacatatatatgttagtgctgatgcagtgcattgggttgctgcatgttccttgaattgagattctgcttctatatgtggtcctattgaagaaaccttgcattagtttttacaggccataaaataatttagttgctgcataccgtgcataatattgtttgaatgaaagtgtgttttatcccttgttgcagggattcatttcttctgctaagtgtgttttatcccttgttgcagggattcatttcttctgctcttaatactggtttactgacatgggccaacaaaattttgggccctgctatggtgtcactttatatgcctcttcagccagtggtttctgctctactgtcgaagttttttctgggaagctcagtttaccttgcaaggtaagaacactgttatcactcactctactttttaatcacagttacaattttttaaaaaaactttctcttgcaatgtgaacaatactgttttggtgcctcatggcctcaccttcctggtgtaaatttgtaatgtatgtttgcatattgatgctgagatattggctatttgatgatagatcaatagttcaagcttctagttaatctatcaattgatcagggtacaaatagttttctatcaatccatttttctcatttctgttgatctaaactctgaagttaagatctttgcttgcttgcagtattattggagggtttctgatcatctctggtttatatcttgtcacctgggcccggcatagagaaaagttgacaattggagtaccatatgaaacatgtgcatctgagttgcttgaaagtacttctcatgtcgtaaagagcagaaacatggcctcggtaccctatatatcgctttctaggccgtcaaacgttccacatgaatcataactcttaagaagttggtcactgctatccccttccttactcagaatatagatagagaaagcatgcattagaaaacatgaagtgccgcaaagaagattcaagtgaacgtagttaagactatatgttaacaatgctgtcatctgtccttggcttagttccccatatggcttctcttcagaaaacagcattcttattcttcatttcctaggagaagttgatttgtgtatgagtaaagagaggttatgctcatttagttttgtgagactaacaactctgaggatgctgcctgaattgactgtcctttcaccaaatgcaaagccagctcagaagctccgtcggcttagtgaatccccaacaaggcaacaatacgtatcctgttaacctcctgcatatgtaattactctgtaaacattatacatgtgcgcaagtcagagcggttaaatgacttaaaaatctatgtatctcctaaatgctagtagtacatttgaccagagtacaccatgtactgtataaattcagtcctggaaatcatgcaagttgcaactcttgaattgatgtttttgtgagattgtccgtgtttgtttggaaatctggaattgcttatttttcgaaattcttagtccacatcatatggtcccctgtaacacatgtttatcagcaattggaaagcttcagatgttattatgttttgtatttcaaatcatcgtatgtatatacataattttctcaactgtgtgtgtacagtatcacactacgtttttttcccactacagtaattcgtgatttcatatggaaatgtgcatcggagtcacttgaaagtacttctcatgtcgtaaagagtggaaacatggccgtgccctatatatctctttctaggctgtggaacgttccatatgaatcataactcttaagaagttggtggtctctgctatcacttcctttgggtatatcctgtcctcccttgctcagaacgtagatacagaaagaagtgctgcaaagaagattcaagcgaaggtaggtaagactatgttaacaatgctgtcattatcctcggcttagagtccctatatggccttctcttcagaaacaacatttagttttgtgagactaacaacacttagaggttattctcatttagttttgtgatagtgagactaacaacactgaggttattctcatttagttttgtgatagtgagactaacaacactgtggatgctgcctgaattgactgccctgttaccaaatgcaaagccctctcggcagctccttcggcttgttgaatccccaacaaggcaacaatacgtatccagttacgcttttgcatatgtaatgtaagtactctgtaaattatatttgtgcacaagtcagggcagttaaatgacttaaaaaaaactgtgcatgtcctaaatgcttgttcatttcaccaagtcatgccagttgcaactcttgaaatcgatgtttttgtgagattgttcttgtttgttgcaactctggagttgcttatttttcgaaattcctagtccacatgatggtcctctgtaacacaagtttatcagcacttggaaaacttcagacgttactatgttttgcatctgtgctcgtgtagttaaaatcattctttcatttcatatgtactctacataattttctcgaagtatgtgtgcacttatactacgtgttccacagtaactcgtaatttcgtatggaaaatgtatacgtgaattctatacattgctacgttggtttgtatcattggtgctgtgactggagctcggcctgcgtgacgaacaggccatggaagccgtaggggacgcgtccgggcagctgcacctccgcgacgatctccaggtccggcgaccgcgcgtccatcaccacgaaccggttctcgccggtggcctcgtcgtggacgtagcacaccaagtacccgtcatcctcgttgccgttgccctcgacgtcgtcggccacgaagaacggttcgccggcgaagcacccgggcccgaagtcgcgctgcgccacggtgcagtcgccctcgccggcgcggtcgaagtcgagcttggccacgccgccgatcttgggcgcggggtcgccgacgccgaagtagccgtacctgttgcggcggccgaggaaagccgggttgatcacggggaagtcgaagttcccggcggcgagcggggtgcgcgtgacgacgccggtgcggaggttgatgcgcaccttctcgacgcaggagtgcactagctccatgtgctccagggcgtgctcgatggagaggacgttgggcgccaccagcaccagctcctcgccgccggcctcctcccacgcgttcaccgagtgcatgatgttgaagcccggcacctcgaaccaccgcatctccgactcgtcggtggcgtagcgcgggatcacgccgaggcggggcaccttgccggggtccgaccccacgggcgagccgccgcccaccaccatgtccatgggcttcatcacgatctggatctccgggaagatggcgtaccgctcggtgatggcgaagtcgtgcaggaacgacggctgctgcacggagaagatgggcacgtcggcgcccttgttgccggccgggtcgaaccggaagtacgtcacgaacggcggcacggggccgtagcggaacgcgaagagctcgccggtgacggggtccttcttggggtgcgcggtcatgcccatgacgaggcggccgccgaagtcgcacctgccgtgcgtggtcacctcgccggtgtccgggtggacgcgcacggcgtaggggaggtcggactcgccgagcgcgtagaggcggccggcgaagtaggcgaggctggtgttggcgagcccgacgccctccaacggattcatctgcccggtcaggaccctggccgccacgacggcgccgcgcgccatcccggccacgccgtggaagccggagaagacgttgggcaggacgggcgcgccggcgtcgcgctccacgaggtacttgtacgtctgcacgtagcgcgagcacaggacggggtcgtcgccggacgacgcgggcgacgggaggaggagggagtgcagcatgccgtcgccgtcgaacaggtggtgcggcccgcgcgggaggtgctgcgggttgggcccgttgcggatgtaggcgccgccggcgaggcagcgcgggatggcgccgcgcacgacggggcagggcgtcggcggcagctcgtccacgggcacgaagttgctggtcagcacgttccgcgggtccaccgccggccgaagcgccggcgggtcgatgaacgtgttgatcacctcctccagcgcgttgcagaacgtcatcggcagcgaagcggccgacgccgcggcggcgggggcaggccggcggcgaggccgagactggctcggcgccgccctgccattcgtcgtagcaataacagttctcgtagtcttggtcttggctaccaactgctcgtcctcttgctcggtctgcttcggagtgcgggtggtggtcaccagcggggaggtgagaacggtggtggaggcggcagccgatggcggagcggcggaggcgttcttcttcctgccatagctggggctctgtggagcagcagaagcagcaggagggatgtaggaaagcctcatggacttcatggtgagtgagtgagtgaccgagcagtgagcagggcaaatcctttgcatgctactactactgcactgagttgtgagattaaccgtgcggctatttataaaggcctctcttgctaagagaggctgtccctttcagattcgtgctagaccgggaagaaagatagtacaagtacctcgtgataaagatactaatcactccgtacccatagaagtcgtttaggataatttttaagtcaaactttaaaaatataaatcataaataactatcaagttgttgagcttgaaaatgtaaaaattatatgaatagatttgtcttgaaaaatactttcataaaagtatacatatatcacttttcaataaatatttttaatgaaacaagaagtcaaagttgtgttttggagaccgtgtcgctgtccaaaataacttcctttacgagtacgaagggagtacactactactgtaccacttcagacaagggaaagatacggcgtaattttgtacagttgtacctgtacagttgtacctatgaactatgaagactatttgactagtaaaacctggacgattggcaagacactctagtaagattctcaaaaaaaaaaaaaatcaagaaatggcattagcaagcgcccaatttcaaaaaaaccatcaacaaatacaagttccataaaatgatatcgtgcgagctactttattccaaaaatatcattgccgttaaggtttcgccagcaaccctccgttaagtgctataggatgaacagtgtatttaactgtgtgggatggacgaaaccctaacgacgatgatatttctgggacaaaattatttgtatgatggtatttatagaacccgcactcatcgatggtattttttggatttggttgtttgtcaacgacatttcttgaattttctcgtgctcaaatggaaatatttttcaaaatattgatccctcttttgatagctagttgttttatttcaggaatgagattttcatgaatatgcgtagagtgaatatttctctcaagcaaatagttgctgattggttacaactattgtaattttaatctggacatccttttcctttaagtcttttaaataacctttttcatacttataaaattatactaccgagcaaatgcctagtagttgttcctaaaaaaattactctagtaagaaacttcctctgttttatattataatataagtagtttttacctttttttctaatcaaaactttttaagtttgattaagtttataaaaaaatgcagcaaaattttcaacacaaaacaaacatcggcctgggagatctgctgtgcaggtccaaagattgttgagatgcgggtgtgccagtcagtttggtcctgcaactgacaagatatgtaaacagtagatcaaacagccgatcggctgacaagccgatgtagtgattccagccgatgccgataccaaccgatagcgatagggtttaagcaatcggctatgtgtctaatgtagataatgatataaaggcaatcggctgatgatgatagaatacaacaacaatataatccaatagaaaccaattggctatcaatatgatagaataagcactggtctgaaggctaaagcatacatcggctggaggtccgatgtcataaaatccacaagattagattaaacgataatatctttgttgcgatcggctaaatccaatatgtatgtatatgcaatccttacaagccgatgcaacgtccagataactcatcggctgaaaccccgataaaacccttattggcagtcaaaaagcaagctagagattatggttctaagcacgacttagtagatcaaactcaactgatgcagcactaagtatgaaaagaaacacaatatctagacaatcaagccgttgactgagttttcagggtggtagatgtctaagctaatctaatctagcaacgcgatttagccgataccgacagaaaccctaaaacgagaagcagccgatagagctaaattgatatgctaagactagattaacatagacatatgataaataggtaggcaagtatatcatccaaaccagaacaatccaagagatcgaatgtcctgatgcagccttaaacgacgccgacgtagacgatataattgtctgggccgacggaacattggacttaccccttagccggagatcgaacaccgatgcagccccgcgtcgggtgccaagttccggcggaacgtagaaacaaaagtaaaagtaaaaatggtggcgatgcgccgaattgtattgatcgtgaggatagattacaatgaccctgggtgtacatatttatacccatgggtagatacaagtccttgtcggacaaaaaagaaactttcctaaagataaaaggaaaagataaagtccttataggacactaaacacactttcttaaagataaaagtaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcaagacttcgaagccgatgctgactctaaaccgatgactactccgggcttactaaatttcactgttaacaattatcgaaatatattcaatgttatatttaataaaactaaattggtgttaaaaatgttgctaaatttgaccaaacctaaataaggttgacaaaaaaaaacaaagtgtctataatatgaaactgaaggagtatactataaatctataatcaatctaaaatctggtgtatggatacatgttggatatacccgtgttggtattgcctacctagaataggatatatttgcagtactctacattttcatctccaaaggcaatcagtttttttgagaacaatcatctggttttgcatattttgcgttacaaacagatttcgtatttaatttatggtagcttttaggcagcatgttggatggaggttaactttgcgacaactccatttgccataaggcccataactgggcaagccacacaaagggtgtgttcggcactccatcttctcaacccctctccctcgttttccgcacgcacattttttaaactactaaacggtgcgttttttacaaaaattttctatacgaaagttgcttaataaaatcaaattaatcctttttttaaaaaaagctaatacttaattaatcgtgtgctaatggattgctccgttttccgtgctggatgtttgggttggaaacctgggttgccgaactgagccttaagtgtggccaataatttattggctctaactatgacaaactttgactagaaaaatgagaatatgatgcatgggccaatatgctaatgaagtgtggtttgacttaactgtgacactcaaccaaatattaatctaaaaaattatggcacgcctaaggtttgatgtggcaaaccatggccaccaaccagacagctccgtacctcttctagtatcaaaaaggttattgctaatatttcttttgattctaaataaccattttaaccttctcaactctttcctaaacacaggttattttataacttataagtacctatcataatttctaacacgtttagctcatcaaataaatattgtcaatcttatatataaaaggctcatccttttcagcactgtatgacagtatgaatgaagtataacaaagttcctttagttcctttcttatttcttatgcacaaatctaacacaagttatatctggaattaaggcgagcaaatatgccgacaccaaattaatatgggaaaaactaagaaacgagatgtcagtgagtgcaaataggaaatttttcattgaaatttacgagtttgaagaatgaattaggttaccaagtaaacacaaatagagggagtcgatagtttttaccagaatttttatttctatctaaaagtttcacaaaccatcattttacgaattgggtgtggattggtagggcccacactgtctatatcgactcttctttttactcgtcccctgctaccatacaattttccttggtcgccatcgtccatttccatcttcccttcatataatatctacacagttatgtatgaacatcactagagaaagcacaagtggtatgatggtgaagttgtgggtacataactctactcagcagggtttaaattctggtactcacaaatattacacacatatagatgggctttcaacaagtatttagggagatcagggatgtaacgctggtttatatcacttagagcatgtgttaggggacgcatttgcagatgaaggcgaaataactcatgtaataattagattgataatcaagagattatatatacaggagagagtccaaagccttccatattttaactaccgatttataaaaacaaaaaccagggagagaaggaaagcgactcaaataacccaaaacaacctaagtagtctatcccccctccacacacacacacacacacatacaaatcgtattgggaggacggatgttgagactagaccgatactccgtgaatacggaagtgggtagaccctttgtaaaaacatatacacactgtatagtgtcaggcacatgcagaacgcaaatttcaccaagagctactctcttacgaatgaagtgtaagtcaatctccacatgcttagtccactgatgctaaactggattggaggagagatagacgacagaaatgttatcacagtacaccatggtggcacgctagagtagggatccaagctcagcaagaagctgtcgcaaccaagtagcttcgacaacaccattagcaacggcacggtactcggcttctgcactggagcgagagacaatatgttgacgcttggaagacacgagacaatattatcaccaataaacacaccatagccggaagtggacttgtgtgtatctggacaaccagcccagttagcatcagtgtaaaccaccatctcagctggagaagtttgatggagtaccaagctgtgatcaagaataccatgaagatatcaaataacccgcttaatcaaagcaagatgtggctcccgaggatcatgcatgaaaaggcaaacttcctggacatcgtaagctatatcagggcaagtgaatgtcaaatactatagagcatcaacaacaccataataattagtaggatcagtaacagaggatccatctccagagagtttggagtgcaaaaaaagttcttgatgatatgaggggcaacaatgacgttcttaagaaggaaattacggaagggggtgtctaaagatatagagcaagtgacagtaatagggataacagaaccattgcctacgacaatatgggaaggagtgaccgtacggtgtggagaattagagtgagcaagattaccgacatccaatgtcatgtgatcactagcacaagtgtccatataccagtttgtcgatgatgggggagtcagcgtcatatagttgaatgcactggcgagggtgccctgatcctagtcggcctaaggaggcatggtctggcagtgccagtgtccactgctgagaaggaggcaatccataagtaggtaggccggctgaaaagcccatggcgctagggtgatcgacaacaagagcgtgcagacgaggctgtgatgtgccggggaagaacgagtgcataggtcacaccttggacttagctggcccaaggatgctagaaagtcgacggccagccaggagcagccaacgcgccagtgctaggagagttggtgctgcttgtgttgttgttgtcgccgccattgcttttcttgtgtcgatgattgttcggataattgccgtcagaagt

SEQ ID NO: 10512 - DNA, 7609 bp, Oryza sativa
  unsure (1)..(7609): unsure at all n locations
tagatctatttagattcgtagtaataagatgtgtcatattccgtatttatgagatggagggagtatagaggaacacgtatttcttttttttaagttgatcacaagggaaatttaaatcctgatccctgaatactataggttacagggaacctgtagtcgagaagagctgaatgctgcgtgagctgtagaactgcagataacagatatggctggagcaaaggagatgcgaagcagagagtgaaagagaaatacggtgattcacaaccgacgcaacctggaatcccagcatcatcctgtaggtgaggtttttgttcgtagttgaacgcgtgcacgcaatgtggtgcacgtccaatcataccacacataccatttcagctggcagaccaatcgtcaagtctgtcttgcattcagacgatggcatgatttttttttttaaaaaaagggtcttgtgagaattttttttctgaattcttacatatagaaaaactgaaatgtttccataaaattcatccgctaaatcctacattacacctaaaactgacatctagtaggaagcaaagaatctgcccgatataaccaacagtatcgcctactaatatctgactccaatatcacccccgcaccagaattaatgcaaataatcaggcactggaattgtagcaccacaagaagactccctgtaaaagacatactccctggagtatatagtacagtagttttgctgtagttggttctttgattgcatgggaagtgagtggcgaggatggctgagcccggcaacatccatgtcatgtcacgtgtgccatcgccgccatctccatcgtaaatttatgatcaaatggaatccagtgaaccctgaaacggttgagccgagccacccgtgcattgccttctcttccactccaaccccaaaccgctgccactaatttcgctcacgaaaagcatagggtaaaaaaaaaaatccatgggtttatcccggtaagcttcggctgcttgtgggctgtggctgtgataaattggcgggatcagagcaaccagtaaactgcagcaagaagccaagaagctaaatcgtttcagtggcggatggccagcaagatattcccatgagtgatgagaaagcaacggcggtgacggcgatgcggcaatatctgggggacattttgtgtaggtgtgcattgtgctatctgaatcattggtggtccctgtgctccaacagtaatgcttcgtgttttgttcacaaaaaaagtgcagctcagatgaacagggagctcagggtccccctagattttttttttgggtgaaatttgatcgtgtaaactgccttctcgagaataaagacgttttacactggctttgttcagttttttatgtgtgcatagagttcgagctattgagtacccattttgtcttaattaatctaacaaattatttatgtaaggagtaaatatgaatcatggaatgccttgtacgtaaccaaccaagattaatttttattggttaaacctatgcatcatttaaagtgtgaactaatttcttttggacacgaagtgtatttgatgagaagatttcagaatgatgtatattttggtattcttggtgttgatgtcctttgtgtaaaggatggtcatattgggatagaaggagtattttctaagataaatgtgatatatttcatcaagaaatgatattatggttgctcttggttagaatttcttttattttttgaaccatctattttttttgttttaaaaccaaacccttttaaaacttactttcaaagctggttgggatggcgtgaccaaaaaattcagataataagtttagggatgatttaattttaaaattaaaatttaaaacgttcaaaaataattaaaaagtcgcttggttaatagtcttaacacagacaaatgatcaacaagaaacaacgctgctcaaccaatataaactattctacacccgggatatagaatagctattctataccccctccctcccaagggccaaacccacctcccctcttttctaagagttcaaaacccacctcccaccttagtcaaaggtcagtcaaagcactctccacatcggtcaaagcctggtcaaaccgcctaccaactcccccaccacccacctcttctcagctctcatcttgcggaacagtgcagtaacgcgacagccatcgtacagtaacgttgtgtcttacgtgcagtaacagcattcgaatttagttgaaatatagtcatgacggatctacttttgataatcactttttttctagcatcatggtgcaaacggttttaaaaaaatcatacatcacatgagaaatattgttattcaaagcttcggttttttggatcttgactctccacaagtagtaatactatagcattattactactcgttactactatgtgttgtgcgttactacaatcccatcgcgacgttattgtaagtgtgcagtaagaccataagttttgtagcaacaatgcgtcttactgcaattcttgaatagtgttactgcataaacatgtggtaacgtgtacctgctatgtagtaacactcccactttgtgcggtaacaagtatatttagcatgtgagacttttaaccctttttttttatttctggtttactacaatttcatcatgatgttactgccaaatatgcagtaacgttctgtatgttctacagtaacaaagtgttttactacagttcttagatagtgttactgcataaacatgcagtaatgtataactgtcaggtggtaacgtgtatatgccgtgcaataacacttttacttttgtgcagtaacaagtatatagttagcatacgagactttgaacccatatatatatattttttgtttcaattcctgatttactgtcaaaagtgcagtaacgtcaataacactatattagagggaggataccgattttcttaagaagagggaggaagaatggtttcttgaggagggtgtatgtagatgcattttgaagttctatcctccacatgcagtaacactatagcatcattgtgaaaacggttttaaaaaataatacatatcttgtgagatattgattttcaaatattggcattttgaactttaacactccatatgcagtaacataatatgtaatttgcagtaatatgggtatatacatgcagtaacatgattttaccaaatgtataaaattgttcaaaacactcctacatcaatcagacctcgctcaaagccacctacagactttacctataggctacctattcgatcttcatctcgtaaaaatgacatagtaaaactacgattatcgtgcagtaacatagctacttggaagtggtaacatgcacctattatgtagtaacacttctacttttgtgcagtaacaagtatatggttagcatgtgaggctttaacccatatatttttgtttcgattcctggtctactacaattttacacgacgttactgccagaagtgcagtaacgtcctatgtgttctatggtaacgtcacatgttaatgtacttttacaacaatgttactactgtagcatagtaacatgttatgagtttgggtagtgaaagatattagaattgataatcatattactttctcacacatctttgaacaaatagcattattagatgaattggntagaggaatgtgcttttgactatgacatcatgggttcaagtctttaatttggcaatttattttttattttccgagaaaatgtgtttcggggagaaaagaatagtcttaacacccctccccccctgtctctctctctctctctctatatatatatatatatatatatatatatatatatatatatatatatatatatatatatatatatatatatatatatatatactagtagtgtgtccgtgctaacgctacggtgacaattaatattgcaaatgaaacaaccaaatgacagtgatacaatatgcttggacaatggtatatatatatagagggacgactcttccgtactcccaggtgaaccggtttgaaaaattcaaaaatcaagtatgcatgtccaacggatggaggaaaatcaaccggtggaaaaataattgttctataataattgatccatgcatgtctgtttataatgctaaatgtgcactgctgcagtatactattattttgggagtaagtatatactatacactcgttagattagtttgtactatcagtagtcagtatatactacaaatctgatttcatactcttttttttccttgacagtatatactgcatttctcgatggagcagtatatactactttttatggtttgtgttttttttcttcaaagaagcagtatatgtatttttttttcttagcatacagttagtactactggtagtactatgtactacttattaaatagcagtagcatatacttgttttgacgttgtagtatcattatatgctacattaattcgtcgataaagcagtatatacaattttttttgggtcagtatgtgtatactacattcctaatcacttaatcaagcagtatgtactacttttttttgttcggtcagtatatactgccaagctagcagtggtatatactgtttttttagatagtagcggtatatactgtttttgttttattagtagtaggtatggggttgcttatacattatgaatcacagagcacaccacatctcaagaaaaatcagaatacattaggacttacgagtagcaacatgaaaagaagtacatatctgcaatgacagattcacaaacaaaatcactagaaaaatacataaagcacaaaagccgccatgaaaaccctctttttatctattgtcttgggataaccatactgcttctttaggattctctctaagagtgatattttgaggtgtgaaaagtttggtatctcaaatatttcacacaatatttgtttcttcccatccaattcatcttgagagcaagggataataggttgacctgagcatggcaagctaaaaactgcattgacatcattagaaccgaatggcagctcctggttgacatctttaacaatagcgcatgatttcggatcaactttgctcagttgccatgccccaaactgcatgtgtaccttagtaaggctgtgtttagttcacccccaacttccaactttccatcatatcacatcacatccaaaactttcctacacacgtaaactcccaacttttttttccaaactaccaactttccctaaactttcaacttttttcaggaactaaacacagcctaagcttgatatccaaaagtccatcaaatccaatttcaccaatcaagtccctcttcctatcatcaaagtctttaatgatattcactacgcatttgggctgacacctgcagttgataccaaaggtagtgttgtctttcttttgtctatttaatactctgctttgccgatacctggataccacccgtgcagccgtcttatttaggctgccccttgtgccagaaaccttcaaagcctgcagataatcatttttcattacataaatagacaatactacatggaccagtttatttaaaaattcaacatatacttctgtttaaaaaaaacagcatacactcatatattcatatatgtatggaaaaatgaagtacataatactgagtagcaaattctgcctatgtgtaccccctaaataaaaaaataatcatgtctattgaaaaaaaaagtaagtatatacaaagtttagagcttactgctgtctaaaaaaatcagcttatacctctctatgtaaaagtgcagtatatagttcttcgtaacaaggtccagtatgtaaaccactatggaagagactcagtatatatgtggaaaaatgcagtatatgctatcttctagaaaagttcagtatgtaccacatagaaaattcaatacatactatatgctgtcgtacaacaaagttcagtacaaagcctcccatagaaaaattcagtatatctgtgaaaaattcagtaaatacttgtgcgtatcaaagttcagtctatgaaccactatggaaagattcagtatacatgtggaaaatgcagtatatgctatcgtctaaaaaagttcagtatataccccatagaaaaattcagtacatactatcattcaacagaattcagaaagaacccctccataaaaaaaagagtatatactatcgtctaacaaagttcagtacaaagctccccatataaaaattcagtatatactatcgtctaccagagagttcaggaagaaccctgccatagaaaaattcagtacataataccgtctaacagagttcagtaagtatccctccaaagaaaaaaaatgagtacatactgtggaaaatttagtacgtactaccatctacattttttttgggagggggggtgggggctaaaacagcatttactttatccacccaaaaaaccatcatatgcactaaaaggggaaaaaatagcatctgaaactgagagcgtacatgaaccgaactacacataattgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggaccgcgcgcgcgctcgagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccgacaattcaagccgccgtggtcgtcgtctcctctcctaacgcctctccatcttctcctagggtgtcgccggcgcccgtccgtgcctccgcgtcgccggtcatcgccgctcgtctcttcccacgccg

SEQ ID NO: 10513 - DNA, 1503 bp, Oryza sativa
  unsure (1)..(1503): unsure at all n locations
ccctcccctcgctgacgtcagccttgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagtagtcttatagcctgttttgcttgtgtgctttgtttgtcgcgtaggtttcggccgttttgtcgatccacggtttctcgaagacgttgctgaggtctcgtcagtgcgagagcaaggcaagtcatgaaatacgtttgatcatattgtacccaatttacaaatatcccgcatttctattaaatgttgcattcttttacaatgtaatgtgggatgggtcctaatcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatgattaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttagtcgctgccgtcaaggattgcctgtggagtggagtcgcccgctgctgaagtnnnnnnnnnnnnnnnnnnnnnnnnnnnnnnnnnnnnnn

SEQ ID NO: 10514 - DNA, 695 bp, Oryza sativa
  unsure (1)..(695): unsure at all n locations
gtgaattgaatttaggtgacactatagaagagctatgacgtcgcatgcacgcgtacgtaagcttggatcctctagagcggccgcctactactactatacggctgcgagaagacgacagaagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacgaaaaaaaaaaaaaaaaaaaaaaaaaaaaaagtcgtatcgatgtcgagcgatcatgatgatgatgtcgacccgggaattccggaccggtacctgcaggcgtaccagctttccctatagtgagtcgtattannnnnnnnnnnnnnnnnnnnnnnnnnnnnnnnnnnnnnnnnnnnnnnnnnnnnnnnnnnnnnnnnnnnnnn

SEQ ID NO: 10515 - DNA, 16513 bp, Oryza sativa
gtggtgggaatagcgagggtgttgagagaattgtgaactccctgcacacacagtcgttaacaagtaaagtgaagaggaaggggagattcttttggataggttttcagggtagcaatgctgaatctttttggagaattatagagcctcatgttttgaacaattttgcgagtttagtaacacaggaaggtagcagcataggctctgatggtacccaagataccgacactgattctgacgatgatatgcaaatgtccgatacagaaagagacgagtgaatacaatgttcaggcagtagttattaaaacctgaaggtatatctaaaggggcacaagtctacacatcttatcagagattcagaattttgtaatgcatatttcttgctttgataggcaattacttagtaacatgtagccctggttgatctacctatcttgcaatgccacgatagattagtgcactagacagtcctaggtaagaaagatgggaaagtcatttttgttatccttgctttgtacatgtaaaatgatgtattatacatttgatcagctagctattttcattttcctttgtttttctctgttaaatttaaccttcatgaaattttgcccataccagtatagtccttgaactgtactacttattccatcgtcagcagtattttcagttcattcatttatccgttccatggtttctagcgggtaaaagaatatttagcagaaagaattcaacagggaacaacataagattcacatacacaaatctagaaaaaaagaattcccatctagctatgatcctaagacatggtaaattctctgtttgagttagacatctcacatcatccctacaaatcatcatcctgcaagagcctgttcagcaaggtggtcaggagctcgtccctccgctcagcccttgcctcttccctgaccctcctctgctcctctcgctccatccacgcctgctcgagcatcagcctctcccgctccagcgcctgcatcgactgtctccattgctgctcgatggccgcccgctcctgcgcgtgcctctccagcgcctcctgccgtcgcacgtccagccggtgctgctgctccaggaagtcctgcagtaggccacggatgttgctcgacctcgacgtgccgctgccgccgctcgtcggcttccccgcagccctcatctttcagctccttgccggcagatgcagtaggccgcggtgaacggacgactcggccggccacttgagcttgtgtgcagcagcaggcgtagcagctcgtcccggttcacggccggggagctgtcgctcgatggcgcggtattccctctcgcgtgtggcgcgagggcggtaataaagggggcgcgtcgtacgtgcttacgtgttggcgagtgtggaaggggagaccggcaagggtccgcgtccgtgcaacgcgcacgggacaggagtcagcggccagcaaggcggaacggctacatgcagcagccattggctggattttcatgcgttttccatcgctttctgacgcaatctcaaaactccccgtccagtccgtcgatccgcggccgcggactccgctatcccttcattcacacaccgtcgttacggctggccggtctgaatggcgctggagctcggtcatgtccacacatcggctggcggcgccacgtcatcaatcgaatgggattcctgcgctggacccatccccacattgtcgactcgacgagatctgagaaactctcgacgtatcgaaatctcctggtccttcggctgcacgcgatccgcgacactgaccgctgctcctcggtccgcgtcacgccagcatgaggcgaattgatcacgttcgcgcgcgcgtgcgtgcacgcgaggacgcttgacgtttcacgacgtacatacctccgtgaaaaaacatcgggtgtccggttctcctcgcttgttagaatttgttttggtttagccggcgcgccgtggtgcagctgccggtcagggatggcgaagctcaggggctcagggcctcgggttgcatttgattcgagctgtacttcccctgcacccgcgtcttcccgtggtgacgcgtgctacgggccttgctgtgtgctagtctttgtgtgctaatctccgagttgaacctgtgcaccgcccttgcgtgcagcggtagtcgtcctcggcgtacagatttcagtttctttcgggaaggctggaatgcgtgccgtgcatgcctcccgatctcccgtggtggttgataagcaacattcgtgcagatctcggttttcttttgggaaggctgggatgcgtaccgtgggtgcgtcccatggtggttgatacgcatcattcgtctgccagtctgttcttcatccgatcaacaaaaataccagaaccagtataggcctatatgctagtctcgtcgagtattccacgatttgggagaacagtgggagcacggagaaagccgttcgctcagactcgatggatctcgggattgtgtgtcctaggttgaatctcgatatctaactttctcttggagctagatatttactccatccgttctaacatataagagattttaaacggataggatattttctaatactacgaatctagatatgcttcatgtttagactcatagtattagaaagtgtctcaatcgtccgaaattcattatatttttggatggaggagtatatccctagtcatctcatattccaagggaactcgtaaagctatttttgacattctcagtctaagtcttttagactcagacttagactcatagtattagaaagtgtctcaatcgtccgaaattcattatatttttggacggaggagtatatccctagtcatctcatattccaagggaactcgtaaagctatttttggcattctcagtctgagtctgattaaatctgagtaggtcttcttcaaccatgtcaaatccaatctttctttcctcgccgtgtaggctagggcatgacccctgttgtcgaaacgacaactgcatatgtcgaaagacgtggttactcaatagtggttgaaagtaaagtgtattgattagagaatttttcttggatccccctattacatggccctatgagactatttatagctccttttacaggttcttactactagggttttggttatacaggagaatttacatggttacccttatgaaagggacatttacatgggtacatagtgtaatagaggttcatggactcctaatgggccgttaggcaatcgtcggtccaatggcccctaggcttgttgggccggaaaaggcttcttcggccctcgcggggccaagcttgctttgcgcgcaagttgtcgaaggtctcctgtaggtcggacgtgtggtcgaaagccttgcggctttttacgacgatgtcgtcgacataagcttccacatttcgccccaattgcttgtaaaggaccttgtacatcagcctggcaaaggttgctccggcattcctcagaccgaaaggcatcctgaggtgacaaaaggtgccgaacggtgtgatgaaggctgtcttggggatgtcggccgggttcatgcgaatccgatgatagccggaatatgcatctaggaagctcatgagttcgcagccggctgtcgaatccacgagctggttaatccgtggcaaggggaaatcatccttcggacatgctttgtttaagtatgtgaaatcgacaaaaatgcgccatttgccatttgacttccgcaccagcactagattcgccagccattcaagatgatcgatctcttgaatgacccttgccttgagcaatttttggacttcggcttttgctgcctcctggcgatcaacggacatcttgcgtagcttctgtttccttggcttggcatccggcttgactgccaggtgatgcatgatgagatctgccgaaacacctcccacttcatcagggccccaggcgaagatatcaatgttctttttgagtacctctaggatgttcttagcttcttcttcgcccatgtcgccccccagtgatacgagctttgtggggtcggcatcatcaatctgcatcttgactatcttgtcgtgaggggcgggctttggcgcgtgcttcgcccggtcatgcggttcggcctctacattgtgcactgctctgttgattatggccaaatcaccttttgaagcagccgaaggctgaagccccttaaccacgatcactcctgccgggccgggcatcttgagcttgagataattgtgatgggaaatggctttgaatttgttcaaggttgcacggccgaagatggcgttgtagttgtatgggatgtcgacaacgtcaaacaatacttgctcttcgcgtctgttttcccccgtgccgaaggctactatcaactgtgcttggccaagaacatgaactgcttctccgccgaatcctcggagcgatgtcggtgctggggtaagggcttgggtagtcaaccccatcttggcatatgcttcggcaaagatgacatcagccgaacttcctccgtcgaccaggattcgccggacctcaaaaccagctatctcggctgagatcaccagaggttcttgatgcgggaacattactcctgcggcatcttctgggccaaaaaagatttgctggttcagatactgcggagccccttcgcctgccgaagtgatattgtggaccgttcgcagctgcatcttcttctatcgcttcgacagttggatcggcgggtcggcccttgtaatcacttggatcactctgtgttgcgcatattggcgctgttcggccgggggtgcttgttcttaagctacttcacgagttgcttcagctgctgctccctgctgcgtccttggatcttgcgcgttgccacgttgccgaatgtttcggcattgctctgtggtgtgcgaagagcgtccgtggaaggcgcagtagaggtcttttcggaccttcttgcggacaggctgctgatggttgcttgcttgctgatcgttgaactccttgcggagggcttgcacttcttcgacagccatcacagccttgcccgcacggtcggttctgaacttcctctaggtcatgggggcttgaccttgccttggcggttgtgcttggatctccggctggggctggcgaacaacgagaggagatggtttggcaacttgaacttgttgttgggcttgagcagtggcgacagaagccttatcgtactcagcttgtattgcttgccgtcgcttggaatcctcttcgccccttgcgaacccgtcaatgatgcgaagtaggtgttcaagcgtctgcggctccttgttggcgatttttcttgtgagttcgccctagagtaaaccggccgaagcagcgtttatgacttatgcctcagttatgtcttgaacttggcaccgggcttgcgagaagcgacgcatgtactcccttatcgactcccccggcctctggcgaatgtcgagttgatgctgctgcgtcttcggctcctcataggtgcctcgaaagttaaggacaaagacatcgcgcaattgctcccatgtgtaaatgctattggctggcaaattgaaataccaagagcgggcgatgccgtctagggcgagatgtattacctttgccttggtattttcgtcgccatgagccgcttcgatcgcggattcataaatggagaggaattcctttgggtcagtttcgcctaagtagcgtgggacgggtgggaacttgaactggggtgggattggacgggtcttgattcccccactcagcggtagccccttttcgccccctgcgctgttcacgacaccttgctgcgggtacggcgtggcgaagggcgaaatcacggcttgcgcgtgaggttgggccatggcattcggctgctcggccccgattggtgatgcttgctgagccgccatgaatgggtcgaaagttggctgtgaccatgtcatggtgacctggtttggtgcttggtttgctccgaagcctggcaacattgatagagtcgaactgcggtccttgactccacggcgaagcccctagacctggctgattcgaaggcaagcaactaggcgcaccttgacttgtattcccctccgggcgggccgaaggcgctgtacttgaaatgttgtggggttggctgagctgctgaaggaaagcttggagctgcgcctacagagccgaagccccttctgccattgtttgtggcacttggccaggctgttgaggatgtacttgggcagcgatcggttgagcttgcagttgcacgtgaggggccggatgcgctgctgcggtcgatggctgcccagcgaagtacattggcgcttgcgcgacttgtggcggaaggggctgggtcggcacttgtagatagacttggggtgggacatagcctgccgaatactggaggattggtgccgaagcgaccttggaccgccttgccgcctcgtacgcttgctgctattcttgcatttggcgaagcatgtcttggagtcgtgtcatgttctgtcgcacggcttccatgtcggcttcggtttgtgtctcggggtcagggtagacttgggcttgcacagcggcgagcgcagtttgggccgctgccggctgcgacggagcggcttggggcaccagcagttggcttgtcgaaaggatctccgccctggtctggagtgcccttgccgccgcagccgccttcgccatggcacataggtagcaggggccgaaggcggtagtgatggcgcaggtgcggaagcagatggcgctcccccatcttcggcgataagcgccgaaggctctgctccctcttcggcagccatatccaccccggcgtcgctttcctttcgccttgtaaccttctcctttacgacattcttcggtggcgtttgctctcagtggttttgctcggaggtccccacggtcgacgccaactgttgtcgaaacgacaactgcatacgtcgaaagatgtggttactcaacagtggttgaaagtaaagtgtattgattagagaatttttcttagatccccctattacatggccctatgagactatttatagcccctattacaggttcttactactagggttttggttatacaggggaatttacatggttacccttatgaaagggacatttacatagatacatagtgtaatagaggttcatggactcctgatgggccgttaggcgatcgtcggcccaatggcccctaggcttgatgggccggaaaaggcttcttcggccctcgcgggggcaagcttgctttggcgaagtcgtctcccttcggcatatactcttcgccctacatccttcccccaagaggcctccggcttggcagagtacccgcacgatccttcgcctctcgccgtccttgttccatagtcttcgccattggggggggcttcgccccgactaactttgacgtctcgggcttggatccccactcctcgcatagccttcggcaggttttggtcgaagggcctcatgccataccgccaacaacccctaatctaggtatgtctctagttgtattacccctagcgaaagagggcaatagggatagtggtggcgatgcctggtcagaggtggcggggttttttttcgtcgttgggcccaaggcagtggtcgctttgtttgcaacatccttctcatagagtcgcacatcatcgtgagcagaggccaatgaaagtttgacggcctatgctgaggacgagattaggggtagccagaattcacccaatgattgacctgtgaagccctaaaagtatgaacctccccctccccccccccaaaaaaaaaacttatcataattcacaaatcattagaaaaacatgtgtatgcatttaggcccaattcaacccccattctactcaccgtcggtatgaaacaaaatgcaaccataacctcatgtttccctaattgtcgctgatgggtaccctcaattctccgaccgcatcacacgcacaagacgacctcgtgcatccgcctcccgacacaacttcactatccgctcatgctcacttgcaactctagggcttttgctcccatgcggtggcctccacctccacctcccgagctcccgcaggccgcaacggtgcttcttccattgctacacgcctgctctcatgcatttactttatctttatctcaccatctctcacatggttgcctgtgctacatgtttaggatagaaaaatacgaatataatcctctatgtttagaaagaaaataagcgcgggcgtgccagtgtacctagatacacaatgtaaaataaacacaaaagagacacagaaacacgtgatctttattaattgaattaacaagatacagtttccatgtataatataaaatacgcgcgccattgcctgtcgttggacagatcttgacatcagcggtgtggtcttctggttcctggggtctcgaaagactcccatttaattacctccgcagatctacacctgtaggagaacctccgattaagttgcttgtggtcgtctcgtcgtcttcgcttcacgttctccatgcatgatgaatgttggtgaagatggtggatatatatatgtgggcgccggcaacgcatccacggcctcgtcggtccgtgcgccgatgttggtagcgtagccttccatcggcttcgcccaccctcgtcgctccgcctcatcagtcttgagcgacgtggtggtgtagataggttgatcttcaacatgcatgaaactcgcatagcttggacggtagagacgtcacagtagtagcgtcggaatgatgttaaagggaagaggaattggtgaagtcagttggtgtacacaacagccgaatatacggtggctaggcacctcctggctaggtgagatcaaagtgacgaagagttgacaaagacggttggtgtagacggtagctggattacacatggctgggcacctcttggttcgtcatgtcccttatacaacagggacttgcaatgaagatgttgatgaagaagtcaatgtagacaatagccggatgaacgtggctttagcaccttcggatgatggatctactattgatccagttgatatgatgacgagcccataaaaggggctatataagggcgccggtaacgacggcgaccttggaagaagtaaatgtctcttcggcggaacggccgaggacattgttggtgtagattcagcacgaacggttccctagcatcacagacggcaccattcttgctttatgttgatgaagatgagcaacactccaatacacggacgaacagcgacatcaatctccacgaagaaggagagaatcacgaacgaatgacatcgattcttgacaagagggggaaagcgccacggacggacgacacagatcttgacaaagaggggaaaagcaccatggacggacaacatctcatctcggcataatgaagagaacgcatcacgaacggacgtcacgatatcatgttggtgtggagaggagacgtcacgacgacgccggcttgacgaggtgaagacattgcggacgaacggcgcgatgactgcaaaccatgatgctccggcatgacgaagtgaagggatcatgggccggcggacttgacgacagcgtgcgggcacccagcagtggcactccggcattgcataggttgagtagatgttgatggtgtcgccattctcataggttgcgaccagcaaagtaaggacgctcgacgtcttggcgacgtcgtagcatcaggtagatgcgatcttcggcacgctccggctgggtggcgtcacaacggccttctccggcaggtggcagatgattgttagttgacggagatgagcgctgcttggcagcgcctcagcgactcggcgaagaatagtcatcgcggacggatggcatcacaagtccggcgcgatgaagcagaggtgtagtagccgaacggcacgacgacagtgtgcgggctccgggtagcggcgctccgacaggcgatctcctcgagcggctcaacgacgagtgtaaggaaaatggcaggaccgtcgaagatgattgagtagacatcaatggtgacctaagagaccgcggcgagcgtgaaggcgtcgccggccagtggagtctcggtgagatgtcctcacacagtagagatcacaacgccgacatcctgagagcctggcgtcggtgcgatggtgccggcacaacggcaaactttgacggggtggcactcggcggacagtgtcaccagcagcttgacggggacggcgagcgtctgggcgttgccgataaggtggacgagatgcctcccggttgacgatggggctgctccatcaggatggcgtgggtggctaccggtgtgatgaggatatgttgttcacggacgcgggcagctcagcggagtctgtgtcgttctcgacaagaacttctggatcaacatgacttggcggcgtccgcggctgctccgacgatctccggcgcgccccgacggagtggcgtcacgatggtcttctctggcggacgggtgttggtggtgtcacagcgttgggtacggtagtgacactaccagtggcttgaacgggtgacgtcaatctcgacggaggcttgcgggtgacgtgaatagatcggctggcccagtgaccccgggcgacggcaatacacccgacttctccctggccatgacaacagattggaacgacatcgcctcgctccttcctggcacatgtctcctccttggcgtgcgcgtcctcacgccggacgctggggtgtgctgcagccgtggtaacctggccaccgagcgcacacttcctgtcttagacgccgaggtgcagcagtgaggtcgccggctgccgaggtcaaacgccgttgcttgccgtcggaaggtcgcttcgtgggggccggtagatggatgctggccgtcggcgcgtgcgcgtacgacgtagatggctttctcctcctttggcctcggcctccctgccgggccgagcgccggtgaggctgtgcacgcccgcccgccgcgctggaggcttctctgctatttgatatatgctgtggatgagatgggatcggagtagatgaatatggatgccgatcgcctggcgccgtctcctgggtggctgcatgtaccctcgccgagcgtcagatgctgccggccggcagccaccggtggcgcacacgttggtgtggcgtcgtcggccagcgcgtcctccggccaccggccaactccacatcatggcttcttctcctttgtctgtgctccatgatcaatctgtaaaaagacaataacaaacaaaaggatggagctgtactcgccgacgaatggatgtgtattgatgccgatgttgacgagtagtctacaggctgccggagcaacgcgccgatggttttcccctccgtgatcaatctatggtagtagatcggactgacaccagctcgccggacgccgatgatgtgcgctgatgccgcctctcggcgatctgcccctcccgagggacaccggcgtacgtgatactgcttcgccgccggccggtgtgttgtcgatggatatgagttgaagatggctgggcagagacagatggatgccgatggatagaactgtgtgttgatagattgatctcgatgggagttgattgattgtccatggcctctggctggctggctctcggtggcttttataggcgctaggaaaacctaacggatgggcgcgtatactccagcgccgccggggccacacgcgttggttcgctccgaagcctccggcgacgttgctgcagatcactttcatccgaatcacctggataaggcggagtttgttgcttgggtttatccggcgccagccgcgcacatcagtagcttgcggttgagatatcccgcgtacgcgtgtattctgatatacaatcgcatatatacgatgagaacgaaatgtggccatgggctgccggcccacgggcagcttcacatttccaccgtacgtgtagctagctgttgcttcttaactcagaaatcacgcggtatttctatacgtatacatgcatgtacggtgaatacatatatagcgctcgtgtatgagctgctcacatgtcactcaagtctccttgtgcatgcatgcatacgtacagattagccaagcatgtatatatatggctgaacacacacatggatatagccatatatagatggacatatatatgtagtacgtgcatggctcatgcatcccatgcaattgagcaagctatatacagtctcacatattaacgaatgcgacgatcatagcagctcctttgtttgcttgtcttgataatacaaatactccttggatttataagatcacaaaataccgtcaaacactacaacttattggctcttgtgtaaggtcaaattaagcggtagagaacccgctgggaccaagagtgagggaggcttctctcccaaagaagctagtgctagagttaggggatgaaatcggggaacagatgcagattgccctacccatttcttattgcctaccttataaaggatcccaacatacaatgcggatgcttgagataggatctcgtctcctagcattccgaaacacgtggcgttaagttccaggccaaccaaaacaggccgcgagtggtcgaggtacctcttgagagcgttgtcgaggtgcctcccttccctcttcaaagggatcctctaggtgaaaatcttatccttttgggatgagcgatgacagcatttttaatgttgtgatcttattgaaggcgtcgttttagaggtggctgtgtattcctcagggtgtggtggtgtgtgggcacgtggcgtggtgtgttttctcttttatcgtgagtatagcctcctagtgctataatcttgtattaatttgcttctctcaaagtcttaatacaatgatgcacaactcttttgcgtattcttgggaaaaaaaaacagggcgcgagttgggacctatctcgtctagccagctactccctccgtcccataaaaaatgaatatatgaccagatatgaatattctagtacgatgaatctggaataatgtatgttcagattcgtagtattaggatgtatcacatccgatattaggttggttttttatgagacggaggaagtatacaatacaggacgcccttgcatcataatcctgttccggcctgcccaagtagaaagggcctcacgtagacggtaatcccgttccgtcccaagtatagcaggccgtacatgcgtggcaatcccgttccgttccggcccaacgagaaaatgtggacttaaaccgcagtgccgtaacccgttaaagacacagccagatctctagtcgacacacgccggccgacctccatctctgcagtgccaactgccatgagatgagagtagcaaccgtcttcaagctggacaacacacgaacactaggggggaaatggaaaatggaactcaccttttgaccgaagactagtagacagacatccttcggacattccatttgaaggcaaagacattcggcgagcgatgaattattttacctcgactcgaggtacatgctttcatcaacagttcaaaaagatactactctactccgtagcatcggtttccttctcgagaaacgactcgtcacatgctgacattgccattgggtaccgtggcttttgctggccgcacaacaatgatagttagtactctctccgtcctaaaataagtacagttttacgctatttatgtctaacatttaactatttgtcttatttgaaatttttttatgattactattttatatttttattgttattagataataaaacataaatagtactttatgtgtgactatttttttaaatttttttataaatttttcaaataagacggatggttaaacttttgaggtagtacatgctctcacacagatgcagctgtacctcaagagtcaaggagtcaagacaggattaccattctccatttttacattttcagaaagttacaccaaatgattcgttcgaaaaataaaaaagaaagttacaccaaatgatgaggatggcaatggtttggttcgactccacttgtccattaaactgatatataaatttactctaatgaaattttaggttcactctaaaatttatgtctaaaatgttcaatctaaaacagcttcacatgtataaatggtctaaatttgtgcaaatttgcttctctatataataaatcatttctataaaaatgaactgaatttaataggtttttatattatgaacactgatttaaaatttttggtccaagttttatgcacgtgtagtaaattttctctcggtctattactctgtataataatcatttctatgaaaattaactgaacttgaaaaatttttatagcctgaaaatgagtttaagaatttttgtcccagttttatattgaaaattacttgatctattagtaatatatagttgattcatttggatgtctatgataacctatcaatataatgcatgatctcgtggtggattgatcattatagatcatgaatctagaaaaaatagtttaggctcgatcctactcctccatcctataaaagacgaatctagagctggatataacacctaccctcgtctcaagaaaaaaagtccaattctagctacgaatctggacacatgcgtatccagatttgtagctagaatttatttttttaagatagagtagtatgttcaaatttattatattatgttgtgttacatctcatgttagattgggtttcatgggatgacggagtattaaccattccaatcctgacggaatgaactctgctccattatcctcgcagaaacctttcccgtatttgctctggaggctggacttccactttctgcagagtgcagatgtgcctaacactggcactgtattcaatccccgtgttcactgttcaattcaccaccactgcacgtcttaacgtgcggcatcaatggcaggcgttgcgttgatgacgagatcctggcgtacgcacgcactagatgatacccaaggggaaaaagagaggacacacgagctcacacaagagacgcggcccggcgtggaaaccgaacgggggccgcccactctgcgttttgcatcggcagaggcgcggtggagaaaaaaaaaggccgagcttggatggaaagctccaagcttttgcgctgttcgcttgcctgagccccccgtcccgtcccgtcccctcgcctcggcaagaacaaagagcatgcgagattagatcgagacggcgtatccggtaagcgctgttccatctccggcacaaaagggtgagttcttgggtggttggtttggttatgtgtgttcttctgcagctcgtgtggttttatctgtatctcgttttcgcgctctcgttaggatggcgaatgggggtgtctgcctctcgtgctctgcacttgtctgcgcgctggtgtttctcacggtggatggtgatttcgtggacattacttacgtagcgagcgctgtggccaaaggcgcaggtgtggatgcagctgcttctctgtcattacttgttcattcatactgtattagtatctctttttctctctctctctttcctgaattagtatctcgttgtgctaatgtgcattcgatggtgtgtggtgtgatgtgctagtctgtttggatgggagccccccggcctaccatctcgcccggggttttggctccggcgtgaatagttggctggttcatttcgaggttagttcttgtgaggatagcagtgcaattgtgctactggagcctagaactctactacaaatgtttgcccggctcaattttctgtgtctttcttgcaaatgttagggaggaggatggtgcagcaatgtgacgacctgcctgcaacgcaaacgcactcggttaggatcatcgaagcagatggcaaagcagattgccttctctggaatactgagcaacacccctgattacaacccgggtactgtatttcactagttgtttgaaggaaataatattttgtactatgttgtcctagttctctaccacctcaggaattggactgcctaggctccatgttactacttactttttttttaagataatgttactacttactacttcctccgtttcacaatgtaagactttctagaattgtccacattcatatagatgttaatgaatcacaatgtaagactttctagattcattaacatctatatatgaatgtggacaatgctagaaagtcttataatatgaaacggagggagtagtatagttcacatgcttgatcgattcctgtgcaatcatcaaaaccagatttctacaattggaacaaggtcaaggttcggtactgtgatgggtcatctttcaccggcgatgtggaaaaagtagatcctgtgagtccatagtccattctttcttgattttacagttacaaattgtatgaggattagtgctgctccagtgttaagtttctctttgattttgttccatatggataggcaacaaagcttcactacagaggtgctagggtgtggcaagcagttatggatgatctgcttgcgaaaggaatgaacagtgccaataatgtatgttattcttatgagcataattcttgacaacaagaaggttttcaagactaacgaatttatggcaggctct

SEQ ID NO: 10516 - DNA, 27825 bp, Oryza sativa
ccccccaaaaaaaaacttacctggtatgtaaattacaaattaggatcagaatttaacagagtgaaaagcaaaccatcattttccaaagttctatttcacatatatttgcattgttttctcctatacctaaatacattttgtacaaatgtgctagggatcagcgaagaatttaccttctgcttgcacctccagattgtccccaggcatggtaaggtgtaagcttcaggcagttttacaatacgaatttagacaacagattacacttgaatacttgttaaaaacatgttgctttgaatgcagtgcttttttcctcagaatgaggtgaaacagattcagacacctttgttcattctcaacgcagcgtatgattcctggcaggttatcatctgatccacgttctgcaatacttctatgattatgatccttttagtgttgcccttagataaatatgctttgtagtggcatatgttttggcattgtggctgtgtacatccgatttggatgtagaggccagactttaatccattttctaaaaatatgttttggcattaatttaggtctcgtgtgttacaggtaaggaacatcttggtgccaggatttgcagaccctcatggtaaatggcatagctgtaagcatgatatagatcaatgtcctgcatcgcaacttcaaatcttgcaaggtaggtactagatagtgtattggtatgtaatactgcattttctagttggccagctatcgacccagtttaaaaattgcatggattctaaatgccatcacaggattcagagacgattttctgaaagcactgaaggaacaagggactccctccaccagaggattgtttataaactcatgcttcgtgcattgccaatctgagacgcaggagacatggtttgcatctggttcccccatgcttgaaaccaaagtaatactacatccttcaacttcaacaccacttaactcaaaattaaaccaaagttactactagagccggctactgctagagccagctatctaatgatgatctgacaagagctcttcacacttgtgtagacaatagcggatgcagttggagattggttctacgaccgcaatccgtttcagaagattgattgcccttacccttgcgattcaacctgccacaaccgaatctacgacgacccctcagaagcatagcaattacagaaacctcacctcgtactaccattcatcacattgttatatttgatgcacccttattgctcgcaatagggcaatccgtgggcaaccattgattttcaggaataactgcagatgatggcttaaagctcatctgatgcctggaggctggatgcagcttccaacagtagttacaggtgtctccaacatttgattcgctttgtcggcaatattttgccatatcttcgataatcatcgacaaagtccacattaatgttactgaagtgacattggacgaacacgaaacacgaaaagtttatctggtgaggggatggataatgctattttctcgaaattagctcaaaattcaagtacgttcagtgagattttcgaaatcaaagtggagcctaaccaaactgcgctctgttaacctgtcaacggcgcctcgccgccgccgttgcgcgtccccgccggccatcgatgaagagctccggcgtgagatcccccgtatctccaccgcatatcaccacgtctgcacgtcaacgagtgccagatccatttctgccctcgtcggcgtgacgaacgacggcggacgtacgggcggcgctgatgagcagagcgagggatgcagcacgagctcgaggaggggatgatatttcgtcgattcatgcaccgatcggagtgtgtgaaggagcttcttctagttgatctcgatagactacgttcagattcttcgctctatctagggtgcaggcgtgcggcactgaaggagacaggaggtagaatactgaacacaaagatgtcgacttgcccgatgcctcctaacacagtgccacacttgcacaatcagaggaggggagatgcatgataaatggagcacacacatgtttttcctccgagggaaaatatcactcgctctctcgctttgcaaggctgccagtttatatatctagcggtgtacctactgggagtaaataggtgtcagcgaagcatcttgtctttaatttggatcaatcacacagtagtggtctgatctgatccttttaatgacacggtattattactgggcggattgtagcgtttgtttttttcccctagcgacaagggcttttaacaaatcttcaacgttttgaagcatttgtactggtctggtttgatttgatctgtctaaatcgtcagaagtcacatgaaaagcatggcattctgaaagtaggggctgctcaacttctttttcccgctgggtttttgcagcaggcagaagcctccgctcgatgtataacaaataaaccaaaaacgaaaagaagaaaccaacagagaatgctacaattacagacccataccatacagttctatgagccggagcattgcgaagggatcaattagaggaatgcaacaaactgcaaaatcaacagcccgtaagcaatgcaaccaagagttgcaaatacaaactactaatgcaaccaattgaatggcattcctccagatccatactagaaaatccttccaaaatcctttcctgcaaaggaagacggcagtccgcctgctgtaaaagagtgaccaggccttcctcctgcacaacattcagaattatgtttcagacataaatatgcataccttctatggtttccaaatgcatgcaccgattgaaatgacttttaagctataataggttaataaagataaggcactcgtgaaaaaaaaatggaagatccaattggaaagcaaactatatcaacaggacatacatatctcatgcatgaaggttacaccttttcttttggccattgcagtcccatgtgcaattacaagcctagaccaaacatgtttcaatatactattaaacaaaatttgccaataaactatgtgtactgcaaggccattgttctgaaaattaataccaagattgcaagttttcagtagcacatttagttaagttggatacctcaaaaaaaaattagttaagttggactagaaggccatgccacataaaaaaagaggaccacagatggtagtaaatctagtgctacgatagcttttgcagagtcaatggctataccaacaacacccaattaaataaaacatacaaatgacaacatggaaatattaccccaaggcattccgtcagccatagtagcaggtggaggttctgccatgccataattaggccatacaggctgaccattgtgatgattccccattggacgtaggtagctcgcagtcatatggttataccgctgaaatggttgtccatggcgactttgaaaattcagctgagaatagtttgcattatggtaaccatcataggtcacatggcctgtagaggcactactctctgtaagagttgatgcatggaacaggcggtcacctctataggaaaagcatgaacaatgatcagttaataatactaaatataacaatatggaacccctgacaatatagcaccacccaagaaaattcaaaatattttcagtggtattactctcaataaagcaacacatagaaaacaagattcgtgtaaaagaagcacctcccttatccagttatcccttaagatgtttattgtcatgaaacaaactgttgcactgagaggcattacattttacaccccacagcgtctaataaacgtgtatgaaagctctttcgattctttgtacacatgccatccaaaatgacaatcatacccttacatatgtatataatcaaatccatttgttagcacattacaattttagcatttgtaaaaatggtgaataattaagcagaaaccagcagcacagcacaaggtgggaaaagtgaagtatgctttttttttcctaaagatatgagcgaactatacagagagcaaatcattgtagttggattgtaagcaatctatcagatgaggggtgcctctattatattagctttttatgcgtcggccaaatgtcattacatgaacaaattagaaaacacttaagtacctttgattcatggataaagagtttgagtttgcaatagcatggctttggatatgggccaatctgctggattggtttgtttgaccacttgcatccttcaggtggagatcgctcaacgcatctgatagtgaagtgtcctcttgcagaagtgactcttcgctgcacatcaaaacaaagtgaaaaagatcaacacatgttacattacaaagacaaaactgtatgatgcactgttacctatagtttggatcccaatcagctggatccggtattgatgaggtggaagccagtgtatctgctgacacattggatgagtgcgtaggaggaaaaccaccgtatcgagatggtggaaaggacccatggttcgaagtgtctgttgataaaccactgccagcgcatgtatgtggtctccaactgaaatgaccaggattagggagtgcactttgtgggtaaccagaatgtccacgagcatagccatcaaagtgattactaatggtgccatccccatggtgtccctgagtcagctgagatgtgtattcatgaggcggcattgatataggtgggtgaccaagatttcttcttctattgtattggcctacagcagcagcttttcccaatgagccatgactgctccttgcaggagaagtggaaccatactttcctgtagcagtacttgggatttgcatctgagaatttggtggagtaaattgtgatggacttgccccaagagacataggccctggacacccagggcttaatcgaatgccaccaccatgatagagataagatcgtcgtctaatatctggactagatcccaaaaatgttcctccggcttgtgaatgtaaattgaatccagaagggcctagtggtgaatgatacatgttcacactgttgacatcatagcttccatagctgcttgcaagacctacattgtcattaaagctaccatggctaccgaagctgccacagctgcttccatatgaaaagggaatctttggtgcaaaagcgttattaaatggtaggcctctgttaatgcttccaacctacaaacataatcaacaatatattatgataataattatcttacaactcaccaacttaacaaaagcataagagaacatacttacaacctgaggggaaagaccagcagctaaccagtgacctcctccaggattatgatcaactgctgcaacacgaccaacaggctacaatggcacaacacaacaagacataagtatatgacttacggactacttgtatgaaaaaaagggagcgcttaaggtacaagtattttaaggtttctccacattgtctactccctctgatttcagatatgtcaccattgactagtgcaattataattttgaccacaacaaattttgaatggtggagcatgacgcacaaaagttttgtgatatttagggtgcaacacacttcgttaatatgacatacttttaagtatttgtttttttcaaaaaagacgagctgtcaaagtttgaagatgaatagtacctagtgacaagtatttgaagacagagggagtagtatatagcaatatatagtctgttggtgggaagaaacactgtttcatgtatccatgtttgttataatgtgaaaggaagatatctaaatacctcgttcaattaaatgcagagcaaaaccaaagtcaattgttacaaatgatggtcgttccgtatcaacagtctctaaggagagaaaaattatacagcaggttgtctggaaacaagatcatacttacaattcttggagtctcctggataggctcatatggaccagtaaacgcttcaccagttatgaagggatgatatgaagcctgaaataggttcataattgtgaagtacttccattgattattcaagaagaaaaaaaaatagcgcaataggaaatcaagttaataatttcctaagtaccaaactgacctgcctaaagctcatttatttaacggctacgaaacaaggattccccagcatattcagatattgggattaataagacttcccattcacaatcaaagagtacaaccaaataggaatcaaatgttatcatcagtgaatacctgcaatggtgaccaccgcttattaggatcaaactcaacaagccctctcaagaaatcaaccagtgctaagcgatctgtcttttctgtctctgaatcaaaattgaaataggtgagaagataatgtcaaacctgcaacttcatcataaggactaggatattatcattcaagagactaatactaagaaataattctaagttcaccagtattattagtatcttgcatgattctggtatgtgccagcattgctaacctattgttcatacacctgtttaataaagaactgcaaccggaaataaggtatagttaactaggttgatcatttcccaaaaggtaccgctatagtatgcaacactatcagttctataacaactactgcaacttcctgggcacccattataatttatgccacagtatagtcgtacaccaaaggcaataaaccttaaggcaatgcacaccaaatgaaccacgtattccgcaagaaacgctaattactgggtctgccatattgatcactgctagctgagattgttctagaataaacacagtttcaaaatcagctgtaaacctacttagctccatccttaaaaataagtatcacaaaacatacctggcaagttttccccattcaaattcttccaagggtatgtatatatgagtttgtcaagccttccacgagggaaataccatcttcctacttttggttttttggactccctctgtgttgcaggatgtaaacagggtatagataagtaataatgaagtaaatgtataggacaggacaaatatgtaaccttaaaaaaaataaaaatattacagtttcaatctcctcttcagttaatattctgtacgcactgatagggccattctgcatttcaataccaggataaatacttccaacttgcttaaaaaatctcccagtatttttagcctcccgtagcagatcatctggtggttgtccactgtataagaaaaaggcaaacatgtttaaaaacacttttgaatttccataaaagcaatgttgtaacatttctgaaaagttaagaacagaagtgaaagaactcagacagttacaaagtaattgaatataagttattttcactgtaaattgttggttgtaatgaagaaaagggagggaaaagttcaatcagatgtactaacccgagaatctcaatcatacggcataggacatcgtattctgacgctccaggaaataaaggcaatcctatatatagttcagcgactatacagccaaatgaccacatatcaatggccgtggtatatctagtacttgttaagtttacaaatccagatgttagaattcacaaaagctgcaccacataatgacaaatttaaaatggacataacagagaaaaacaaattaaaagcataagacatttgtgcagctttaaggtatttcctagtgaaaaatagatgtcacacaggatacgggtaaccaagaagtacttccggagatctgtaataccgactctggaaaagaaaaaaaaaaggagaagcttctttaaatcaacaattttactataacatgaattcagagttcacactgatgggtgagtttgaatgaaacctgaatatacgagtaaatggttttaccctccaagcatgctgatccaaaatcaattactttaaccccagctgctgtttttacactgcaaagatatagcgtggatggattaatagcatgcaaacagtgaacaaatcaagtgctgatttgagatgagacaactaactttggagttatgagaatattttccggttttagatcacaatgaataatgccagcgtccttcatgacaaccaatgcatccaatatctgaccaataaagaattagacatagataatatggtaatcaatgcatttaaaattcaaaaattcaagcaccatatgaaaataaaaccttacctgtctagagaaagttcggacatatttcagttgcaaacctcttagactattcctttttagcagctcataactagatgtgggagtttaagtgatacatgaattagttacatggtatataatagattagcgaagagaagtacgacaatcttacaggttatggccaagcatttcaaatgctatacacaaatgattttggtagagaaaaaaatccagcatccggacaatgtggtgttgatcatcaggatcatatttctcattcagctgcaagattgagcatacacagttgtgatgccagtcgttacatacatcaatcacaagtgagtaaatgctaggtaaactactgtaccatgctcaacagtgagacctccatgatagcttgctgataaaaggcaggctgattttttataacctttactgcaacatagctgttagtttctccatcccagcatttagcaacctgtccaaacgtaccttggccaagcatttctttaataacgtacctacttagaacaataaaaagatgagtgcagtccaatctgatgctgttcatagtttaactttagaggtgttttacaatgctctctactggtagtagaaccaatctagatcattttttttctccaatagatcatatctatttatactaccacatcaactactggtagtataataatattttctactggtagtagaactcataaattaatagttgagatcacttctattggcaataatacttgtagtagaatactagagagcaccgtaaaggtactcttaactttaaccatcaggaactctgataaaaaaaatatgaacacaaagttgaattgatcaattggatagctttatcgcctaagttcaataagttgaaaatttgaaagaaactacaatgtgtggcaatatggcagtcctttggacatatttcatcttcccatatttccacatctgagttcttagtataatggagagtcagaatgtgcatacatatttctaacttataacataaaaaacaaaatagtgaaaagagatatatctggtaaaaatgttttgagtgctctaactcactaagaaatggacaacagacacaaatattgaatcacataaaagggttaacaagtcaagaagaaaactaacctccggtccgactttttattaaccaattccaagttgacatacaagatgaggtcagaatttgcattatcaaggccatcattgtgagctggaactgaagggttggtgagaaagcgcttggggttcagtgaatctgagtacttaaactcaggattgcattttccgaaagtttggacaatgtctgtggttaatcttgcaacaaactgcaggaataagaaaatataatttagagtgaagcatcacaagtatatgaagaaggtgtcatacacagttgaacaattgtaacaaaaaaaatgtcacatagactgttccctcatcattttacaatataatacattcagaatatcaacaaagttgaaaattgtccctaaagtattgtgcttacccctggatgagatagcaaagttatgctgccaaaaaataaataccaatttaaaggaacatcttaacttagcaaaaagctaggatcctcaagtcaatttgagttgtgcaatgcctcccattcgctcatgaattatgatcaaagtaattaggaccgcctgtagcagtaaagtacctgttctagtgactatacgattagaagaacaagctaagcaaacaaatctagtgtacattaaacttaacagtgcattcgaatttagcagaaaacaggggtcggatttctggttagcaatgctgagagctttcagaaatgaagtttgtagctgaagaatcaatagaaaatctgagcaatcgaataatctagaccatgcgtgcaagcaataagaaaaaatggcagcaacaatgggtgatcatatgatacagctagttcaagcgaccagagtttaagctattggttccttgcaagcacctgatgctaatcgcattccagctaagtaaccatgtgcgaatagctcaatgcaattgacaattcagcaaagcgaggcctgaccgcagccgcatcaagcaagcatcttaggtagccctgtgagaaggggaaggtgcaggaaacgtacaggcctcttcctgacggagctgaggttgcttgagcgggcggcaagcccattgcgtcgaccggacaacgacgcccccgcccggtccccggccgccgcagcagcagcgaacggaaggaacgccgtggactcactcggcctccacggcggccccgccgcgtccacctcccaggaaacctccatacaccacacgcgcaaccgcctcccagcacccaatcgccgccgcccccgcggagatcaaatgcccaccaccaccacctcagcccaatccacctggctcccggctcccggctcccactaggatcacaccaacacgctcctccaaataagcggcaccagcagcagcagctaagcggccgccggcggagtccagctgcatcctaggcggcggtcatcgcccaatgctcccccctcccccgatccgatctcctccgcccctgcccgctcccgctcccgagcctccgccgggagctcgggaccccggtgaattgggcgcgcggggttttggggagagcacgagaagagacccactcctctacctcgccggattggcgaggggataggctgcggcggcggcggaggcggaggcggaggcggaggaggaggaggaggagtggggaatttggagaggggggcggcgagtcccaatcccctcctccctgtttcgtctcttctctcttccctttccttgctcgtctccgtcacacctccctctcgcctatttttcgctcccttttccgtccagcgattagcttagtacttctatatatttttacgcgtcgagttttttttaattaatcaaagggggtgaaatgacaatgtgcacacagtggtaagcacagcagcaacggcctctaattatcgacgacgccgtcacgtgctccggcccacgctgctttgtcgtccagatggcacggtgaccgtctgatacgttctgatcttcgcgtcatgcggttgtacgtggaaaatgatgaaagaccaactcgtgtttcgttgtgtttttctttttgttaggaggttacacggtaatttcaaatttgttgaccacgttctgaaagtagtacatatttcgccctccggttgtatatggttcgttgctattttgaatggcatgtgaataccattagtgggaaaatatgtgaaatgcattattggtaaaaaaaaatggaaacaacgaaatagtataattgatgtgtgatttattgctattttacaaataaatgtgaacaattgacccaaaagatagaaacgtaggactttttgttgagatagatgtgttacaagacataaagtggttgagtgttcataggtagtcgctagagtacatcaaccctaaagtataaaaaaaccaacaaaaagtggacgcaagtgctagaaaatttgacgtgttaggctgtgttacatatccgacgtaatttcactctatagactagatagatagatacaatcttgtcagtgatattaatacgaaaacaacttaagtagaaatcaatatatttattttcttacaatagatgtgttatgaaacataaagtggattgagtgttcaagatagatagttgctaaaattcatcgacactatagctttaggatgtgtttatatcatcatatgatgctcaaattttaaattattcatgtcatctacaacatagagaaaccaacaagaagttaacgcaagtgctagaaaaattgatatattgggttgtgtgtgtatatattcgatgtgattgacccatcacatggaaagatagataaatgcaatttcgtcattggtaccaatatcaaaacaatgtaaaaatcagcacgttcaaggaacaaaagaaaaaaagagatatgtgttaggtcagcctttgtcagaattggttcgatattcagagttggtagatgtgaaaaggttgttggctttcaattttattccatactttgtatgaataaatcccaagaattgttgaaattaatgcatgacacaggatttgaatatataaccgcagaacatatactatggaaacttgaaaacatttttgttagaagtaaaaaaaatacacatctactcctttcgtttcatattgcaagttgtttgacttttttttctagtgaaactttcttaaatttgatcaagtttacagaaaaaattagcaatatctaaaatatcaaattagtttcattaaatctaatattgaatatattttgataatatgcttgttttgtgttgaaaatactattatatatttttctacaaacttgatcaaacttaaaaatgtttgactaggaaaagatcaaacgacttataatgtaaaatggagggagtagtttagatttaaataaacaatcatccaataagaagtttagatttaaataaacagccatccaataagaacaaactcaactttgattataggatgcaaaaactaaccaaatcgcaaagaaaaacactattctttttttccttatccactattcctcatttgggagcatcaggaaattcaaatttaaagaaaaaaaatcaatcacttttctcatttttttcttttagcgatcagcacaacacgggcgtgatgatccattgaatagagtaggaaaaaaattacaagtaccctataaggcagtagttaggaaagaaataaaaaaaacaccaccacacgcaccgacaacacatatacatactcaagtagaaggctagcattggatcggccaccgctaggctaacaaggaagctacagtcgggaccacccaaaaccaatcccaaacaaccaagcacctaactcaactctgatcacgcctttgggattgaggggggagggtgagaaagaataatggatccgctctccccctacagcccgcctactcatataaactagagcaccgccgcaagaaaacaacgcatatagaggaagcttgcactaactaccagaaggaagttttggcaagggacctccaaaatgacatctccaggaaaatgaacgacgatgagcaccaccgccgctgtccatccagatctcagggaaaccaagacagggttttcccccgacagcctgaccagaggtaaggggattgctcgacaaaaggtcaagcaataaactattcctatatgaaaagaatcaccgagctacataaaaaagaaacatacaatacataaaggtttacaaaaatacatacaaaaagttttcaaactcaaataaaaataaagtaaacccatatatatcaataaaactgcataaaaaagtaaatggcgtattgcacatcgcaacaatttagtgtacaatttttatgtgactggaatttcacaaaaaatcacacaattaaaatatagcaatattcttctcaattttatacttcctttgttttttaacgatggttagtttgaaaatgaactaaccaatgacaagtatcttacaaacgaagatgagtttatttttacaactctggggctgtctaatatcatcttagctatatgtatgatatttttctaagaactgttataccgttgtttgcaggtaccacctagatatggttttcactatacatttatgtgaaactactagcgtagttcttttataaacagttcgtggaactacttccgtggaaaagaaaagaaaaagctcgtgaaactacatggaatttagatctttgataaagcaaggacgccagtggatttgtgggatcagtgtttctccgagcacgggtttctgggcttgtcgcgacgcgacagcagctgacacgttgttttgaccgtcgacgatctcgccgaggagtcgaggagaatgtcgagaccaaaccgagtcacgggcacacgggtgcagttgcaccgtaaaaagctcctgtggagtccacgccgcgaagtcgcagcgcgccacccttctctcccactcccaatctcccatctccaatgccacgccaaaacgccgaccaacgtacggcaagtcagccacacggcgcatgtcaaccctccaaccaaccgggactagcacgctgccagttgccgcgtccgccggccgcgccggcggtgcccgtggacgctcgaggacccgggcgaccgtggaagccgtgacccgtgaacgcctctgcgcttcccctttttttctcaaacgctgaagcattcggcgacggggtcgaccggacgaggtcatcagctcaccggtctctagcccccgtccaggacgccaaatattgacctgacagctgacagcgatacgtccgtgtcgcgttcctctcgccgtgtccctgcaggaaaccgaacgggtcttgctccggaacgagggaagcgagagtgaggtttataaaaccatgcgattatcgtggttatcatatatggtaacattttcaatttttgaaacaatgatatacttcatgataaccatatggttttcgcgataaccgtagtagccacctaaccgcgggactaccacgatagagtggtggcgggcgggacgcacgacgggcgagcgcggcagtggagcggcaacgggggatgagcgcggcggtggcggaccacatatccaagagcagcggggggaggggagaggccaccggctccgcgtggtgcacggcgaccccgaccgtaaccccgtccttgtcatgctcctccccttcgtcgacaagcctcccgaagtcgaggtccatctcggagagctcccctgtgctcgaccgccaccaccgccgtacccctccgggtggctgacgatgctaggagtggcaccaccggcaggagaaggggaagaggcaaaggaggagatggttccttggtcgccgtctgcctccctcgcgcgcaggacgggcgagctcggacgggttcaccggccgcctccccctccctcccaaaccacttcgcttgccacccgccgactactgccgcactcgcttgccgcccgcatccacgctcgcccatcgctgtgcccatcgtcgctccgccaccgcccacattcgcgctcgcccatcgtcgctccgcccgccgcccgcatgccgcctcgcccatcgtcgctccgcccgccgcccgtatccgcggtcgcccatcgtcgctccgcccgccgcccgtatccgcggtcgcccaagagaatgtacagctgacatgtgggctccacatacttttttaaattttttttattaactaggatgccacgtcagcgaaaccatccatatatattatcataggaccttaaatgaatggtttgtgtgagtttagagatacacatttctagtttgtggttaagggatctcaaaatctgttaagttaaggacctccggtgaacttattcccaaacagtttgataaaccctgctcgtcgcacacacacccaagccgtgccatccagcagtcaaccacaggctacggtccaatgcaccgcaacagcacgctttgatcgctgcaaacgttgatgtacgatgcggccaatgctagtagcttttaccatgcatacactatttagcccgttccatacaggacgtattagcaaggtgaacttaaccaactttatgtagccagccagcgcgcagcacagcatgcatcatcatcacaaaccctgtacaactgccaaaaagaaaaacttcacagcttcatgtcctttttcaccacctaagctgcttcacccccttcttcctgacgaccgcgtcgaggctgccgtcgaccaggctgatctggtccatcagcgaccgccggatgtggcccggcggcgtctcggtgatgccggcgaggtacacgtcggaggagaggtcgaacttgagtgtggccagaggggtgttgggcttcttgatcaggtcatcttccagcagaatctctgctaccctggacagtatgctgaatgccaccccaacaagaacccttgagtaggcctccacaatggcatgccccacgtcctgcgtagatatgtagtaagttcgttcaaaaggcaaaaaattcagcaagcagaaccaaaacatgttcagggatttcataaggtttcataatgcattttggacaaaggttacatgctctgcgcgagcacaaatggttgttatgtaatggcgaacttaccacattgtattggatctttacaacttctataaaagttggaggaaggctcgggaatctggatttcagaagctgcataagtgtttcaaccctttctatgcacatggacatcttatcgagttctgatgaactatccttcatgaaattccaggaatgccttcctggggatttcttgctcttttcctctgagatcctttgattccatgcaaaaactgcaccctccaaccggttcatagtctcgagcacggtatgctccgtttttaaactaagagagaggaaaatttcctctatgggaatgtactctgtggttatagcatggtacaagtcttcacccaagccagctctgccagactgcaaaagaatttaagaccatatattcagtacaatcatcaattaaagggagaaaagaagcatgaaattcacagagattgtcatgaagcacaaacaagttaacttgaaatggtacttgccttaggaagagcatccgtgacagctggaggaataggtatctgaagcaggacttcttcattgattgacatcgcagctttgaggatttgatgaaccagcttagcctgaaaaacaagcctatttctctgaaattgagacaaccctatatctggcacacgaggtgatgggagccaccacttcttcgtctgcctcagaccattctttttgccccggccattagctcggctaccactctccacataccaatactctgtgtctaccatcgagtccagcacttcctgcacatttgtggcatgcaggattaggagatacaaactatgacattgcataattaagtgaacgatggtttatgaacattttttgatttgtaaaataaaatgaaaagagatggcaactttgtcagatatgcatgttcatttactagagtgtaacataataataacaaaaacatacaattagcatggaatcaagcttctgaagggcaggaaggttcacattaacatctgaacgtgctttcggggtcataatctgcagtaaaagaaacattagacacagcacttagtgaaattacaggctttattcaatggatctttacctcaaacgtgcacccgtctgctccattttgttttgtaggaaccagctcaaccatgtaggttgtaggagaaagcaaccagtccatttccttccgccacctgacttttttctcttcacagagtggttccagcttccagagttctccaaatatagtggctggcataagaaatgatcattttggtcatgatgataggagtatggaacaaatacttcaaaaaaagaaaggaaagaaagatgatagttcacccaaaaaaattctacaatggacaatatcatagtttccaaacaaatggttaagcatacctgagagattaataatggcattggacaaagccagagcagcacaaacacctctagctcctcctgaagcatcatcaccaagcagtagcttcccaaacttctccttcatggtttcaatgtctgaagcactcaaggtatacgtgattggcttcttccctttgagaggaagtagatggacagcactgagtgtatccaactcgtaaagtgaatgctcctcttgctttctcagtggatggcattgtgaagagaacgaagagctagaaacatctttacttgaggagcaacttgagacttcatcatcaacggaatcagtggttacacacccatctgctcccgttgttgcactaaggccactatcatcgtcataagaggaactgttgataatacagctctcaaggccattgtacgtcatcacccctacatcatttggtattttcaacttattttggcaagattttaaatcattcagatgaccatgcgacataaatttaagaatttccagggagcctgatcttgcgataatgaaaacggtgaataaaattagttataccgccatattacatttaaaatgcacagacatggagatcagggtttggttcagtatactctaatgtgctgattcagaaatacattttaacacaaatatttcccaacgacccaatgattcttttgaagagcacttcacaaataactcaagaaaagtctagcaattatgcactgtacaccgtaatacactcaagatattgagaaaaaaaatgcctttagcatgacagtacgagtatgccattgcaaatgttctgatgttttgccaactccatgtgcttctgtctacagatagtacagtgtgccatctgtaacgcttaatgcctcactccaccgcaatgtacaagctgataattcattccgcttccatacaaactacgctagttcaagcttgctaccactaaaaacctagctcggataagcacaggtaggcacacattaaaccaggctaggttcttgtgacaccacagaacccacaaacagacactcccattgaaagccgatagcttcaaaacattctaagtggtcccttttactgctaaccaccactgagattcccagattcccctgtaagacaaagaaaaaaggttctttatctaccctacagaaaaaaactatgttacactttcacgagatgctcacatggcgcacacgatttatagttctaaattgtagttagtcgttaagtcatactccctactcctccccaacttcctgcctgctcacattgctcagtgctcaccgtctaaaaagcagggtaccactacgttacttctttatcctccaaagtcaatgaagccgcagatgtcgcacttgacccagctgaaagtagctagctggtccccgacacacgccgctccaaaaataaaaggtactagtactagtttctactgcttgtagtcttgtactcctgcactaccactccatgaacaaacacaccagaagctaacggatacaagagagagatcaaaaacgcaaacaaaagagtataaaaatatcactaggctggtaaaagtcaagactagtgtagaccggaagcagttggatagtggcgaggcgtgaatgcggccggcgccgcccggattcgcgtcagatcaagatagcagaggccatgactcgcttgctctctcttgtttgcttttttttactcgtagagtgccgcatctttcgtgactcccatttactcccacgttcctaacgtcagtggctgatggcactgtgctgcagcctccgtcggagaccaagcacatagcagggaggagaggagaggagaggagaggagaggagaggagggcccgtgaggcatgaacagtcgcgttggtcgtgactgctcagtgccaaatctactgctgctgacaccagcgctatcccacactccatgaccctatcacgttcacatctagtactagaagaaaatatatctctgaaaatttttgtttcatcacactactagtgctcctacttctttgctgtatggattttggttgtgcgggtaaaaaaattgtgaagaaaagttaggcagctccaaatcttggccagatttggagcagcaggttgcccggggcttgtagacatgctgcagctaccatcgatccaacaactaacaactactacagctagtagtacttacaaccaactcatgcacttgagaaatgaggaccgaaatgagcaaatacaccgtgaaatgagacaatgcggcagctgtacgcacatgaaccgggcaagaacaccacgaacagaaaaagaaatgtaaaaaaaaaatgaggcaggaaaacaaaaacgggggagattcgagatttcaggcttactgtcaggctcctggtccatgtcgatgctgaagtcctgcggccgccgccggcagcacgccagcgtcttcatcctcattcccctcctcggcagccggtaccggcagtagcagcagtaactgaaaaagagaaccccacagcgtcacgatctgaaacgagcaagttacgacgctggccaccgcatcccttgcaatgaatcccgtgcagccaaagctcaaggatagcgctcgtacaactacggcggcgactggacacgagcgcgcgcggcgagaagaaagatgagacgccgaaacggccaaaaaccccccaaatctttcttccccagttggtcccggtgaagaaaaaaaaagagaaaaggtgcgcgacacgaacgacgccaccagtccaccgctacacacggcaagcgagcaaaacgcaaagcacaaaacacgcgacttttcaggttccaccaccgctaataattagcccatcaaaaaccaaaccccaaacgtagcgagaggagaagctaataaaatccacgagcagatgcggggtaatgatgcgtaatccacggggacgggtttagattagatttgggtcggatcacgctaaccgctcccgtgttgtcctgacgggatttttatggtgcgggatgagcgtcccacctatacgggtttacggctgctgccactgcccactggcccggacgcccggtgacgctgaccggtcagggcagcgaggccgaggagggccgcgcggccgtgcagcgcagcgtccggagggaggatgaggtgtttgaactttgaattttgaactggacggcggtgtgggaggttgaggaaaggaacaggacggggacgtaggctttttgttggccgctttccccaaaggtactagctagctaggcaggcagctgaagtcatggtcatgaaacaaacggaaagccatgacctgatgaagggaaagattggcgtaataaagtgggcggagctgaaaagtttggggattgttcatgctatctttttttttctccctttcttttctttcccggcatcgctgatgcttcacctgcacctgcaccaccctcgcgaggacgccgtttaccagcctagcgacaaaactggcaacaaaactggcttctcgtctactagaccattcggtagctcgctcaccgacattgcaggaagaggaaaatcgcctggactgaacagtgactcgttgaggcagtagagccagaggaagatgagaagtgttgtaccttttgcgggcgtccaaagcgaagaaatcagcagccggagcttagtcctccgccatggatcttcggcgaaggtaagtgaggaggggctcgatcactgaggtagcaaaacgaggccaagagaaggcgaaggtaagtaaaacgagggatcgatcaacgaagtagcaaaacgaagccaagatagacggatgcatggatggagaaatggctgtgcttaccactgtactagtagtaggaggagcgtcggtgaccagaggacgtgtgtgtgtgtgagagagagagagagacctcagaggcactgcactgcactggaggtcgtatggagcaggtaagcgttggtgaaatgcaagggggcagaagaagggggagccggtggagtgtgtgtgaaatggaagctcgaactgtctgactctgtcgagtaataaatgcggcaccgaggaggaggagatgaagaacagaacgcaagcgaagtggcagaggacagtgaggaggaaagtcaggaaaagtagaggaagaggaggaatgcatgtggattcggataaaatattgggccgctgcagcaacggctcgtggtggtggcatcggtccgtaccccttacgtgcatcccgatcccattcctcgcgtttgactttggtgcgttcgtctctcgcggacgggcggccacacccacacccatcgcggttcgcttgcacctgcacgcacaggagcacacggcatccaaagctcctccgctgcaaccgcgcgcggtccgcgacgctggatcgatcggcaacaaccagcgtggggggcatatcgtcattatcccccgtcgcgactgcaacgtgacaacgtgtaaccggtgaaccgtgaaccacccggcttaattcttcgctcttttcacctggccgatcacttcacgacgcactttcgtggccttttcaggccagctttttgcgagggtcagaaatctcccaaatgcgacgtatacagatcgagatgagtatccgaggaaccaggggtgcataccgacgtgtacgcatgcatgtgacccgtgtccaggttttgctacggggcgagcacacggaggagtaatgctcacttttaggatcggaatcctgaatttctgcctggctggagattggagggatatagtcgtatacataaactaatgcatcgattaacaccgaggtattgcaaatagtactggaagtgaggctacagacaaacaatattgcaaatatcgctcgaacaagcaaacatgcacgcaaaactttgttccccctatcagagttttccattgtttaccaccaaactaccccaaatcccaccattcccggatcagctgaaagtactaataatgatctactaccactgatcggttaattgtgtttcgagtactcgattagactgggggaagatccggctatcatggcacatctctctaggattatttagattccaagtcgtcttgtactctatataaactgcccataaggttttgataataaatgtacaaattatactacgatcgaagcctcatgtgtatgtacaggttcgtaataataccatcctagctataaactacccatggagggttaataccaaaaaaaacatagagtaaatttcatagagctacatgtacattgatcaatcatatcacaaaattataacttttgtaatctcaatatgttatggatataaaatataaaatgtgtagttcttaattgataacttcatcactaaatatatagttttacgatatgatattttttaaatctgtagttctgggataaatttaacattaaacctgtagttttacgatacacatagtttgatcaaagtatatgtatttatgtgaatttttttctcaaacttatactgctagtagtaaattggattcaatatagtaaaagtattgaagttgtggcgttggattcaatatttaggcagcattgtggtatatcatttgagatcaatgccaccttgtgagtagtttataactttatataaagcacaaaaaagacttggattttaaacaatcatatagagatgtgatagaaattagagaaaatcccctgtgtacccttgaaagttcacctaatcccttctgtacccctgaattttgctcaatcccttacatacccctgaattttagtttggatctcttccatgccctttccgctagttgaccgttagttgaccgttaaattcttatgaaaaagtccattttgccctttggtataaagaagcatataaattaatagagtatattgttggagcatagaaatttgttatatgagactattatgtttatgagatagttatgcaccatattatttgcgataaatatacttttagatatgacataaaaaattaatacttatttattagttattaaaagattttttttagcatatgtgttctgaagtaataaacaaatctgttgtattactatgaaaacacatatgttacataaaagaacttttaataactaataataaataagtatcaactttttatatcatatgtaaaagtaaatttgtcacaaataatatggggcatcacatactcataaatataatagtcccatccaataaatttttacattccaacaatatacttcattaatttattatgtttcttcatagcaaagggcaaaatggactttttcaaaagaatttaacggtcaactaacggtcaactagcggaaagggcatagaagggatccaaactaaaattcaggggtatgtaagggattgagcaaaattcaggggtatagaagggattaggtgaactttcatgggtacataggggattttctctagaaattaacactgtccacaatgaaaactgaatcatttctggcctgtcaactgacttttccaggtaggaggcttgcaatcatgtggagtagaagcggtgtaacgcaggccttgcttagttccaaatttttttcttcaaacttcaaactttttcatcacatcaaaactattttacacacgtaaacttccaacttttacatcacatcgttccaatttcaactaaactttaaattttagcgtgaactaaacacacccgtagttcatcagcaaaacgagaacatctagatagggaacgaagcccttgtttagttcccaattttttcttcaaacttccaacttttccatcacattaagactttcctacacatataaacttttaactttttttttaaacttttaattttagtcaaacttcctattttaacgtgaaactaaacacacccaaaccgagaaaaaatgctacagatctcatagcattgtgaatcactgtagagggtccagctagccaatgccacatctggaataaccagcgtcgtttagttctaaaatatttctttaaacttttaacttttccatcacattaaaatttttctacacacataaactttcaacttttccatcacattgttctaatttcaaccgaactttcaattttaacgtgaacttaacacaacccggatctaatcgacgacagggtgacaaagcagccgtacgactcagatttggccgcatcttctcctctgttacatgccgcgcctacgcatataattaacaacgtcataattaaacgatcacctcaggcatgaacgcttgaacgcgcttgcattctctgcaaccaacctctcgtaatgcgtccccaggtagataatgatacagccaaggtagccaatcaacacatacgcgtagcatctttgcactgcacggtcacatgcgaacgagtaccttcagacgcgagggcacgcgacgagatcgagcataaatgcatgtgtaatgcggcaacgtacgaacgattcgagtggcagctagtgcgcggtccaagccaccgctctggccgctcgcgcctagcttgtccggtactccggtatagctaagcgatcgaccacgcggagcggacacgccacacatgcaatacatgcaaacacatcgccgttttcccccatgcacggcgcagtcgccatcgggacgggagcagcaaggctctcgctccgtgcaacttagtactactgaattctcacttcctggctcgtacaactgcacgagacgccttccagctgaagcaacccgggcggctgggccgtggacaagcggaggtggggaagtggacctcgtcgtcgtcgtcgcaacgggaggatttggtgcatcgatcggcaggagcggggcgtgtctgtccgcgcgcggcgtcgtgcgtgccgggaccggagcctcaccgcgcgcgctgcgtacgatatagcgtggagttgggccggttttttatggtaactttcatggcgacatatgagaggaaacagagatcggatcggtgttgcgcggaaatccattaacgggacaggggacgggccaacggcgcacgtacgggcgttcacgatagtggctctagttggaagtgagtgacgagggcgtcaattattgtcggagatggagacttagagcttatgatctatctgtcccggatcgtctggttgcatatatggagaaggcaacaaatgttaatccaccggtcactgttactatgtcctccgaaatgaagcccggtgtcttccatggagtaggacaaggtcacgtacagacatcgagaggaatgcgtagcggctaagctgccaagtataactgcgtggccgcgtacaactgtaactcgagtgtcctgatctactcctctgccaggagaagccaaaaccagttattctgttaatttgacagcgttgcacacgctcgccatttgtagctctgcaccattcgtaggtacattcgctgtcgcgggtggttgttgcacgagttgctgtttaccttcggcctttggctttttggcagcgttgcacgctcgcctagccggccggctggccgaaccgactgatgcgcaggcaggacaacgtgctgaggaccacgggcgccaatgcaccgtgagtcgtcgcgcgggaggactcgtggattgatgaagcccggccaggtttttcatgtacctcgtcctcccggtacagtatatgggcataggggagaatgaagcctgcgcccctccaaccaggccagtgcaactgttcaaggaggaaaagtaggtgatttctctgcaggtaaatttgctcgttcgccttctccttttttaaaaaactttttttgaaaacttcgccttctcctccgttgcctcaaagtaattttggcgtttgacgttgaagcatactgaactgaatggtctgcgtttctccattagctttagcctttttagccgggtcggacgaaagaaaacggccaagcaaatttcattaagaccaggaagggagcttattagaaattacatgatatcaatagaacgctgtagagaggcgtggtccaacctcaaccaatcactagtaacctcaacatttcgcactacaggaactacttctttcaagaattaaacctcgttttgatttccctgaatagttaccatggcgtgcgaggtcgtcctttcgagcaccctagcatttcttttcttccgaatcagccaacataccaacatgaagaaggtggcaaaggattttcctatagctcgtctgaaaagcccaccttgctaccagccagaaggcaccaatcactcaaataatcctgccccagctctccaagaagttagaaagaaacaccgccttttgatagcctccaaaccctgttagtgtaggtcagtaggtgtaaaaagaaaaactgttactgtaagcacatgaaactaatagatatgcttgcgatattcttcatcaactgagatacacgagtgacaacttcgttgatgatatcaatttttttaggaggttataaactgtgaggcattttccctggattgctagccagacgaagaattcgacgtttgatggcactctcgtcttagccttgatctcaccttagcccgcccactgttgcagaaaacataataccgttcaacgattaattagaatgcaggtaatcgaagttatacgaaaatcttgtgtttgcagatatatgtatatattttataatactatgttcttctttgacttgaagattcagtccctgctctattttattaggcaaaatttgctacaggacaccgaaagattgtggcctttactgtgagacactaaaagatcgtgtatttgctcatggacactgtaaaaatatggtaattagctactggacactcctcccattattttattttttcagttgaaatggagagagaaagagttgtgtaagtaccaaaataccctttgacactgttcttcctctctctctcttcttttcttttccccttcttcctcgcggcggcccagatgtcgtcgtccaacacagactcctccgacgagtgcctcacgctgccaccgcaccgcacgaacagcatcctgacctttgtcagcctcaccatcgccatcgcgtcgtgcctcgtgccgctcatcagcaccggcgtctcaccgccagcgcggcgcacgcttggcagtgccgccgccgccgactgcgtcgttgccacgcgacgcctctggcgggacttccccttctccggcctcttctccctcgtcggtgcgctccttgcccttctcgttgacctctccgccttgtcccacctcaaacccatggccaccagcacgcggaggcgccgccgcccccaccaaccctatgttccaatc

SEQ ID NO: 10517 - DNA, 6615 bp, Oryza sativa
tgcagcaaattttgccattttatttctccgtccgtcccaaaatataaacatttctagaatagtgccaagtcaaactgttttaattttgactattaatagcgataaattaaaaaagataaatcatgtaaatttaatgttactatcatagtatgcaagtctttttatttaaaatattttacttttgtagtcatttttggttaaagtagcatttcgaagaccgtgttaaggcctgtgtgtataggatacgctgcccattgaacctggtcggtcctccttgtgtgcagctcgatctcctggacgtcgtcccacggaactaggtactcactccgtactcaccaatcgctctatattggagggtgccacttgtatatcagtatatcacgttcctaacaattatcacgctgcctttgtgccactgtaaaccttggcctaactacatgactgaacaaggacggcattgagagctggatgccccgcgccgtttccaacgacaaacagtcgaccaatcagccttccaaaagttagttccgtgccgtttccaacgacaaaccttgttgattctcaaaacatgtttccaaatccctcgctgagttgtaacattttccacggtcgatcatgatgctcaagtgatttcattagccatttttttaaaaaaatatagtacaaacacaaccactcacaacgtgcgtacacttatcatctgaacgtacacacgcacatcattcacctataaacacatcttaaaaaaaactggtcagcatgtattgaggttgatagtcactatggacgcatcgctgtgtcttgagattgatgaagtcaccatgaacgcctcgctattgatggatatatttagaacttgaacccaggtaagctaaggctgcgttcgttacctcccgttcccaacttccctcactcgttttccgcgcgtacgcttttcaaactgctaaagggtgtttttttgcaaaaaaaaaataattaaaaaaatcatattaatccatttttgaaaaaatagcaaatacttaattaatcacttgttaatcgctgctccgttttccgagccaggacaaccctcactcccaaaagcagcctaaatccaccataagaaaattaacccgttgagttacactcacttcgcctttcactagccactttaaccacaaaaccttttagaacagtttcagatccttgatgcacggataatatcagttgcatacacatggagctctatgctattaccgtccatcataaaataactttattttttatccatttcatatgccaacataaaactaaaaaaactaaaataccttattttatcaaatcgtaatgtaactatttctcactttatccactctcaatgtaactaaaataccttattttttatccactttcaatgtattttatcttctacttttatacaaactcggatgcaatggttgcttgaaaatgaactaattttatgatagatgggaggaaaaacatataatattactgtaggatagggagaggtaccaactaccaaacaatgccctcattaacctcctcctgcctcttccacaagaagactttgattggtcaccgggaaagttgcagcaccaaaagaaaatgcactgccaaagttaacaacatttcacaagggttgtcacctggatagcatctttggcttcgttccaacaactttctttggcgaggtttagtactctgggaactttaataatagatggcacaattaaaatttaaaaaaaccacaacccacaaaaaacacaatccatatttattccacgtatgaaacccaagccactgaagtgtgagggcgttgatgatacaacgacaagtttattttacgggggtttacaagacagaacttagttgctcttttgtttttattcactgaaaatacttacaaagtgaaagttcgtcggcaaaataaaagagcatcactgttcactcaaggcaagccatgaaaaaaagactcacgcatgacatcaggaaatgaactcacaattcagaaaacctataacaaacaacaaacttgtacagtttcgtgagcgacagtctttgcacttcgagaagatcaaggaccgatgcagatggcttttaaatatgctaccgagtgcaccagtaatctctacgtcgcgcctcaagttgccaaaactattatcacaattagcaagacaaccccgaagatcaccagaagaatgcagagctgcaaacaagatgatttatcaaggtagagaaatggttacaatagcaaaagcttaagaaatttgcactagcctgaacataccagtgatgaattcgatttctgagtcttggacgctttcgcgagttctgtctttgcctctttggttgctgctgcagaattctcaatgtttgtatcgatttcctctgtaataaaagatgtacgtgttaactaggaagcacaggaacaacacatgatatgtacagtgcaatgtaaaacttgccgattgtaactccttgaatatgcacaagtgtagcaagatccttaaatgcttcatgtacttcaccaatctgttgttgaatatcttgaatagcttgctccctttcctcaatgatagcttcattgaaaacaatttcattatccaattgcagcacctcttgcctgaagaaaaacatgataacttagcagagatgtaaggaaaagtgattctaccaaatcttgcatgtcgtattttatcaccatgaatatcaatcaaaataagatgcaactctttttcttcagggtcacatcaaagacagccttgtctagtcaaaattctctccatccttctctaatgtagaaaaggctctcagttcatgcgacaagcaatctgtgtgaagtaccaacatgtggaaggcaatctgtgtaaagtaccaacactgcaatttactgtaactgccacacaatctaggctcggtcaaaataatgcatggccacttggcctatgtattccagcagaagcatttgatctaacagattttaggtgcatgtactctcccaaaaagacatagaaagtgtgccaggtatataattcatgaggtgatatactgcccatgagataaatgacgtgccacgcgacttatgtaagttccatgcaccacagatgaaaactcagccacaggaagtcactaaaattgaatattttctgatgggatagaatgaaaaaacatgcgctatacgattaaagctgaccttccaccagtaagtactaaatcactagttgaaaaaataagcagaaaaagaagagctatgagaacactgacctctttgattctgcgagtagcgcatgctgttcatgaattttaccagaatccctggcttctataccacctgtagtatagctacatcatagtgaccaaaattctcaaagatattagaagataacccagtcaactctgcacatgaatacctttagttttaagataaaccatgtcactaaatgaggtcatcaggtaaactgcaagtaaaacggatggtcatgacactgacaaagagaaggcaatgtgtctttaaattagttaaattgtatgtttttacaatgcaaaataataagacccatctccatacttcaaaggaagagaagctaatggagcaataacataggcaaagttatatgacctattcaaagaaaaaaatgccaatataagctaggcagaatcctagaaggttgcagcataagcaaatgaaatggatcatgatgaacacagtaacaaactatgccaaaaagttgtgagaagtattacttggccaatggttcacatagggctagtttggtttgaaaccctatcaaaatactggtaccaaaccttgggtaaattttggcactaccaaatttttgatagcatagatttggctccactctattgatttggcaaaaattggctccaatccaaaatgctaacatgcactattcaaaactaccaaagaattggtagggcaaaaattggcaccaaaccaaaatggcccatacacaacagtatcagattattcaactttttttaagataatagaaatggtttacatctccagcctctgccgacaatcagattattcaaccaaactcttttatcaagcaatgagggcaaaggaattggttattactatactagtaactagcatggtggcccgtgcagattgcggctagcatctatattttatctcatataatagcatatatgttttctcaatttattattaaaatatattaaaatgacaacataattttaaattttgtactaactttacgaaactactaatgtgtaatattcatattgtattttatatacgtgttagttattaattatttttaatatcaaattttagttatttctaaattatattcctatatggactctagactcgtctttcaatatttcttatttttaattccaaattttcgttatctgtaaattgtatttctatatagactctacgctcttcttccaatattatttatttttaattctgattttttttttgtttctaattgtatttctatgtggtctctaaactcatctttcaatattctttaattttttatttcgaatttcagttacttctaaattgtatttttatacggattctaaactctacttttagttttattatgtttattccgaattttagttagttttaaattcctatatggactctaaactcatctttcaatattccttattttttttaattccgaatttctattatttcttaattgtatttctatatggactctatactcttcttctaaaattcttttttttttattccgaatttcagttatttctaaattgtatttctatatggactctagtctcctcttccaatattccttattttttaattccgaatttcaagtatttctaaattgtatttccatatggactctgtttttctttttctccgattaatatgagaatttctaggccgtgagagcgaacgtggaggctcctttttatattcctttttatagatagataaatagatagatttgttagaatccatgtggaagccactgataagtaacatgtgcatgtaaattaacttctacacatggccattcgtcggtatactattaaaaaccaatggcatatcatggcaggaaaatgaaacaatcaaacaatacagagaaaagtttgagatgaatcgaatgaaaagtgtacaagcattactttggctgagatgtctggggaacaactggcttatatgccatctccctttgaatcgcaagattttgaagttttccatactcctccatcgtcgtggcaaaatccttggcaagcttcatgtcagcaaccctcttgtctgcctgcacatgatacccagattcctaatcactatggtagctaagtaaactaagagcagaaagatgcatacatgatcacacatatagttggaaacagtcttgtccaagacaaattcactgggctaaaacaaagggtataaataaacagtaaattactactaacactagtatcggcgttcttgtctgcctcagcagctctcctgagcttctccttcgcatcctttgccaattgaagaatgttatgactagtcttctgcctgtggagaaatcaaccaatcagaacaccagagtgatggtaaacgacatgcctcgagggcatgagctaccaaccatcacaatttcgatcaattaacttgagctgagccaaaaaaataataataatcgcgagcatctagcattctaggacatgaaacgtgtagaggcaaacaacaattaaaggagtgaggagtgggggggagcgaggagagacagctggtcacgaagggcgggggtgtccttgggcgtcccgagcgagttgaggaggcggcggtaggaggccacggcggtggtgatctggaagacgagcgcgcgcgtggcgtcggggccccgcgccctcctgggcgcccgcaccgcgccggcctccagatccgcgaagctcatcgctgatcccccccggcctttctcctcgcgcgcgcgcgcgcgtccgatccccctcgcctcgttacgccgccgaggtgccccgcggctgcgcagggtacggcgccgggtagcgaaggtggtggtggtcctggtggaggcggcagagcggagaatacactagggtagagtcgccatcgccaccggccacgcacagttgcaggcaagagttctttattgttccatggatcaaagcgatgctacaggtggaggtggtggagtcgtggagatggccgcacagccacgaacggaacagtgtccgcccgcgggctcgatccgcggtcgcagtttgggcgtggtgcttggcatgaagccatcaactgcggaataagtccattttgcctccctcatctcttgcgcttgtgtaaataacatccccaaccggaaaaccgggtataatgcctccttcatctatgaaaaccagagcaaatcacctctctcggtggttttgctggcggtttcgtccgacgtgacgttgttgacccggttgacaagctgactcagcgtggtgggactcacatgtcagtgtgcagcgatgtcatcttggaccgacagcagttgaccaccggggagatcgacggccggcgacgcacgacggcgagccgacgaacggcggcgaggtaggagtagcgggaaa

SEQ ID NO: 10518 - DNA, 2118 bp, Oryza sativa
cgctgcacgtgctcgaccccttcgcggctgcggccgtgcccgccgctaccgaggctccgttcggggaggccgccatcgccgtggtcggagcggcgacggaggaggcaacctcgacgctgatcgacgactccccgcagcaagcagctgccccaccatctcctcctgctacttcttctgtctttgccaactggatctggactccacgacgccaccgcagctgtccaccttgccaacgccactacacccggtgcaccacctcgtgccctcgtgagccacgcccatgccgctgcgtcgcctctgccatcaccactgtgcacccatccttccttctcttcgaagccactgcaataaaatcccccacaaaaaatccccaaacacatcatcctccccatttcacttaccattcaccgccgccaccatcgcctcccagtccccaccatcggcccgagcgccgccccgcgcgcggctattaggcccgcacaggcgctgcctccgcctccgccgaaaccgccgtcgccgccggtttcttcttcctccggggcgccgcctcctcgcgcgctcctttgactagccgtcttcatcaggccgtcgttatcgcgtcgtggccgccttcgggcgccaaccgcctatgcctcgccgccaccatcgcctccccagtccccaccatcggcccgagcgccaccccgcgcgcggccagtcggcccgcacgggcgccgcctccgcctccgccgaaaccgcctctgccttgccgcccttctcggtcgccgcgccggccgccatcgccgtcgccgcgccgactgccgccgtcgccacgcccatcgccgcccagcgccggctctgtctcagcatcgacaggaagagcagagagaagaatcgagaggagaagaaaacgagaagaagggaaaacgtgggtcccaccatttttttattattttctgtgtgagaatgacatgtgggtcccactacgctgagtcagcttgtcaaccgggtcaacaacgccacgtcggacgaaaccgccagcaaaaccactgagggaggtgatttgctctggtttgagagatgaaggagacgttatacccggttttccggttgggggatgttatttacacaagcacaagagatgagggacgcacaatggacttattccatcaacagccggtggaacacacggaaaagttttaggccggcctaatcgactgtatgtaagcagttgggcccatcatgatatctctcgggaataagttcaccggaggtccctcgaggtcccttaacctcgccctaaactcattcacaggagctcccttggcagtataggtggtttcgcgtacgtggcaccctagtcagaaaaataaataaataaagtacgtggggcccacatgtaagtgagagaaaacggtgcgggccccacatcccttctattttcccctttcttctcttctatcgtcttcttcgacgaccgagacgggtggggcaacggccggcgagagcggcggcggcggcggagggcgagtgtggccgcggcaggcgaagctggcaagagcgactgcgggcgaccccggcgggaggtgggggcgggatccaggacgggctcctgctccgggaggggattcccgcggtgacggatatgtcgccgccggtggcggaggaatcaaaagggggtggcggtcgaatgccgagcgcccaaggtcgggcatgagcttgccggggatgctcatgaggtcgaagaacggcaggtcgccgggctatgggcagaacggagacgggcggcgcggcggcacgcgaagcggcgttggacggcggcgggcgagcggaaggcaagcgcgacgggctgtgggcagagcggacggcaagcgagcggacgagcatggcaggcggaggagggggccgcaacggcggaggtggccgaaggaggagcgtggcggcctactccgccggtcgcgtcgtcgttggcggcgagagcggcacacaaagtggacagagcgaacgagcacgtcgttcttgccgctggtacccgtcgccgccgtcgcactccttggaggagcccagcgtggtggcgtgccgcagcggcgggaacggacggagcggggggagatgaggccggcgggaggggggaaagag

SEQ ID NO: 10519 - DNA, 9907 bp, Oryza sativa
tttgctccgcccgcgcccggagacgccgctgctccgcttgctccggccatgcaccgcccacgctcggagccgccgctggcccgcagtcgcgcttggccgctgcttgtcgccgccgcagccgcgctcgcccagacactgccgctccgcctgctctagcgtgctgacgccgcccctccacctactccagccgcgcgctcgcccatcgccgctcgccgccggcaaagagagaggagaggaaagagaagaggagagaaaagagaagaaaaataaactgcagctgacatgtgggcctcataattttaatattttttttgctgactaggatgccacgtaagcgaaaccacccacctatactgcgaagggacctcctgtgaacggtttgaatgagtttaggtgcgaacatttctggttttgtggttgagggacctaaaaaaattctcgctgttaagttgagggacctcatgtgaacttattccgcgtctggagtacctcgcttgggcctaggccctcggtctatggatggactgaaagaaagttcagtacatgccacagacggctatttggatttgaaaaaaaaaagagtccatatttcccccctttcgccggagcacttaaccttctatactatttattcgctcattttgcaccacgaactattgaaaatggctcaccttactccctaatgatatttgtcttcttcttttctctatatgtatgtcatattttgcaattaaatttgatgacattgatatacgcattataatttatatctcaacattttttgattttttttaattgttgtagaggttggaaacactcatactaatttaaatttcaagcaaatagttttgaaaaaaaatgaaactattttagaactctgataatggtgtcatttgtggctctgcaaaatataagcttaaaatatgactcgtataaagagaaacaaataagagaaatgaaagaaccatttttaatactctctccattccaaattataaggcctatttttttacatgatctccaatgatatactttggccattaatttatttcatgtcatgttcccaatgaatataaaattagcatcacgtgaaaatataataatataacatgcataatacttggtatcgatatagttagcatgattattagtcaaaaattaccaagtttaatttttttttagaaataagggtgcccaataatttggtatggagggagtagcttatagggtaaaatgagttcaaaatagttttggagtttaagtaatacaatgaaattgtttgggtgagtaaactggacttttctctttggatttttgtgcggtagagaaacaaattaacaaatgatgactacttgccgacccgttcactgtaattttaataattgcaagggtttttttttgttaaataacatggatattgaaattttaattatatgtcaaatatgtttgttaactttcaaattaaaatagatcatgttaaaataataatccatgtcaattactattcattaattattaatttcgatttttagaattaaatacaacactaaatcaaaatttattctatatgttttctgttgtttgtatgttttatttaatatttttaaaattttaattaataagtactccctaagaaagtcgtttaggacagtgacacgatcaccaaaacacaattttgacttcttatttctataaaaatatttattgaaaagtgatatatgtatacttttatgaaagtatttttcaagacaaatttattcatataatttttatattttcaaactcaacaacttgagaattactcatgatttatattcctaatgtttacttaaacattgtcctaaacgacttactttacgagtacggagggagtatttatttgtatttgtgttggagattcaatgtactatatttcataaattaataattctgaaatttaaaatttgtaaatatcgagttgtactcagtttagacttttggagatatattaatttttatttttggtttagtgtttccaagtttgtaattggtacatactcttattttatttgaacatgtttggtagaagttgaaaagagatgatttttttaattgcatgtattgtttaaaaaactctaaatacgatatacaatcatgattccagatacaacgactaaaattttcagttaacataggagtttcctcgggaatatctataggtatagttgtgggtgttttttttttctctgagcacccaattaatatggatataaatttttcaacaaccaaataaaacaatgtgatccaatgatccattgccgtcgtctaaagaatatcggatagagtactttatatgggacctgtatgtcaaccttttgggatcagcagagtcgtgtgtcaaagatggggtgatcattgatgatttcgttttcaaaagttgtcaattttattcgggatcaaccgagacgttcgatgtgtcacggtctaatcccatcgtcttaataccacgattagattaccactacgaccaaaccaatcacaattggcgatcctctttcaactaaccccaaacagcagcagacacactgaaatccccgggttaatattgtttttttgatagcgtaatccaatatccccattgttagtaaggctctcaaccgtttctccgttcaaccccgaacctaaaatacgaggcggcggaccacggttttgctgatgtgataccgttgcttgttggcgcgagcagtccacgtcgggctgcctcttctgcttgcaaggctgacgggtgacggctgcatcgttatgcagtcaacgattgcaggctagaactcgagaggaacattttccattcttcctccatcgaaggctcgaactcgaagagtagtttaggaaaaaaaaaaaaacgccgccttgtttctccaatgtcattgtccgtccatttgacacatgcgacgcgtgacgatttgtttagcttttctgcctgttcgtaagccggtgacccatgcgaaatcgtttgcgcagcgcgcaaacgatcgtccccacgactcaagtggatcaactggcgattgggaaggcaacctagatcaacgaaccaaagagaagaaagcgagatgatggatgcgcgcatccagttggtggtggatgggcggcggagaccggagaccgaacgaaacggccagattcggatggatccgtctgccccgacgaggagaatgccgcttccaccacgccccaacgctgggccacacgcgcgcgcccaccaggccaccacccaagccgagtccacgcatcgcacgcgacaacagaaggtgaccgaccagagggcggcccaaacatccgggaagagatccattcctcacggcccccgccacaacatcgccgtcgcctcgccgtctgccgctgccacccagcgaacgcaaagacgaaaacgtcaaggaaaagggggggggggggggggggggaactctgcgaaagaaagaaagcgattcgtcgcaatcctcactcccctcccggtctttctcattcgtagttctcctttttgcccgcacaagcagcagtgcagcagcagcatacgcagtcacaaacaccggttattattggtcgatgcgtgtttcctgttcgtttgggtggcctgatgccctgatctgacgatgggtgacacgacttgggcttaaacaatggccgcaccattaggtagtgtctggtgcaggggcgaacgcgattagccatgatgtagcgtgattctttccttgcaggcttcctttcctagccaatcagccaccttctcccaaaccagtacaggcgctatccggttgaccaaaccagcctaccaacccgtcaagtcatcgacacagggatcagatcgatcaggagggcctctcatctttgccaattccatctttcttctgttctcctttcctcttcctcgttcttcttcttcttctagtatccgtgcataaaactgctaaacaattaccactattgtattgaccaatgagtcgacggggccatgtggtttggttttgtttagcatcccgtctctctcctcctctgtttccatcatcatcatcatccagaggccaccaaccctcctcgattattcagagcagccaattagtcttggcgtcttgacgtgttcggagaatttcctctcatttatatgcagtagttagacatgctctggagaagcaaagcgaggtaggaagagggatttggtcgaattttacgtacttagccgtgggcgaggcgtttacagggttgcttcggctcggggtgggttgggttgggttgggttcgatggagaagtggagcagggggctctcctgccgggccgccatctgcggcatcgtcgtcctgctctgcgccaccgcgttctcctgctccctcgccgccgaattccgcaaagtcaaggtcaggctcgcttgctcttgcgctctccgacgccggcaatggtggcgggcgggtcggtctcactcacgcccttggatctggatcatgtctgtgtgtgtgcgcaggagaaggacatgaagctggacggtagcctctgctccctgcccaagagctccgccttcgaattgggcgtcgcggccatcgcgttcctctccgtggcgcagctggtgggcaccacggcggcggcgaccaccatgtgcgccgcgtccaagcgcagcaagtcgtccaccaccaggcgccgcgcggcgtccgtcgccatcctcgtcctctcatggtacgccctatagtacggccatggctgccaaacaaagaattaatgcgtgatttctgcgagcgtggatcgctgaatcgccgcccgcggcgcgcgcgccggatgtacgcagggtgagcttcgcgctggccgtcgtcctgctggcgaccgcggcgagcatgaaccacgggcagcggtacggccggggctggatggacggcgactgctacgtcgccaggaacggcgtgttcggcggggccgccgcgctggtcgtcgtcacggcgctcctcatcctcggcctcacctccaccaccaaatcatcctcatgcgccacctcggcagcatccgccacaacgacaatccgtctcgacgcggcggccacggacgccgagcaggcgagcgggcgatcgaagcagtgacccgccggcctggccggggcggaacacgcggggcgggacgggccaaccggaggagaggcgggtggacggtgctccgcgctgttcgtcccgcaaaggccaagcggcgtgggggcaatctccgcttgctggcaaaggccaacggctggtgatgggtgggggcgggtataccggtgggttagaagatattttagctggacaaaggtagtacatagcattactgacaaaattactgaccaagaggtccaagaccgtgcaaaatgtaaatgaaaccagatcaaacagatccacgcaaagaaagtaaaggttgtacatgaattaattacagcatcttaagacatagccgagttcgaacatggtgattggtggatgtggcagagtcgaatgtgagtcgtacgatttagtcgtatgtatagcaggattctatttttttttagctcgcctatgccagattttcgtgatggttttattgtatttatatatttgttttttagataacaggagatgtattactgtagtaatatttatatatacctagcatgtgtttcttgattaggtcctcatgttttagcatgttcacttgtgctggcaaaggctggctctgtcctctatacattatctagtctgtaacagtctaacagacagcatgatgggaatgcatatgaacaattctttttggctctgtagactgtaaattccttttttttttcttcttcttctggtgagaagacaaaaatgacacggggataatatgtgatggcccccgagtttatcagtcgcattgttgcaatgagaatgacaagcacgttggctcataagcagtcgcattatcctatgtttctatcttttcatagggcaatctccagtttttgaactagaagtatcatggaaattgcagagttataatgatacgcgccgctggtccaacaatacggactattgggagagcaatgcaacgcagaaaaatgcaaacgtcatattagaactatccgtacacagtacactttatcaggtcataaagctaaaaagggtatgcaacggtgaaggggatttttaagccgttgcgggcaagttcgatgttttctttcaggttggcaacagcaaacatgttggcctggtgtgccgaaggtggaagaaacaaggcaataggattctgcatgtgctgtcattcatacgggcttgcatctggtcgtgtgttctttgttttcttgcacacaaaaattcgtggaaaatgtatactattcggtagctctattatagcatgtacaatagcatactataagccagttataaacacatatcaagaagataaaagaagagagagaaaagcagcgggctacagatttatgtgtatgataggggggaggtagtatatttattagctattaaattaactataaatgatttggagttagtagtattaaacttgctcttaccgcaccaactgttgactggtttcacagagagatacattcagttatgttgatattgattaatatcattatgagctgggataagttcatatcatccccctcaactaccacatttatctaaaagaatccattttactctaaaaccgacataattccttcccgaactcataaaactgtttaatttacacccctcatacaaactagactggttttttctatgcggcgtttacgtgaacagcatgtggtgtcgatgtcagcataaaaataaactagtagcttcacatgtgacttcttccccctccccactctccactatgtctcacgcccttactccaacgtatagatcaatgaccaaatgggccgtctggcctaggcacaaccgggcccgggccgagattagtcgagccggcagactcgacctacacatcgggctgccccgggtctatccacttgctgcaccatctgcctatgcacgacccaataagacttggatggtgtcgagctagcccaaagccacgaaagtccattgcactcttccttggataaaagactattttgcttccctcatatctttgggccgtctcttatatggttggaataaatctatttttcatccctcatctgtttgggtcatttcttgtatggctgaataaatctattttgtctctctcatctatttaactccctgatcgttggactgggccaatgccgtatcggcccatcgtgtcgagacagaggcccaggcatggcgcaaaggttgggtcatgccgacacgggatgggcctaataagtcaagcaatcatcgtgccacgtaggcgtcacattaactagaaatcgctttcaatattgtcgaggaatttaatttgtacccgttttaaaagttgagggacactccggttttatggttgagtggtgtgaataaaactcgacctatagttgagggacctaaagtgaattttatttcaaagcgtacaagaacctgaaccttgcacgttagctcaaaacctggatgtgcataaatcctggccccatcctaagggggtggctacctggcgactggtcgcgcctgccccatcgcgcgcgaccaccccccactcctcttagtatctatactatacaactagtagttactagtattactattactattacactactactattagtactagtattatttctataaaaaatatatttttatatgtatatattgttgatgtataaaaaatatacacatatacaaactttgtatacaatatgtacaaactttgtatacgtacgtattaaaaaataaaaaaaaacaaaaaaacataacgtatacaaactttgtatacgtgcgtatataaactttatatacgtacgtatataaactagtttgtatacatgaatacaaaaagtttgtatacgtatatgttaaaaaaaaccgaaaagagaaaaaaggaaaaaaaaagggggggggaaacaaaaaaaaccaaaacagaaagagaaccccaaaataacggaaaaaccaaaatagacagagaaacaaaaaaccggaaaaaaccaaacagaaagagaaaccaaaaaaaaccggagaaaaccaaacagaaagagaaacggaaaaaaagaagggcgcgcgcaactagccgccaattagcgttttcgccatcctaatgcataagcgggacattatactaaaatgtttggccaatacagttgaatgggcctcaataccgactcattcaatcgagtccttaataaagtgggtgcaatctcagatcggacccattcctcgttggaaaaagttcaatctgactccttcgatataggtcggatatgataaattcatatccttcaaccacaaaaccatatataatgtaaagcaaggtcgacaacgaatgcctgcatgagttcttggataaggcgaacgaaggcggtggcaccaccatggaggcatggagtacccagagcatatcgtgttttgctacagtcccaccgccgtcctatggaagaagtcgtcgtaccactgccgagaaggggataaacatagataggaaagtaaggagatagaggggatgacatgtgagccccattgtattttttttaaaaaaaaaattacgtgatgactaggctgccacatggatgccacgtcagtgaaaccaccaactatattgttaagggagtcattttgcatggtttaaatagttgaagaaatcactatacctagtttgcggttgaggggtaggaataagtcttgactatctttgagggactcaattaaacattttccttcctccctccagatacgctcaggacccatctcttaacttcgataggctggtgctctggcctcttcatggaccacaaaatggaataagttcaatttgactcccttaaaagtgacacgaatctaatccgtgaccctgaccctgaaccacaaaaccagatatcttgactccctaaactgttaaaaccggttcaatttgactccctcagcggttttggagggcggtttcgctgacgtggcgcatacatggcagtattgacctggttttacttccatgtggcgctgatgtggcactataatttgtaaaaaattgtgggacccaattgtcattcacattaaaaaaaaattgtgggaccctttacatgtggggcccacgtgtcatcctctctccccttccctcttttttcctccctctctcccttctctctccttctctccccacgccggcatcatggagcccagcctagccggtccttgcacgcgtagctccagaagagagcgcagcagaagtactgcgccgagcaggtgacgtgaagcagcactgccacgacgagcatgtgcgcgcggtcgtgcggccgcggcgcgcagtctttgcagtacaccttgtggatctcctcgcggtcgtcgctggtgccggggcgccaccggaggagcagcacgaggtggtggaagatcttggcgtgctggactgctagtacaggcacatgatggtgaagagcgcgttgaggaactggttgatcacctccgtccacttctttccgctgctcatcgttgggatggcggagtcaagcatgccggtcatgagcatgaacacactggtggagaaaccatctttggtcggtcgaccagattttacaatagtcccgattgtattaaaaaccgggactaaaaatatctttagtcccggtttaaaagctacagagtactttttcaatctttagtaccggttggtgttaccaaccgggactaaagatctatttgtagtcccggttaataacaccaaccaggaaaaaagatcgccatacgctttactctcagttgctgttaccaaccgggactaaagatatatttatagtcctggtggtaaaaccaaccgggagtaaagatcgacgcg

SEQ ID NO: 10520 - DNA, 15947 bp, Oryza sativa
tcgatttgtggatttggaggcaatttgagaatgattgatttgagattttggggacgggatagagtgaaatcaatatatttaaaaataatgaagaaaagaaaataataaaaaggaaccggaaagagcaaccggattagcatctttagtctaaagatgggtttttacccccggttttttcacccgggactaaagatagcgatctttagtcccggattcgtacttccggttcgaaaaccggtactataggggggttacgaaccgggagtaataaccctttctccaccagtgacagcaacagtaggccagcagcccagcggcgacgaacgccaaccaaatgaccatggcaaagttcccttcacctttccatgctcctccatggttgacatgcttttgcgtacatggtgcgatgcagatggcggtgacggcggcgttgaacggactcgggctggcactgcaaatcccgacaatatacaccttcgtcgccgactccttcgacggcacgagcaggggtgtggtgtttgggttgctcatggtggcgggaatggtcggcacgatcgaggcagagtggcgcaacgcggcgtccctcgccagggcgttgtacatcggcatcgctgtcccatggtgctgtgttgcctcgtctactcgttcctgtactgagagagaagggagaaagaggggaggaagaagagagagaggatggcatgtggagcccatatgtcagtgggccccacaatttttatgggtgtgaatgacaaacgggtcccacatatatttttttaattcaaatgccacctaagcgtcatgtcaaccccacaaattaggttagcaccgccacgtcagcgccacgtcagcgaaaccgtcctccaaaaccgccaagagagtcaaattgcaccgatttcaatagttcatggtcgagatatccagttttgcggtttagggtcatggattagatttggtcacttttaagggagtcaaagtggacttattccccacaaaattcctgtgcccgacgtgttcggccggctgatgcagaggagagcccaggtttctgaaacttgcgatttcggcccataatcctgacgaaaactctcgtgataaaaaaacgtagcatatcgtatcatcgtagtttttctggtgagtgactcacgatgtctgaaattctgaatggaaaaggatacgggaaaaaggagagatgttggctgcttttttcgcataaaatattgaaacggatacgtacccggttcctggatctaagccacaatctcacaagaatcaaattcagtgaccacccccacacaacacatcggcaacgagatttttatatcagagaaatactcccatggctatctgtgtaaagattttgtgaggttgcatgcacacgtaagtcctcggcaaaagctgaagccaaaaaaaaaaaagatcctggttatctccgttttctgatgatctgtagccgtctttttggtgcgttttgatatccccaatccgcgactgtcagacggacacacaaaaatgcgctgtaaagcagatcgagccacgtatcaaccggtggtcgctagtggagcctgaggccgtagttcgtgatgactctgatctcaaatcatgagaagcctttatatgtcattaatttgtgtccccccccccccctctctaaagcgacgcgcatccagctgcgattttgtttctggctacaaatcgcgtttctttttaagtgaaagcacaagtgcagctcgatcgaccaaagcgatcgatttagcaatgtactccttaagtgaacgaattaaaaaaaaaggactgacacattagcttggatctttgcttcatgacagtatctccctcgagcaattgcatggatgcacatatcttaaactaagcgatctgaggactgtgctgtggtggcctgtgatcggaaaaaggataacaatgacagctgaatgggaaaatttttaatatggtacgcatcgagatttctgaattaaaaacaagtgaaagaaaagttgatggcgaatgcatgggtccggccttacaatcaagtccaccctgacaactggcttagtgtagcagctagcatatatatatcctcacctttgcctccgctaaaataatgaaagactcgattgcttaaccaggcagagagtgctcgtggggcaaaaagatcagaacaaaggatgatctgtcaccaaaggccctagtgtatactactgttcgcgtttgatcgggctttgagactgaccagcagctgtatcccaatctagccagattgccactaaataatagagagtgatgcaaagctactagcacggtccgcgatcgctgctccttttcgccttttggatatcattatggagtaaaatacaacgtaaggaagcacccaaggaagcagggaagcatagtagcatcagtgatgagcacgtagcttagctagctgttttagcttattagcttagcttgggggaaggcgatgtggagagagcaaccggtaggacaaaggagtacaactgtaggatcagtgcacggcgaagcgtccacccgagtgacaggggagcaaggcccgaaaaggcgaccagaaaggcagaggaaaaggagagggaggaggatcccgggcggggacggaaagcgaaagcgacggcacggcacacgcatacacatattagcatgtagcgggggtgtaagattaacggtatcgggacggccgaccaggtgcaacagccccagcagcaaccaacatcacggctatcaagttgcggcacaataccagagctgtttcagcttcccgtctcagcttttgtggttttcctctggcgctaatcacatcagctccctctgattctctctcgtcatgcgcgtgccttgaacctgcccggtttaagagttcggctaatcctgcctgcgcgcgtcgctgtctcggcctctcgccgtcccgtcgcgttccgggttttcgcctctcgcctcgcgcgcgtgcggtcgcggtcgccctctggcgcgcgaggcgaccgcggtcgccctctggcgcgcaagcgcaagtggcgcgtgctcgcgtggggccacggaacgcgcgcgcggcgccggataacggcagaggcgacgcggaaaagtcagagtcagccgtcgcgctcgcgtttcatcgacgacggaagatgtggaggggggaatagggaatcaacagcaaactaaaagcgcacgcgcgcgtcattggttgaaactggaaaaacccaacgagattacgagagaaactacctcaccggaatgctacgataggccgttgcggggtccttgaccgagccggtggtgtgcgtgggcgtggcgtcgtttcctctggtgatgagatgagatggaaagagcttttcgctgcaacagaaaactgacagatggatggaaccacgcgtcgttttggttcgcccatgctgcgtgctttacatagccagttggtcatatatcctttgctcatctcatggcaaaagttacacgtgcactattgaggaataatggaaattggaaaatcgactgtgcaaacagagctgcacacttttcaaagcaaaatttctaaagagagattccatccagaataagttaatttagtactaaatcacatccggtttctgagacggagcaagtaatctagaaattttggcgagagctagacgtaccctctttgattatgctgacgtttatgttcacaaacacaacaagctatacctattttaacgcttggtggaacagttcttttactagtacaagtcggcatggatttctttctatgagtcaattacgtgaaccgggactacgaatcgccctcttgcatgtacggtcggcattgaacttgactcctcaaaaactacgcgcgtcaattttcctgataggttcgatacaggtttccaatatatcgacggataaggtctctttaaacggttttaatgacagcggtgaaacataaccagtttgttgttatatatagtcggccactcggacagcagcttgtcttggccgtggaaaaccaagtcaactaccgcgaccttcctcatgcaaatgcgtatgtatgacttggatgagaggagaggccgagactgataggactgagaccgagccaagtacgcaacgaaacaagcaagcagcttagctatcgccatatgtgcatgtatagtcggcattgcccctgcccggtcggtagggacgacaaaatcatggttcgcctatgacaacgcgaggacgtacggtacggtgtagattgacctcgttcgttcgctcgctagtccagagctagcggtccagggggccactacctgtcaacaatcggtgctcgtatgaatagccgagcagtatcgcgaccgttatacaagcagcagcacatggatggtcgatcgatctgcgggtggcaggcgaggcgtaccgatcgaccgtacacgcacttacctggtcaggtgcatgatcgagaattcgagatacgcaacgcacggttggatcgattgatacgcagaatccgcgggtgttgatcgattggcgataggatcagcgtctggaattcgtgtgaatcatgcacggtggggcgcgcgagttgcgtgccctgattggggcgtgtagggtagcgcgtgcatgcgcgcgtacatgcgaggatgggagcgagatatatatccagatatgtgtggcggagccgatcggggtgcgggacccccccgtgccgggtgccctgggtacctgcccgctggctacgcgagggaccaggcaaccactcgcgcgcgtcgcatccgcatgcgccccaatcaaccagactctccttctctccttcttctgtttgctcgcgcgtcgtaggacccggctaggcagtacgtacgcctctcagcctctggctgaatggctggctaagatccgccacttctagcgtgatcgaatgcgcgatccatctcccctgcctcgcgcctcgtcgtgttgctgcgtacgatgtgtgccacagtgcggccagactagataccggacagagaatttgaggtcctgtggctaagctgtgcgtgtcaggggagggagtccgtcgtacgcgtgcatgcacggttctgcacggaacggaacgtcacgcgagggagcggctatttttgtagctggaccaacctgttatttgttgcgtacgtacctcatgcatacacatgcatgcagccatgcatgctgcggcagtttcacaatgtcaatatgtttgtactgtacggtgtatctagatcggccggttagctgatgatctgataatccggaacgtatagctaaaaaaaaaaaccccaaaaaaatacattagattgggtacggcgaggaaacaggatagatgcctatgtgataaaaagcgaaggatatccttccaatattgagccagcaaacaacgaacagtcgggacaaaagttacatggatgatatgtgccatactttctgcaatttatctatgcagaaaataagattgtgagcgtacgtacatagtgcgatgtgccgatgtagacatgaatggaagtcgctgtagtgcttgtacacacccaactaaagtttagcgaaacaaagattctagatatccaggagacctttcgatcgtcttatgcagacaaataatgcaacggcactaactgacactcgtaacgacctgcttcttccaacatcaacatgtacctttccatggtatattgtgatattgtctacatagacctgtacgaagacctggtcccagcagagaccgggtgtaaatgaggtgacgggggacgtaaaattcagagtctagtgccgacttgcaggggcaatttaaccactgcaatttcctttgatgaaaattctaatgcgtgtgggcgagttttaaattgaaacaaataagagtacaatgtactgcaggaactaaccggcctcttgtcacaagtgcaacaaatgggtcgccgtttaaagttacttagaacaatgctacttacactatgctgggctctcgagggaggttgggctgaaaaaaaaatccctgtcatgaacgtttaccaaactactaaatttcgtgcataagtttatgtataattttatttaaaagaatcaagtaaatctattttgacacctataataattagtattcaattcattatttgctaatcacttactccctccgtctcattttaagtgcaatcatgagtttccgtgtccaactttgatagtccgttttatttgaatttttttataattaatatttttgtagttatgagatgataaaacatgaataatactttattcgtgacttatgtttttaatttttttttaaaaaaaattaaataagatggacgatctaatttaaacgtggaaaatcataactgcacttaaaatgggacggatggagtatttgattttacgtgccactaaaattcaagtcaaactgtctccagaactaaacctaagttttggatgtgatagctttgtgggattgaaatctttagtcttttgattagagtaaatgtcataattgtggcccttgctgcctctctatcttttaaacttttttagtttgcaagatgcatgagaaaatcatgcttcggacaatgagttttcctctaacttagtggaaataaggatttcggcacaccgggtgacatgaaagtattattggtatgctatatcaatataaaacaacacactattgttgttcgttaaaaaaatattgtcgatatcaacaactactcaacacgtcaaatattgtgagagttactgacaaatatcggtttagtgtcaacagatattagatctttagatcttatacccataagtatgcatcgtctcattttaaccagtagatttgctccggtccaataaaaggtatctcgaagtatcatacctcatggtaccaaaaaaattattttcaattgttgaatctaaccatgcttatcctgtctagctaatccaacgatcggaaacgatttggtaccgtgaggtaccggtaccttaaaataattttgctggaccagaacaaatctcttcaaacagacacatagttcctcaatcgtttccttgccgaatgccgagtagtaccgacgtattcattcaagcatgcgctcgctgttggaagacacgtacggcgatctcaaatactagtatttcctgaccagcacgacgatctcaaatactagtattccaccggccagctagcgtcgggtggccgctgcgcgcccgcctgccggccacgtcgcgggcgccgactcgtccaccagcatcaccagccttatcgatcagtgccgtccccgggccccctccgccgccggagtgacattgtcgctgccacgcctgccggctcgtgtttgattgatcgggctattttattgctcgcccagctggacacgcgcgacatcgcacgcaaaacgcctggcctattgcacgcgcacactgctacgcttcgactccatcatatcccgtcggtggacgatcgatctgcgtgttacccaagttagcagcgagcaaatcgtccgtgctgatcgaaacgtgccaaaacggggaaggctaactgtactacgcagtcgcatgtgggcgcgcggggcggctcgaccgcgcgcggagcggcgccgcacggcacggaacggaagagatcgatcggtcaaggagcggtagagctgcgaccgggcgcgcggatatgcacatatgaacatccgcgcaatcattgaagacacgtatgtcctgcggccgccgtaacgtggcccgcgcgtcgatccggcgccacaacgacgcctccgcgagctccggcccccgatatttcctttagctagagcccgctttgctgggtgccgtgggctagctcactgcgaccacagacgcgcgcgcctcccggcccgggaccgcttccgcgctacgtctactacgacgacgtactatcgtgcatcccctatcagatcagatgcgtggttccacctctcgtcgaccaggacaaacaccgaagcgcgccgcatcgtctcatcaggaggtgatcgaaacgcgcacaggtgtcccgcgaccgcacgaagcggccaggagccattgatgatcccacggcggttgtcgtggagtaaggacggcgccgagacgaccggtcgcgcgcgcgccgcggcggttgattggctctgggcggctatgatgaggctatttgactatcaacggctctcgtccgcgccctgcacaccgcaggcaagagcccggacaaagcacgcattttggcgcccttgaggccttgactccaaagttagatcgcaacgtagccgccccgcgctcgcatgtgattcgtgaccgccgcgcccgcgcgcgcgccgcggtggggtgctacgtgcaaattccctgcccgcgtgccctggacggcgccgtgccagcaccgtgcggctctctcgcacgtagttccgcccatcaacctgcaaaccttgcaggctttctagcggcatccgccgccgtgcatatcctgagacgaaatggcactgcatgtatgtgcaactaggataccaccacggacagtttggtcccccaagaatctatccgaatcgcacactcatgctgtgcttcagccacttcccgatccaaattgggctcctgcccccgtgggacctgaccaccgggtctcatattcctcatagataaacttgtttagatacaaagatggactggtagctaccacactacaggacggaacagaatgcataattcacaaagggtagccccccatgcatgtacgtaattgtcctttgcctgcgagaaaatatcctgtcaaatcgcactataacattttaatattgtgcattgcatattcgtttcacagaatgctactactactgatcaaaggccaagtttcatttgttctcttacgtgaagcatgagtttgtacacacatacatgtagcctgttggtagcttgggccggtacactgataatgccgtcataattgaacgagaacaagcgatcaatatcctcccctgccggcagcatggcgcgttgcaaacgtctagaaggcaatggcctcatctgcgatgaccgatgaagaaataggttgagtatacgtttataacgcagctcattcgaaagttgtgtgagattcagattcagcatcacaactgttagactatattacgaaatgcctgccactccttttacattatattgtatactaatatagagcctcttttacatttgctcatagcgatgaggatacgttggattaagaatgaacgcaaatgatggttccgtgccacttgtccttttgcttgcatggagtcaggaagagattaggaacaaccgaacaagagggtattttcaatggtccacgtgtccagaaaccatggcagatattttgttactaatagtttccacagtagactactactacacctcctcagcgtccttccctaatacacatatactagtagtattcagtttcgagttgaaagattttttgacgggatgagttgaacgactgaatttggatttgatgaataagagatgaattgaagcacaccctcacagctgtcccatcacatgcaaaggtcaacctgtagatctgaatgcacatgcctttgaatttctgattaagatgttaacctactactagaactgctaccatccgatctttttttgcccgaatcaaaaaagagagaaaagagaaaaaaatatgcttttatttttctcagaagaaaaaaagaggggtagagctgcatgcgcacgaccatttcgcgacggactaacggtttgttcaacacctgtcattcccatcatgagcaggttaagcatttcggcacgcattcctactttgcaacctgctttagctagccgcggtcagtgataccggcaaaaattcccaagtgatgtttacttcgaaaaaatagattattcacgcatcaataaatcataaaatgagtatcttacgatggactcaggaacaatcggtagatgtgtttaccgacaaaaagaaaaaaaaaacaccgccgcaccggacaccaagtaattaagcagaacagtgttcaggccagtatgatggctggttggggatgatcagaggaagcggccaaaggagagcagcattataggagcaggagcaggagcaggagcagcagcagctgctgccggggcagtacgtagtacgtacgagagcgcgtacagtagctgatggtgtggaaacagggcggaaagggagaggtgagctggagaaagggatgattctctcgcgcgctggccagaagagaagagaggcccatttagctatcactgtattggttaaccggtttaaccgatcagttgattaatccggctctctcgcccgcacgcctttttccctttatttccgtattgattgcgcaattattcggcagcgtctatctgtctctctcgcgcgcggaggcacccagctcggctattctagcgcgtagtggtggtgctagctactagtagtagtagatttttgggcagcaagcggccgcagaaaaggagagcgaaacggaggagaaaccgggaaactcagctcgcggccaatctataaatagctgccacccctctcgcctttccctccacaccccccccaacaacaccaccgcccatttccctttctcttcctcttcttcttccttctcctcctactcctctgcgattgacaaagataagtgaagtgagcaggcgccaatgggtgcttttcttctgttcgtgtgcgtgctcgcgcctttcttgcttgtctgcgccgtccgcggccgccgccggcaggcgggctcgtcggaagcggcggcgtgcggcctgccgctgccgccggggtcgatggggtggccgtacgtcggggagacgttccagctgtactcgtccaagaaccccaacgtgttcttcaacaagaagcggaacaagtacggtcccatcttcaagacgcacatcctgggatgcccctgcgtgatggtgtccagcccggaggcggcgcggttcgtgctggtgacgcaggcgcacctcttcaagcccaccttcccggcgagcaaggagcggatgctgggtccccaggccatcttcttccagcagggcgactaccacgcccacctccgccgcatcgtctcccgcgccttctcccccgagtccatccgcgcctccgtcccggccatcgaggccatcgcgctccgctccctccactcctgggacggccagttcgtcaacaccttccaagagatgaagactgtgagttcttactgcctaactcctcttcccactctgctttgctctgctctactctgctttgctgatcgatccgatgtgtttgttgttgatggcatatacaacagtacgcgctgaatgtggcattgctgtccatcttcggggaggaggagatgcgctacatcgaggagctgaagcagtgctacctgacgctggagaaggggtacaactcgatgccggtgaacctgccgggcaccctgttccacaaggccatgaaggcccggaagaggctgggcgccattgtggcccacatcatctctgcccggcgcgagcggcagcgggggaacgacctgctagggtcgttcgtggacggccgcgaggccctcaccgacgcccagatcgccgacaacgtcatcggcgtcatcttcgccgcccgcgacaccaccgccagcgtcctcacctggatggtcaagttcctcggcgaccaccccgccgtcctcaaggccgtcaccgtaagttcgcctcctcatatctcatagtatatcaaagtccttgatggtgaggctgaccgcgggtgccatggatggaacaggaagagcagctgcagattgccaaggagaaagaggcgtcgggcgagccgctgtcatgggcggacacgcggcggatgaagatgacgagccgggtcatccaggagacgatgagggtggcgtccatcctctccttcaccttcagggaggccgtggaggacgtggaataccaaggtgagcagcagagcagagctgtccggtggcagcctgtccgtccctttcgagacagcctcgcgcttctcttccgctgcgagtgaactggaccgaatggggcagactggttccttaactgaaatagactaactcgatcagtcgtcccagaatctaacctcgttcgatcgtctgctctgtgcagggtacctgatccccaagggctggaaagtgctacctctgttccgcaacatccaccacaaccccgaccacttcccctgcccggaaaagttcgacccgtcccggttcgaggtcagcatcacgaacccactcttccgtgtttttgttcccttccctccctttcctttcccggtgcggccgacttcctagccaagtcggtccgcggtttgcgagcagtggccggtatgggttttcctgaccccgcgtccgtcccgtcactgttgcaggtggcgcccaagcccaacacgttcatgccgttcgggaacgggacccactcgtgcccgggcaacgagctcgccaagctggagatgctcgtgctcttccaccacctcgcaaccaagtacaggtggtccacgtccaagtccgagagcggcgtccagttcggccccttcgcgctgccgctcaacggcctccccatgagcttcacccgcaagaacaccgagcaggagtgaaaaccgaacagggagacaaaaagaagaagaagaatactagcatcagctaagctggggaaagctggcaaaaccaacatcaacggcgggcagcggcgccacgcagcgcgcgcgagtccattttcgcggcggtcaccgtccggggggacacctgttggcgccgcagtgggagcgggagaccgaacggtggattccgtattagcacggatcatcagagtccttgtacagattcttcagctaggaccacggttggcaatcgagaggaggagcagaggagttgatgaaaaaaaccaaacactacgtagacatctgagctagggagcgccacaaagaagtggcccttaattgtaaaaccaaccattttttatccttttttgcttagttttttttttggccaacaactataggagaagagtagagaagagaagagaaattggggagaaaatacagggaggatgaagaggccctgattgggatgtaagctaggttgcccgcctgaaagcaggctggcatgcagatgcagctataggtcgaataatcgaggcgagcgatgatggacggatggatcgattcatcgatcgccagagtcaaaagggaagaacgtcgtgatcccccgcgggctaagccaggccacgggagagcgactcctctgtaccgtttcgtccaactcaagagaaaatgaccttcttgagaaaagtattgaattgtccctatacacgcgcacacaggaattgctacccagcaccctatattgcagttgagcaagcgattttttcgatcacttcttgtgtgtaagcatgcatgcatgcttccaataaactaattctaatctgcagcgtgatccataaaaatatcggttggactttgggataggatactacccgagtcaaactgatggaatgatgcatattgtggatgatgagttcttttaaaactaaactaaaactatctgttgcctctctagcactggaagggctagctctttgtaccacgtctgtgatccatctccaatcttaaggttctagaagctaactttggatgccaatggcatgttcttgattctttttataaaaaaaatgaatatggaattaggagatgattgaaatcaaattgttactcttggtctaaatgttggctccaaaacaacccaaatgcactatgatggtttaacccttcaaaatatttcattttgttaaaaacaaccataatggccaacaactactaagattgtagcgggtaatgttgctcccattgggcacggtggcattggtcaagcgtcgatgaattaggccaaggtcgcgtggaacaacaccctagggaattgaaacaacaaatataatgttggcatcacatagaattcaaataaaatgtggttaatggagttatgaaattcttccatcgtgtattcgtgttgctatacaatcatatacgcatgggagattggatgagaacaggataagtatttttcacctcggacgaacacatgcaatttggttcccttgatagaagttccagttgatttatagaggtatcaaaaatggtttacacttaaactcacctacttatccgtttaccatgttagctgccaaggggtgaaatcaagtttggtacgtcagctcatcgtatttccgtatcttagcccatattttctttcggagttagaaagtatggatagagtcaataatctatcactcagtaactcgtatcctatttcatatttgttgtttagataatagtaccacatatctatttttctctctaatatcatccccacgtttcaggtcgggtgagtggatgggtatgtggaaaatacttatcctgttttcatccaatctcccatgcttatatgaactaacttaatcaagttgaaactgagcttttctagtgaaacaacgatgaagtttggatgataccataattctatccctatcgattggattagactcccctaactttgtgcagtttacagttgtgacactgatatgacaatgtgagaggatctgtttccctatcgattcgcccaccgaatctcaaattaaacatggtgttgacaattttcttgggatgaactttggaagcgccgtagtacgtacagcggtacagggttggtgaccgagtcgagtgattgacttttggagatggaaacaagcatacttaaaaaaaaacagagagacgcttaaaaaaacagaggtgcaaagagccaaagagagatgcagaggaacagagcgaaagcgaagtttccaggaaagcggaggccgaagtctcctctccctctaatggcgagacagatggaaccctatcctctgtgccaattattcagccagccgggcaggcaggcaagcggtcacgagcccggcattattcagttgcccatcgatggaattcatggatggacaccgatgtggtattggtgagtgaactgagcccaatcagtgacaggcaggaggcagctgcgtgcgatagcgcgcgcccggccgggtcggcttgcaatttggcctttgcctgcccatttttttagtcactgcgtgcgcgcgcgcgtccaccgatgatccatctggaaatgtgccttttactacaagtatgtttcggactttcagtgttcgtgtgcgcgtcatgcatgcagggggggaggagacgctcctgctgattggccgctagattctctgctcttctgctactggctaatataatctcttcctttcctagccattcccgggctgacacgtcagcactggtcagccaggagaggcttgacgagctccccgttttgcctaatcccatgtgctagtgccgtactagagactagagttacgggttgtcaaccgtgtgcatgcacttgcaatatagtatcacccatggttgatggttgcatgtgctggaaggtaagagcttagtgttaatgcagtacttctggtataatactgtaaaaaaatgggtgtacacaccggagaaaacgagtgggaggaagaatgtgacaagaaagtgaaaattgcagcgaacgtattggttaaatggaggacaaatggctacaccgggtgtttttaggaacacgctatttagttatgttgttgtcgcatgagagttacatatagtaattttatagatggcagcgcatgagtagttgctaaccatgtttcttacgtggcgtgaagtttgtgtcataagatggaagtgaacctttccacttccacacatcttgcattaattattgatcctaccatatggttcgttcctttttattaagtgacatagaggcagcctctttgagatgtactttgcggaaggtaaattatgtatataatgttattcacattcacagtagaaaagtgcacaccaacaaaaggaaaagaaaagttaatgcccgaaggtaatgtaaagagacaatccattatatgccact

SEQ ID NO: 10521 - DNA, 1203 bp, Oryza sativa
tctccccctcacctccccacatcaaatccactccatttgaactcatttttcgcaggattttttgtggaaattgaagagaaaggtagactcctccattcccccctcttttttttcgtttttattggttgaatttgtagatcgaagggtaaccctagaaccccttttatgcccaaatttgtgatttttagcatttgttcttgggatttacttgttgtagtgctacatgtttgcaatgtacgcattggtgtcacgatttttttaaccatatatgtggtaatgttaatttttggattgtttggttggatggatggatgaaaaattagggttgaggcatgaaagtaattttaatttgatggacttgatgctatagcctataggttaaacttttaacaattaattatatgaaggggagaaaattttggttgcattatagaaattgattatagttaattagaactaggttgggttgtatgacggagtatttgtaatatttcgatgtataatgcactagtaaacttgttgatagttgtaggtggattaaatattttttttggagtagtagctttgggacaaattaagttatgcattggttataatatgtcggtttggactacgtttataaatgaatatttaatttttgttgcaaagttacatttgattttttggtgtagatggatagacttgttcgtgtttactacggtggtagagtggtggaaccttatgttggtgcacatgttgagttttaggatatgtcattgaagaccattttgtttcccacccacccaactgtagatgaactaaggtcacgagtgaaacaagttcttggatggaccgaggataatgtgtagattcgtttttatgggagatacgatgttggtcaagggcataagtatatattaaatgtcataggtcagttggaatgggaagtttactttgatttggtaaaagagtctcagtttagatctctataggtgtttgcatcaaagttggtacgtaccgtaaaaaatttgaatctaaccaaatctccttcttatcattacgttgagaagaattttgtgacatattcttctcatcgtgaagggggtgcaagtaagactgagttggtacgagaagtacttggagggggaagaagataagaagacccctttgcttggaaatgatttaggggaggcaggatcatcaaagagacattccggtagtgat

SEQ ID NO: 10522 - DNA, 364 bp, Oryza sativa
cccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagc

SEQ ID NO: 10523 - DNA, 1128 bp, Oryza sativa
ggcctgttgtcgtcaggcacgatcatccaacatgagtggttgtgtgctattgattcagctgtggatgtggttaagactaccggttggaaggcttaagtggaggcaaagctttactccttgcccctacaatgagccagacatggagaagacagtggcctacctttttgagagtactaccactgcacatgctcaccgggatgtggcatacaagcatcatgtcaatgagatggactgcttacagcctcaacatgtaaatacttccaatatcacttctagttagacatttacttctttaattgatatactaaccaacgacatctcttcaacttttgcagattgagtggttaccatacatacaaatgaggcttcaagcctgaccctgaactcgatgtgcaatcgagactctgactacttcatgtaccagtgcccattgatttgtttttgggcagttgagtaccaccttccgcaccgtgtcatgcgaaagttcgggaagaaacaagactggccggttgaggacatctcaactagagttgaattacacaagtaaatatttcttatctttgtttgctttcattgtcaatgttcaattttgtaccatttaacccttgtcgatgctcactattgtttcatcaccttccacttgtctaggtatgacagggtgagaacaaagaaggtgaaagactgggggctagagcataacagatacattgatgaatggaggacagccggaaggaacgacaggtacatcgagactatacaccaaaatcatcttttctcagagtaccttcgttggctgctcctataatgctgctctcctttggccgattgctctgatcattcccaaccaggcatatactgggctgaacactgttctggttaattacttggggtacggggcggcggagtttttttttttttttgtcggtaaacacatctaccgattgttcctgagtccatccgaagatactcattttatgatttattgatgcgggaataatctattttttcgaagaaacatcacttgggaatttttgccgtatcactgaccgcggctagctaaaacaaggtgcaaagtaagaatgcgtgccgaaatgcttaacctgctcatgatgggaatgacaagtgttg

SEQ ID NO: 10524 - DNA, 3871 bp, Oryza sativa
cgggtacagccagtgtcgcgtactgtggaaggccctcgccccggtggtgggctcgcgcaacgcgcgctcccgcatggtgtggtgggtggacgcccgccggtgtctcactctctcctcctcgcggaagctccgcgccgcgatgcgcagctacgtgggcaacgtcacgaccttcgcggtcgcgaaggccaccatggaggagatccaccgaaagcccctgccgaaggtggcgtccatggcgcgcgacgcgatccccgcgccggcgtacggcgagcacttccaggagctcgtggactgggtcgaggagcacaaggccgggaagcagcggtacatcgacacggcgagcgtcgggctgggcagcccggcggtgagcgtgacggcgttcgcgtcgttcgaggtggacaccgacttcggccacggccacgccgcgatggcgctgcccacgtcgtcctccagcgcgaggctgtgcacggggttcgtgcagatcgccgcgcggcctggcggcggcgacgggtcgtggatcgcgagcgcgctgctgtggccgaggctggcggcggcgctcgagtccgacgagcggctggggcgcatcttcaagccggtgacggcggagtatcttggtctccggccagcgagtggtagctcggcgaagcgggcaggcatgatcacctctaaaatctgaactccaatagactttgcctatgcgggattcaatatttcagaaataaaataaaaccctttcgtaattttaaacaatttttgactgaatttgaataaattttgctaaatacgaaataataaagatgtcctgccgaagctggtcgaggtggtgcgacaccgtgagcgggcgctgccgctgcggtgctggcctcaccgtcgtacagcgcgtcgctcgacggggcgtccaccgcatggggatggtgtggttggtggacggccgtcatagtattgaaagttgatactccgtctattatttcatattataagtcgttttgatttttttttctagttaaattaatttaagtatgattcagtttatagaaaatgatagtatcattttcaaaacacaaacaaatatattatcaaaatatataatcaatgctagatttaatgaaacttattttttttagatgtggctaaatttttctataactttaatcaaacttaaaaaaagctttaaaaatatttaaaatgacttataatataaaatggagggagtagctattattcaagagtgcaatgcactattgttacgagaggtcgagcttgttgtttttaataaaaaggttattataacatgggatcttgtttgggtgggatgatacacacgaggtattaatttcttatactgctggcgccgaactgttgacgcgaaaaatatacactggccttggagatctgcttagctccattgcaggtccaaaggttgatgagatgcgagcgtgccagtcagtttgaccctgcaactgataagatatacatatagcagatcaatgagccgatcggctgacaagccaatagattaatttcagccgatgccgataccagccgatagcgatagggttttgagctatcggctataattctgatgtagattttgacgcctgatgtaaataacaatataaaggcaatcgactgatgataaatgcaagaaagcaacaatataatccagtagaaaccaatcggctaacaataacatgatagaataagcactgatatgaaggttaaagcatatatcggttggtggtccaatgtcataaaatccacaagattagataaacagtgaaatctctgttatcatcggctaaatccaacttacatgtaatccttgcaagccgatgcaatgtccagaaacctcattggctgaaacctcgatgaaacccttattggcagtcaaaaagtaggctatggattatggttctaaacatgacttaatagatcaaacttaactgatgcagcactaagtatgaaaagaaatataatacctagacaatcaagctcttgactgacttttagggtggtagatgccttagctaatctaatctagtaaaataatttacccgataccggcaaaaaccataaagcgagaaacaaccgatagagctaaattgagatactaagactagattaattaagacatatgataaataaataggcaaatatatcatccatactagagcaattcaagaggtcgaatgtactgatgcagccttggacgacgccgacgtaaatgagacaattgcctgggccggcagaacgtaggacttaccccttcgccggagatcgaactaaaccgatgcagccccgcgtcaggttccaaattccgccgattgataagtaaaaacctcataaaagagggtgacgatgcgccgagaatagttgtattgatcgagagatattacaatgaccctgggtgtatatatttttactaatggggagatactagtccttgtacgacaagaaagaaatttttctaaagataaaaggaaaacataaagtccttataggacactaaacacactttactaaagataaaaggaaactaacaaactatttctaattaataaataacttgccatgccgcattctcctttaacttggtcacttctggatcagcttcctttaatagattaatttccttaaccgaatatagcaagaattatcacatcggttattggcggtgtgataattctctcaggggcttaccaaatttcactgttaacaagaaaccatctttagcaagaccccttccttccccctctttagcgatgagctcctcggagacatagtaaggcagtgcggtctttcctcccggcgacatgctatccggtagcacggcaaggcggtggggccttgctccattaagcctctcatgctacatgttgtggtggctgccaccgccatctttccctagcggttcaatatagcgttggccatggtggcgttggaggaggtgaggttgccgctgctcaattattgggcgtgctgagaagtggtcgggcctcggcgtttgggaggagagcacgcttctgcttcgactccacgtagagcgattcctgcaaattataggagcgaaacaatgttattttgtttttgaattgattctaatcctcacaggaatgttcactcgtatatatttttcttaaattcaaattaaatgcttataaatatttttaaaacactataatataaatatagggtatagtaacttctatccctcactaagggcctgtttagatctcccggcatgcatagaatatttggacacatgcatagagtattaaatataaacgaaaaaataactaattacacagattgtgtgtaaattgcgagacgaatcttttaatctaattgctccatgatttgacaatgtggtgctacagtaaatatttgctaataacagattaattaggcttaataaattcgtcttgcagtttacatgggaaatctgtaatttgttttgttattagtctatgtttaatattttaaatatgtgttcgtatatccgatatgacacgcccaaacttttcacccacgtaactaaaacaccccctaaaaatcaagtttcaaactcgatcaacgatgttgggtgagcttcgtgacatagagtcaaaggaatcttgtgtttctcgatcggcagcaagtaattaatcaagacgaatattttgtggtaagttattgagatacgaaattgctcgtgtgatatatatatatatatatatatatatatatatatatatatatatatatatatatatatatatatatatacatatatatatatatatatacacatacatatacatacatacatacatatacatatagtatatatatatatacatatatatgtatatgtatatatgtatatatgtat

SEQ ID NO: 10525 - DNA, 22793 bp, Oryza sativa
atacatatatacatacatacatacatatatacatatatacatacatatatacatacatacatacatatatacatacatatatacatatatacatatatacatacatatatatatatacatatatatacatatatatacatatatatacatatatatatatatatcagagccaagtgctcgtaacctccccaagccatcttctccgaaagggggggaagatgggtcgggtagcgtgctgaagtcgcggtgatcccgaacggtgtggtggtgttctgaagtcgcggagttcccgaacctttgatcggttgcccgaagtcgcgttgccttgttgagccacagaaggagtttgtcggcgtaattcgttgactgggcacttatcaaaggcaaaggatgaacttaattgtgggaaatattccctgccgttgactggaacacatcatatccaaataggttgatcataattgtgggagatttccccgccgttgtctggtaactacctacctatcttcctatctttcgtataagatgtcttggttggttagatcacgaagagccactgatcgatctgtagcctcgtgcagtagcgagaagtctgttggcactatgtcggtaaagaatgcttcatctatatcttttgaggatattgagaaaagtatttccaactggaagattcctaaggttaatattaaggaaatatatcatgtaggtactttttcgttacttagtaactactatattaaaacaattgaaaaaactattccaattagttctttgcatgaaaccctgcatcttctttcagaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttacttggcatgatggaagccagcctcagtaatggtcttgtttattttaacacctttcctgatttttctgtatccctctcagacacagatatccataaagttctcactctcaacttacaaacatctggttatgaactagaactagggagtgaaaacatctccgttacctacagagtttactacaaagccatgacaactttagcaccttgtgccaaacattatacaccaaaaggcctaaccactctccttcaaaccaatcctaataacagatgtactacccccaaaaccctgaaatgggatgagatcaccctgcctgagaaatgggttttatctcaagctgttgaacctaagtctatggatcaatcagaagtcgaatccttgattgaaacaccagacggagatgttgagataacatttgcttcaaaacaaaaagcctttctccagtctagaccttctgtcagtctagattctaggcctaggacaaaacctcaaaatgttgtctatgctacctatgaagacaactccgacgaaccttcaatctcagacttcgatatcaatgttatcgagcttgatgttggctttgttattgccatagaagaagatgagtttgaaattgataaagatttgcttaaaaaagaactcaggcttcaaaagaaccggcccaagatgaaaagatactttgaaagggtcgatgaaccatttagactaaagataagagaactttggcacaaagaaatgagagaacaaaggaagaacatctttttctttgattggtatgaaagtagccaagtcagacacttcgaagaattcttcaaaggaaaaaacatgatgaaaaaagagcaaaaatccgaagcagaagatttaactgttatcaagaaggtttctacagaatgggagacaaccagtggaaacaaggtagactctgttcatcctccatttgaatccattcaattatctcataatagaggaaaagcttgtccactaaaaagtatttctaaaaatacatatggagaaacagcaaaggttgaacacataggacatttggtagaacaacaaaattatgcaaatatatctctacgttctcttggtcaacaaacagatcgaatagagacaatccttatggaaggctacaaaacaagaagacctgaggtaaagataaatattccctctaattctcagtcttctagttctcagtctgttagtcctatgtttgtcccaacaattgatcctaacatcaaacttggaaaacaaaaggcttttggacccgcaatttctgaagaactagtcagtgagctagccttaaaactaaataatttaaaagtaaataaaaatatcaatgagatttctgataatgaaaaatatgatatggtcaacaagatttttaaaccttctacacttacttccacaactaggaattattaccctcgaccaacttatgcagacctacagtttgaggaaatgcctcagattcaaaatatgacttactacaatggcaaagaaattgtagaatggaacttagatggctttactgaatatcaaatctttactttatgtcatcaaatgattatgtatgctaatgcctgcatagctaatggaaacaaagaaagagaagctgccaatatgattgtcattgggttttctggtcaattaaaaggatggtggaataattatttaaatgaaactcaaagacaggagattctttgcgcagttaaaagggatgatcaaggaaggccattgcccgatagagatggtaatgggaatccaaccggtaacatttctgatgccttagccactttaatctataacataatttatcactttgccggaaactatcatgatatctatgaaaaaaaatagagagcaattgataaatttaaaatgtaaaacaatgtcagattttagatggtataaagatactttcttgtcaaaactatataccctaccagaacctaatcaagacttttggaaagaaaaatatatttctggtttacctcctttatttgctgaaaaggttagaaattccctaagaaaagaagggggagggagtataaattatcactatctagatattggaaaaatcacacaaaagatacaatttgtaggggctgagctttgcaatgacctaaaaatcaaagattaactcaaaaaacaaaggattcttggtaaaagagaaatgggagatttttgctatcagtttggttttcaagatccttatgtctatagaaaaagaaaaacccattccaaacctatgacaaaaccaaatgataaaagcaagatgagctttcaagctaccaaaagaaaaccaaaaagaatttacaatatgaacataagaacacaagacactgaaagcaaagaaaccatttgttacaaatgtggcttgaaaggacacatagctaatagatgtttcaaatccaaagttaaaaaagagatccaagccttgttagattcagaatcagaagatgttaaagaaaaacttgaagcaatactaaataatatagacaatgactcaagttcagatgaagaaaaaaatgcagagattaattgttgccaagacagtggttgctcttgttatgagccagataattcagaagaagagtctgatgaaaatatactcgttttaaccagtttagaagaatttgttctcgatacttttgaaaccattcaagatccagaagaaaaaagaagagttcccaaaaaattcctttcaagagtcaagactgataaggataaactaaaaaaggatattcaaaagagcaaattcctccctattgatgaagtgttcaaaagattagatgaacagaaaaagaagaatgagaaatcagatttgatcagcctattctaagaccaaaaaattatgaaacaagatttagaagaaataagaaagcgtctatacatgttagaattaaaagaaggattccatatggaagaaaaggacgaaccaattcaagaagatgatcaggttgttggaaccattcaaaaatatacgaagcaaaaatggtacgcagaagttatgtatcgttttatagacggatcctattttcagcatatcactttaattgattctggtgctgatgtcaattgcattcgagaaggtattatccctcataaatatttctgtaaagccacccacagaattcgtggggcagatggaggacttttaacagtagaatatcaaatccctgaaatctatatttgcatatctgaactttgcattaaaacatcttttctactcgttaaaaatcttaagcaagatgttattttaggaacaccgtttttatcactcattcgtcccttccttgtcacaaacgaagatattcaatttgagataatgggcaaacaggtgagcctaagattttcgtctaacacagatgagattcttgaccagcttgttcagaccaaaagagaacaagttgtgaattcaatatatttacatgacaattctttcccaaaatctatggacttgccaggtaagacatcatgggaagatagatatttattaaaagctactaaaaattttgaatatatatgcagggaaatggcttcacagaagtctgaatggttcacgaatatgagttcatggagactgccccaactgccgagaggccatggagaacgatttaatcacaatttcagagtaacagagctacaacaagagttattaaacctcttgtggaaggcaaaaaacaaaaaataaaaagctcatgccttaaatggcctggcatattatttcaaaaatttcgtgccctcagatcaaaagataacagaaaaaagggctaaactacaagatatccctcatcatgaggagaggttactagattatcgcgagaagaaatcccgtgatggccaagataaacttcccatggaagttgaacaatctatggcaacaaataagaataccaaggtattctcagataagattttgatctcaacagatcctgcttcgagcatggttgctttccacataaatatcaataacctattgcaatcttttccacataataaaccatcatcatccacaaaaaagcatgataccattccccaaacaccatacatactgcataatcatcccaattcattccttccacaatatatactctggacccagccaaaagctccatgtagatcttgtgcctacaaagattcttgccaaaagaaacttaaaagccaaaatcccatgagtaccacatacgaaaatctccaacctagattaagcttcaagacggagcaaactttatcttgctttgggcaagacatcctcgatcttgtttggcaaaagtttaaggagagacaaatgaaaatattccttggactccaagattatttctttgatctcttagaaggaagagaaagaaacccagccatacgagtaatcatatatatgctccctctcttaaggctagatgatcaggcaatctctgacccatcctatagattcctggttctcaaagctgagataaatctccaaagattccggaacctacccacatacaaccatgaagaaatatctctccaaaccattatagatcatggtcttgtgaattccatctatgcaaccctcgatcagatccttcaatctgatttaggaagcgctgtgaaagatgtctgcaggagacttggacatggaagatacaggattatcttctcctccataccaccaaaattcacaccacctgttcatccaacaattcattatatatatatatatatatatatatatatatatatatatatatatatatatatatatatatatatatatatatatatatatatcatgaatggacaatttaattttcaagaagacagtcctagcaaactatcggatgaagaggaagaaatatatacaacaattgctaatcatgaaaattggagattattttctgaagctgcagaaattgaagaagctatcaccaccagattatgaatatcagctagttttccaaaacaagatcacaaggatttttatcagcaaatattacaaccaaagttatgaatacttcaagggagcagggcgcataattaaaccggattttggaaatgaatgctccaagaaaagttactacagaagcctggctcagtggtttcagaaaaaaacagagccgtcagagatcgacacggtgcaatcagcacccacgataatcaacgaagataatgaataaagatcttgtcatccccgacaaagatcactattcaagataaggaatctacactattcaagataagataagtccatagtcaaaaggcgatattatgacatctttattaaaggtctaaagcgtcatcaccaaagattctctccatgaagtctaaaggggtatcataaactctttgaggtcaagaagagatatcatgaagatactctaccgagcgctatataaggggctcaccatcacatttcacaggcatcgcatttcacacacaacacatctcactcaaccattcctctcacctctccaccagccatcacactccactccactccatctaagtgttagtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacctatcaaggtatatgaatgaacacctggactgttctatataaacctactatgttctcaatatctaattttatatcttgtacataatttgtatttatagcttgtctttatttcttgtactgcatttatgtttgcataataatataaaaaaaattaacaacctggattgccatccaattgtcacatactaatctcacatccaagattgcatatagagttcatgatatcgctttagacttcatggagagaatctttggtgatgacgcttttgaccttcaataaagatgtcataatatcgccttttgaccatggacttatcttatctggaatagtgtagattccttatcttgaatagtgatctttgtctggaatgacaagatctttattcattatcttggtgacaagatctgtcgtcatatctcgactaaatgtgtgttggattgaaatctaatattccttcatctgaatcattatcttgcttaattgagtaataaggaggtattggcgaagatggcttaatttggctgcattgtaccatatcttcgtctagacttctgcatgtagaactagattttggggattcttccaatcttttaaacatagtttcatatacttgaagttgcaattctccctttgtcaactcggatcttgcctttaataattctcttgttatatcttcttttaattgagccacatgagatttcttgtttttggctcaaaactttcttccttcaattactggtgtgattgcaaacttatcccaccatcttgcataatagtttcgctttaaggttgctgggaactccattctttgaatattgaggtcccattttagtatccaaggcatccctgtttcggcacaaaattgcataaggataaaaggatattccttgagatccttttttgattcttgtgtaataactttgatgatttcttgtggtaggatttcaggaatggcccctactttcagccaccaattactgaaaaaccacagtggtatctcctcacatccttctttgaagcgaataaaccatgaatgcttcatctgggaattttgtacaaggagtactctttcccaggccttctgataatcccaatagttatatcttttatttgcacaggatgtagaatatatagtcctggcaacatatggatttgatgatttatcccaatcatcgatacttataattttttgggtcaataattttgtgaatcccaattcatcactattccttgtatggaatatctgtgcacttcttgtctcgcataatatggtctcataataattttgatctttccctggatatttagggataaaatattggtgttgtgggaaatactttcccataatcttgataatattgagatcagagtctccaaattctaatggcagaattacttcctctatattgaggatataagatgaattattcccatacttttcttgaactgtaggggttctaggaataatatttcctagttcattatatttatgcttatttggtgaactttctgtagttctcccttgggctgataagtcccttttaggtgccatagccctgtaaaattcatgagataagaaatctggtagggagtttaattctcccttgatatgttctatttcaaagtcaaagcatgataatattgcttgccatctggcaaaattttgtttggagactaagttctccacatccttttggaggacatcttttgctgccttacaatctatacacggcaagaatctttgattcaataattctccttggaattttgatatgacctttactatggccaatgtttcttttttgatggttgaataatatttttttgagccttattccaggtcccagaggtgaacctgaccaactgctctctggaatcctttttttgtttaagaattcctccataaccatgatttgaggcatctgattcgataattttgaaggcatcttgatctaggatataaagacagggcaaggttttgaccttacctttgatcttcttaacagcttgagtatgtttagctgtccaagctggaggctttttctttaacctctcggttaaaatctttctgtcttttgcaagatctttctaaaaatcggagacatagtttaaacaccctagaaatctttgcaactgtgttttatcttttatctcatctggaaatttttctgcaaattctattactcttgctactggttggactcgatcatatttatatatgtatgtatatatatatatatatgtatgtatatgtatatatgtatatatatatatgtatatatatatatatatgtatatatatatatatgtatatatatatatatatgtatacatacatatatatatatatatatgtatatatatatatatgtatatatatatatatgtatatatacatatatatagtaaatttgtttggtgctccatggtgcccgggcaccattgttgaaattgagtatatacctaattcaaatgagtatgaaactttttcaattacttaggtattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcccgggcaccatggtgccccatatgagtgtcctatatatatatatatatatatgtatatatatatatatatatatgtatatgtatgtatatatatatgtatatataccgtttgaggtttacccaatccgaagcttcgttgcatcgatcgctgtcatcatcgagatccggcgtgttgacgatgaaaacactaaatacgaaggaggtcgcaccaacttttcacacaaaaatttttaacattgtcacatcgaatatttggatatatgcatggagtattaaatgtggaaaaaaaccaattacacagattacgtgtaaattgcgagacaaatcttttaagtctaattgcaccatgatttaacaatgtggtgctacagtaaacatttgctaatgacggatcaattaggcttaataaattcgtctcgcagtttacagacagaatatgtaatttgttttgttattaaactgcgtttaatatttcaaatgtgtgtccgtatatctgatgtgatacgcaaggccaaattttttttttaaactaagctgggcctaataggaggtggatttttcatcccataaatattttatgcatttcatccaaaaaaatcatcaaatattcttataaatgataagatagatcgtaaggtgctatatcactttacaaattatatgcaagtttaaattcaacatgtaactttttttcaacttttttttcaacttgaatttgaatatttacatgattgaagagtgatgtattacatattaatctatcgttaaattttttaacaaaatatgatttttttaacgacattaaaaaaagaggcgatgtccctagaggaacggataaacttttatggtagaaactaattatttattatctctaatactttaaagagtaaaatgcatgggcggtccctaaatttgtgcgggtgtgtcaattaggtccctaaattctaaaaatgaaattttgggtccctcaacttgtctcgggtgtcatataggtccaaacaggttccaactcactccatgtggtgacgtggcataccatggtgacacatacgtgtcagtagaacccagttcagccacatatagaaaaaaattaagaacatattttttcttctctcttttttcatttattttttcaaaattaaaaacatacttttcttctctcttttttaatttttttccctacttgactgacatgttgatgccatatcatctcacggagcgggttagagcccgtttggatctatatgacacacatgacaggtttagggacccaaaaatgtattttgagagtttaagaatctagatgacacatctgtataagttgtataagtttaataaccgtttgtgcacttcactctactttaaaaatggagtcgtcctccttccatcatatacttttcttgtatttctcatcgacaattaactaagaagggtattccgaggtaatgctgcatcataatgcatacgatttggatgagtaaggaaataacataattaggctagttgaaagttttgttaaaatatataaccatcgggactatgaaaacactgtagagccacagtgtttgtctttatattttgaatatgggaccagagcatagcattgactcaacgatttctttgttgatttctttgtttagagcaagtacaatatagcaaagtctcattctagcgccaaatacatcatccaaatacacatgtggaggggagcaagaaaattggagagagggggtagcgggcgcttattctagcgccaggctgcagcataataaacaatgtaaatcataggtaacgatgcaaatcaggaaattgcttcccatctgctgtccgggcaaaagagaaaaatcgaacacgcttcatgcaagcctgtgctttcaagtgtgcatggggtgtgggacccatggaagggtcaatcaaaatgagagggatgtatcgagttaagacttcaaaattcaaatgtttttttctcctaaactacttatccaatctaaaatccggttacaccattgtatttgttggaactaaatcattataacaaagatatcacatgattatattccaattaaagaaaaatataagtttcaaactattaatacttcatgtttcatacgttatatccatatgtttcagcgcctgtttttaatgtgtttcacaaaattctcaaaaataattgccactatcctctatcaatgcttgcatgcatacattttagcggtctttaaaatgatttttcttctaaactacttatccaatctatgattcgatcacactgttgtattcattgtaattaaatctttacaacaagatatcacacgattatattttgatgaaagaaaaatatatgtttcaatctattaactctcgttgtttcataagtgatagcaacatgtttcaacgtgtatcgtcgctgtgtttcataaaatttttaaatgtttccgttgctgtctttttgtttcaccatatataaattaatgtttcacttgttgatcagctgcaacattttaaccgaccgatgttttttgagatatcagacgtccgattggtagtattctcctgcaaatcaacgcaatgtgctggccctatccaaagaacaaatatcattggacagagataagcaaataaaattgagaacatagataattacttcattgtctaggagagtgtgtataggcagcttagcaactagctaacgtctcttattggcatgtacggccaagtttagttttaaactttttcttcaaactctcaacttttctatcacatcaaaactttcctacacacataaacttctaattttttcgtcacatcattccaattttaaccaaactttcaattttaacgtgaactaaacacacccaaaaatacgaaccatctgttcagattctcttctcgatcattctctctttaatttatgctctttccaccgaatcagcctatacatgccacgtgtatcgtgcatccgttctagcgaacattcccaactagtactagtataaaaaaaaggaaaaaactactattccatcttgaaaaatatttaaccattagcgggagagcgctacgcgtcggacgtacggcgcgagacgaaaaatcggacgccttgcgcgaccgtccgatccatgcacacgtgcgtcagccatccatcatgcatggatcaaacgaattttaaacaattttttcccttaaaatatttatctaaatcatgatccgattgcactattaaatccgttgcaattaaatgtttaaaacaagaccacacatgaatataatccaatgaaaaaaaaatagcttattattgaattattttaaaatgttgcatgctgttgcgccaaatatatcggaatagtttcattgagtagatcgaaaatgttttatcggatgctgtttcaccttatatgaaaatagtgtttcagcgaatagcgaaagtatgtttcaattcactgcaacatttgatccatacatagtgaaacatcatgagtacattaggtgaaacattttttaaattaaaaaaaatcgaacggttaaatgttgcagttgaccaacaagtgaaacattatgttatatatatggtgaaacaaaaaaaatcagcaactagaacatttaaatattttataaaacatggtggagatacacgttgaaacatgtcgctgtcacacgtgaaacaacaagtattaacggattgaaacacatgtttttcttttatcaaaatataatcaagcgatatcttgttgtaaagatttaattacaacgaatacaatggcgtgatcgcatcatagattgaataggtaatttaagagaaaaatcattttgaagctttgcgaaaatacatgcatgtatgcatgcatgaggtggagagagagtagtagtgggtagtttcaggaattttgtgaaacacactttaggcacatattgaaacatatcactatcatgtatgaaacattttgttttaacagtttgaaacatatgtttttcttttgacataatataatcatgtgatatcttgttgtaaagatttaattgcagcgaatacaacggtctgattggttcgtaaagtaatttaggagaaaaaaaaatatttaaatagaggagaaaagaatgaaaagaaatagttagacatgtgcatgtatgttacagtacgacaagggtttgtccaatccaccaggctactgatttgcagtattttcctgacatcaatagagagaaaggagaaattagcaagtaaggactgagctgaccgtaggcgtccgacgtttttcatctgatcggacgttcgaagagaagcatttttgacattagtgtttactaatttaacacctataaaccggaggcaactccggcttggacgtccgatgtttgggggaaatcgggcgctgacgttagcgcccgatttacgtgcaaaaactactttaaactgattttaatcttaaattacttatccaaatcatgattctattgcaccattaaattcgttgcaattaaatcttcaaaacaagaccacacatggatatatttcgatgaaaaatttttttagcttattattgaattatttttaaatgttgcatgatgttccaccaagtatatcggaattgtttcactacatagatcgaaaatttttcactcgtttaaatcgggtgttgtttcaccttatataaaaataatgtttgagcaaatagcgaaagaatgtttcagttcactacaacatttgatccatacatagtgaaatattataagtatactaggtgataaatattttggtggaacaataatagggggtttccaaaatatgtgggttttttgttgcaatggactatttcagttcactgcaacattagatctatacatagtgaaacattgtgagtacactaggtgaaacatttttgatggaacaaaaaataaaccaaattcccttaataggggtttgcaacggcgcgttccataatatcaaaatccactgcaacatttgatccgtacatagtgaaacatcgcaggtacactagctgaaacatcgtaaaactactggttgaaatatcaaaagagatcatatgcaatattaaaaaaaatatcaatagaaaagctaaaatattttttatcaaaatataatcatgtgtggtcttgttgtaaagatttaattgcaacgaatacaacggtgtgatcggatcgtagattggataattagtttaagagaaaaattgttttaaaactagttaaaataggagcggcagaggcgcgggggcccgaggcgtccgatttttccaactgccgtcgggcgcccgcgcggagcattctccctgtaaacctacaaatgttatacacatatggtaagttattaaacaccacatctaaaatgatatatagttaatgccataaaaataaactagtactactagtagcaccctaaacccaaattgatatacgtctcttttcgaaacaatgagcttcacttctttaagagtctccggctatcaaaaactcctcaaacaatttagaattttcacctaaaatctaactaaaagccagaaccagctgttttttagaattttaagtttcacaaacaaacattttaaagccatcagtcgattacaattcagctagccaccatcactccacctgctgaaagcactgcccgagtagcagagcagtaacaactggagtagtaaacaagtaggaatacaaagcaagaagaattaatggccagcgtcgtcaatgccgccggcgacctgcacgtccgggttgtgagccggcgactcgttcaggcctccgacgaatccctcgtgccgcgcgtcctcgccgtctccaaccttgacctcctcccgcaatccatgcaggtctccatgctctgcgtctaccccaagcccagctcgatcgccggcggcttcgacttcgacgacgtcgcgtcgtcgccgccttcgtctccggcttgccggactttctcagccacttcttccccttcgccggccgcgtcgtcgccaacccgttctccggcctccccgagatccactgcaacaaccaaggcgcggagcttgtcgtcggcgaggtcggcgtggcgctcgctagcctggactacggcacgatgggcgcgtcgttgcggaagatccagctcccgcacggcaaggacgtgccgctgtcggtgcaggtggtgtctggcggatacaaagggtggtccgggtggttccgggaccacccaaaaaaaggcgatgaacccctattaatctttttctattataaaagttttaagatgtttttaccagaaactttcgtacgtcacctttgttgagtcggtttcgtattccgaatataaggcttctgtagaattttttttgtccagcgtcgcacacgctcgcgctgtccgattccatcacccggcatcgagcgcgcgttttccgcatcccgtgtaaaccacgcaaggcccacgactgcaagcaatcaaacccacaagccaaatatgaaacccccgtttcaaaagttcccaaattagaactctaaatttcaaattcagatgatgaaaaacaccaaatcaacacgaaaggaagttggatatggatttgatttggactcaaaatcgggtgaaattaaccccataaatacaaggatttcatgggactgctacaacaagaaatcgaacaagattgatcaattggtgagatctcacctaatttcacggaggcggctttcctcgctggcaccgtggacgaggacccgccgtcggagccccgccggccgaagcgcgcccgtgccacgggacttgccatccacaccgccagatttgcaccctaggtcaacacctccgctcaagccgacgccagatcagccgcatacagcccgcgaccgagctccacctccagtgccttgacccaccgccctgaggtttgccgccggtaccgccgtccatgacttgatctccgtcgccgcccgtgcccggagctaacaccggatccgccgcctgcgacccgagccgccaccgaatccgccgcccgcagcacgcgaccgatctccacctcttgtggcttaacagcaccaccccaagctttgccactggtactgccgccgctcgcgccccgagccgacgctagatctgccgcctgtaacctgagccattggcggggcaaagggcgcctagctgaggggtaggggagcggcgtcaccagtgtggggaggaggagggggagtaacgccgctggtagggggagagggagggtgtcgccagctgataggaatgcgcaacagagaaagagaggaggggagatttgcccccccaccagagcgaaaagtaggagcggtggaggcggcagcttgatgtgccccccaccgcaggtccacgccatcgccagatccacatggactggctcagctcgatgccactctgctcatcgccagcctcctcggctggctcagatcatcgtgtgctcgccgtctcccagccacctccgctgcctccgttatgcatgcagagaccggcgaagccggtcgcctcttccatctatcaggcaaaaccggatcgagtagtagcgcagtacagtggagcatgagaattggaagatagagatggacggggaggccaccgcaccgctcccaaagaccacatgcgaacttgcaggtggcattgactcctggcatttttttattttaaaccctaatagtatcttttatatatcctatacttcagtaaatacaaaatatttttaaaaatacccctaggttagtactcgcacattaatatccaggaccttggaagtttcaactttttgagactgatctgatgtacaaagagtaatcttttatggctttgcatattgagttgactatacagtccttaacctaatatatatatatatatatatatatatatatatatatacattatataaatttcgtgattttcatgtggtttgacaaattttgttaatctctactattataaaaattgaagatgtttccacggatactttggtgcgtcatccatatttgagtcggtttctaaattcgttcgcttttaaaaatacataaggagtcgtataaaaaaatcctttagaaaaaactggcatgctcccctgtgattagagtcggatacctaatttcttcagaattttaacaagccatagaaaaacaatatataggatatagccatcatcccaaccaggatacggattagatatcaataatatctcaaaataaaattcccatgtactttttagataaaaatatctaacaataatacgattaaaatagcattcacccgttgcaaagcacatgcatgttttctagtaataaaaaaaagaaaaaaagccatataatccctattccctagtcccgacgcgctattccctaatgacggctgcagagacggagagacccacacacgcgcgtatggaatcgatctgacgcgatcacgactctctctgtctctctcctcatcgccgccgtagcctatagcaactgccctagcctggctagcgacgagccgatgagagagtctgcggctcacgcttcagctcatggtgccagctggcctagcttggtgcggctgtatgagcccgacagaggagtaggacgacgcggccaggacagcactctcgtacgtcctccccaacaacagcgtgggctccttccgatgtatgacttctttggccaaggccacggtggcgcaggcgtacgtggtccttgctgtgcggatagaaacgacactccatgtcgagctcagggcatctttttgctgcttgatgcttcattgcctcctctccgacctctcgccaatggccaccaccgatgaatccatgcctggagaaagaatgacacgtttcactcacatgtgggacccacaatctaatggaatgccacgtaagcgtcccctaaaaccaggctgattaataaggatcttgtttacaccggttttaggagatgagtgatatgttgtactatcaggtttgtgatcgagggatgtgattaaaattcaagcttaagatgaggtatgtaaagtaaacttattccatttggactatatgctccggcaatttcggcccatacatgctgtcaaatctgtctcttagaaaatttggcctatttcgcacgcaaatgcggcccactggcccaatagtgattgcaattttgtcccatatccgcatgcaattttcggtcgacttaaaactagccaacgtgaagttttgcgctattggggagaactacaaatcggacgtccgatgttgtaaaaaaattgaacggtcaaatgttttagaagtggacggtcaaatgttttggatgttgtaagactagcatatgggctgaataacacggaagtgcaatgtccattcataatcaatagaggttttatactatctatatctatgtttttaaatagataacatcgttaaatttctgacatacatttaatcatttatcttatttaaagaaaatataagatagatagttaaatatgtgtttaaaattcaagaatatcatctattagtagaaaacagagggagtatatatggtcatttcatcactataggccctgtttggagaagtagtccagagttattttgagagccctccaatgaaatagcccttgagctgtttggatgcaagagctatttgacctttagtatacttttccaatcacaaataccccttttctctctttctccactggatcttttgcacatgtgtcttggtgtggccggctgcatggtcagtgctctacatggccggctgcatatgccatgccgttgtgctctatcactaggacagtgctctatctcataagcttgtagcataaagggagaaaacaataaagtttttttatttaaaaaaagagatcaaattgctccgtggaggcgtggagtgctcattccattgcataagcactgatacatgcattgcattcttcgtgcatacattattcaagcatgtgcatatattattcaaacaaaaaaaaatcgaagccagatgcttggatttggatctttcgagaagaaatcgaagccaccaccctccatggacaagaaaacaaatcgagcagtggagggccggtggcggctcaagtgggggccggcggcgaagcggttgacggccggcgaggagcggggccggcggcgctggtggggaggaggtgggggcggcggcgctggtggggcccgacgaggagtggaggcggcggcagcgaaaatgccccgcgcttgcgcgcgtagtcgtgcggagagagagagaggaggttgcgttttctgatcccgtgcgtctatgggagagagaaaagccaccttttttagtgggccccactcaaaatagctccaattagcaccccttgagtggaatagtttttttgggtgggctatttccaattagcccttaaatagctcacccttttgaatcttttggagctatttgggctatttaagggagggataaaaatagcccttggatacaaacagggcctatgttccattcatgcctgtgatatttatatcgtactgtttagatgccaaatttcataactactttcatcatccttgttaaattgtattctgtctggattttctttcttttttaaaaaaaatactgcatgtctatactttgtactgctaagtcctaatctttacaagtagtaagataagaataaataacaaatcataaggtttttagtcatcaagttttcagctttctccattttaaattatttatacatcgttctccgtttatcatcctaagtaaaaaaatttctatctctaactatcaatatgttaaaaaagaactgtagagtttaacggtggagtagttctctaggtgaatctgaagcccatagttcgctcgctaactgcgtagtctctgctactttaacgcctggtcctcttcccaccgagaaaccccgtaaaaaaaggaaccggcccatccttctgaaatgaaaaatgtaaaataatttatgagacttcctttttgtcagcattgcaatgtaactagttctgtgaaaagaatatatagggtccaatttagagtaaattgtactttgggccatgttttattgctaaaattttaatttggatcaccctaaaaccaatcttttttactttagattaggtaactttacctttgttgtataatgaatcaccctaactatattcactagtcatgtctaatgtctccttgataaaggtatggcatgcatataggttaactatattcatcggcatgtcgttaataatttgctcgaagtcattgaagtgatgaagatatggtttagggtggtccattgtataataaatataaaattatcagtctaaaatgaaaagatcggacaaaggtgatcccaaatgaaactttagcaattaaacatggcccaaagtgaaattaactcaaaagtttatagtaattacgacttctcacaaaactttcatccctttaaaatggttcagattgtcccgcagattcttgtcatctaaattctgaaaaatatgtaatcgtagaatgcataaaataaaataaactaaaagctagaggaactgaaaaaccagaattttaactcctcgcacagagtcataggccctgtttggggagcttctcccatctgcggtttttcccaaaagctgcttctgctagaagctaccccaaacagtccacagcttacagattctgaaaaatgaactaagaagtcagaagctgaaggaactaagaagtcagaagctggagaagctgggtttcagagcttttctagactctcagaagctaccaaacagctgctgctcaaaatctaaagctccccaaacaggcccgtagtactaccgtcataacattgcttccgagcagagaaagcaggatgcagatgccgttacctgcatatatagagccatagatataaaaccggagcatcgctttttggccacttccaacggacgtagccgtctcatgcctaccaaggatcgtgcttcgtgcatgcagatagttcacgattaatttatttgctttgttcatttgtgaaaaaagtacagttttgatttgtctgaagagtgcgtgccaaacttcaactttaattaagtactagagagtaggcaccagagacttgaaaagttcagcaacttttggtaaagtaggtaggtagattcaccattgcattgtgcattgaaattattataggaccaacacgttgacaatttaattttcctaagctcgatctcatcatgctgataagttattaaaaagtaaaccaaacaatttaaaaaataaattatggataaaaaaattatatattcgtgttggttgcagtttaaaagctaatgctagaaaacagctatgatgagaaagctaaaaaataattctaacaataaattttaaattttaaattttggttgcggttgaaatcggtcgatgagaggcataaatggcttgccttggtataatgctgtcaacgattgagacgtgcaagctactcgctagctagcaagcacacatgagatgatcaagcagctccagttggtggccgaacttttaggactatcctgaagtgggttatgagctactatagtttaacagtggagctacatatactatttcgagataacatgtatgattagctataaagttttcttccctctctttctctcacttatataaaacatatgtagaatggcttatagcctactattaaacttgctcttagggtgagtctttttcctattggttgtggtagctcgacgacatataaaatgagacaagtcattagtttattatgatcaattgagtattaattattacaaatttaaaaaataaatgtatttgacctttttctaaagaaacttctacataaaatatgttcaaaaaaacagacataccgttcaactattaaaaagagttgctaacgaaaaataaaagaataacagtgggacctaagatatggagtatagtggtgacggagcgtggggctcctcaccgggagaccgcgcaggcccccctttgccggttcggccgggggccctggtgaggttctaagctcctggtctgtgtgtggaaggttcgcgagagtggaaaaagcacaggacacgggcgatgtatacaggttcgggccgctgagaagcgtaataccctactcctgtgttttggtggatctgtgtatgaagaagctacaaagtgcgagccagcccccgatcgttccaggatcgttttttccttttctccctttccctaagtgggcaaggtcctccttttatacctcaaggggataccacatgcaccatttctctcttttttgtggggacttatcctattttttcctaaacagacggagacttggcttctcttcattaatggacggagatttgtatggctggccgtccgaatgaccttttgatgggacgggccatacctaccttcactttccgccgaaagcaggcgcgacgtgggaacatggctgtctgctgacgacatgaccattgttagaccggtcacaaatcgg

SEQ ID NO: 10526 - DNA, 11713 bp, Oryza sativa
ccccccccccccccccgagggggtcaggcctcgtgggcgattgctcctgcccaagcctctagtcatgatactcccggtcctatgtcaccgacagtagcccccggcgttatgccagggcgatcgccctcctcgagggaagcggtcgggcgtgacgtcacttcctaaggcctggtgacaggtgggaccggtctcaacagttgggcagaaacccaacggtcgcaaatcacgcacatcggcaatggttactcggctgtcaataatgagcagtctcttcaagactgccacattactcgagtaacacgcgaatcgggacgagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgcctcttgcaccctaactccttgtttcctgtgccctaccttcgccacacgcgctcgctctcaaacatctcttcttccggcgtcatggcacggggttccgctccgcttgacggtagcgtgctgccgccttcccgcatcgtgagcgagagacaggccgggctgccgcgccgcttcatgccggaatctgccaccggccgggagatagtctcgttgggcgagggatgcccggcgccacgctacccggggcggtccgtcttcttcctcccttttgctatggcagggctggttccgccattttcttctttcttcatggatgttctggagttttatgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggctgctacttccagccgcgggggccggtgctgaaccgctacattctctgcgtcctccgcaagaagtgggatgactggaagagcgactggttctacacccccctcgccgacgaagcgcgcctccaacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggattgcgccactccagcggcgcgcccggggcgcctggagtacactgggtccgaggactgtatgaggacccaccagggagtcagatgggactgggctcctgaggacttcaagatagtggtccaacgggtgctgaatctcagctccgtggaggcatccctcattcctcaaggagtcctccccctctgcagcgatccagaccgcgcctccatcctggccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcggccgccctgccgacgcccgggggaagaggaagcaggaaggaacccctcccccatctcctccccaagggggtggggcggcgcgtgccagcagcaggcgcccggagggggccacgccgacgtcgcagcccgagggggagcggaagaagaaacggccccgcaagatgggggggacagaaccatcccggggaaacctcatttcccctccaaggtggtcatttaaccgaccccctcgcaggttcgtcccacgcccatcgtggccgtattcattccctcaatgcgagttttcactcatccatcttgtttgtcttctggtctttcttctgtttcagcgagatcccgtcgcgtccctcccgccattccaagtccggccagtctgaggccgaggacccggcgaccacagaggcacggaggcgggaatctgtccggcgagaagccgcggatcgccttcgggaagccgaggaggccgctcgggaggccgcccgggctcgccagaccgaggaagccgctcgggaggaggccggactccgccaggccgaggtgatgacatcctccgaggcgacccgtgaaactgaccggcaagaggccgcggatcgccttcgagaagccgaggaagctgctcaggtggccgtccgagctcgccaagctgaagaagccgctcgggaggaggacagacttcgccaggccgaggcgacgacgacttccgaagcagctcgcgacgaggccgcgggcgcatcgcttgggcccactctctcgtgcgacgctcaagacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcaaagaggggcgtcgctcggtggaggccatggtggaggtgggccgcaaggcacaccgccggcacgtctcagagctcgaagcccgtcggaaggtgctgggggaggtcgccaaggaggtggaggaggagcggggggctgccctcatcgccaccactgtgatgaacgaggcgcaggacaccctccgccttcaatacgggagctgggaggcggagctagggaaaaagctcgacgccgcccggggggtccttgacgctgccgctgcccgagaacggcgggcggcagagaccgaggtggcatcccggcggcgcgaagaagccattgaggcccgtgccatggcgctggaagagcatgcctgcgccgtggagagggacctggcggatcgcgaggccgccgttgctattcgggaggtcacactggcggtgcacgaagccgcctgtgccgaagaagagtccgcactccgcctccgcgaggacgcgctcaccgagcgggagcgagctcttgatgaggccgaggccgcggcgcaacggctggcggacagcctgtccctccgcgaggctgcgcaagaggaacaagcgcgccgtaatctggaaggtgcccgcgccgagagggccgcgctgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatttgcagggcgcgctagactcgtccgccggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctctcggagatagccgggactctccaacggctccccgaggagctcgagaggacgattaagtcatcctcgagggacctcgcccgaggagcggtggagctcgtactggagagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcattcgccctcaactccgacgaggaggacgatgacagcggagtgggcgatagtggcgacgaggctggcgacccgggtgcatcggagtgagcccccaggcccccgccaatctttaaatagtttcttcttttttttcttccgaggccttcgggcccccttcttgtatagactaatttaatctgcaatcaaataaagaggaaattttttgtgtcaattctatttgttgtgtgtatgagacaaggatgtctgtgccgtggttcttttgtgtcttggcttgaacaagggctcgcgcccaggtccttagtcctcaaatggctcgggtcggggctagtgcctggggagatccacatgtcgagactggccaggccgggagcgtggtgaccgagggttatgggtgacccgatagtgggtttttgccgattcccccccggagttcaccacgccccggggcacggctcggttctgggccccgtttggcgattttagccgacccgagcccccgagggcaggattgaacacgaatgacctatttcaagtcaagattcttcaaaaggaaacaacagcacagatacagcctttaggaaatcgaaaatacttttattgagatacagatataagagaaataagaatatgcatatgtggtagcccccggccaaccctgcacgcccgaggggggtgcggggttggcccgagcctgaaacctgacacccgatcccccttaggggtagaagcgacgaaggtgttcgatgttccacgggttaggcagctctgtgccgtcgctcgtggctagccgaacggagcccggccgggggacaccgatcactcgatacggaccctcccacattggtgagagcttgctcaatccagcacacgtttggacgcggcgtaggacgaggtcgtcgacgcagagtgatcgggcccggacgtggcgctgatggtagcgccgcaggctctgctggtagcgcgcggctcggagggcctcgcgccgccttcgctcctccaggtagtcgaggtcatctctgcgaagctgatcttgatcagcctcgcagtacatgatggcccgaggggacctcagggtgagctcggatgggagaaccgcttccgcgccgtagacgaggaagaaaggcgtttccccggttgctcggcttggcgtgattcggttcgcccagagcaccgctggcaactcctcgatccacgaatcgccgtgcttcttgaggatgttgaaggtcttggttttaaggcatctgaggatttccgcattggcgcgctccacttgcccgttgcttctggggtgggcaggtgaggcgaagcagagcttgatgcccatgtcttcgcagtaatcgccgaaaagttcactagtgaattgggtgccgttatccgtaataatacggttaggcactccaaactgggctgtgatgcccttaatgaatttaagtgcggagtgcttatcgatcttgatgaccggataagcctcgggccacttagtaaacttgtcgatcgcgatatacagatactcaaacccgcccgaggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcacctttatggatatcggcaagaagctcgacgccttgttcccgaggaatgcactttaggaggattccgttagccgcgcgccgatagagggtcccttctaccagcacgtagcgtttggagatgcgctggacgcgttcactcccttcgtggtcctcgggtagagtcttatctgtgaggtatgcttggatctcagcgatccaagcaatcaatctaagggagctgggagtgctcccctcgggtcccgaggcctggactccgacgggcatcgggggcctgtcaggcgcgtccgtctcccctatggggtcgggtcgcgccgacggctgggcaagcctttcttcaaaggcgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctagttaacgaccagctgggagtcgcctaacaccaggaggcggcggatccccagtccagctgccaccctgagtcccgcaaggagtccctcgtactccgccatattattggtcgcccgaaagtcaaggcgaaccaaatatctgaggacgtctccgctcggcgaggtcaacgtgacccccgcaccggcgccctgaagagacaaggagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaatcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggtgcactcgtcttctgtgccgacgacctcggggtcggaggacgacaggagcggccttcccacagtggcctcagggccgtcctgggggtcgggagctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacggggtgggggtgcgcggaatgaggattgtcctcatcgcgctccacaaccaacgccgcactaaccacttgcggggtcgccgctaagtagagtaacaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatacaaccggtgacgcattgcacatccctaagcttgctggggggcgcatccgctctatagctcgtatcttctcggggttggcctcgatgcctcgggcggagaccaaaaatccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgagacagggggtaagggtccttaggacatgccttgttaaggtcggtgttgtcaatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgcacggcgagacggtgctcaatcaccttcctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcgtcgcatgtgactatccgctgcctcggggcggcgggggcggatgtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaagaccgcgttgtagggcagactgaggtccgccacatcaaagttcacccgctccgtgcggaagttggcggatccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcctccatcaatgaggacacgccccagctttacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccctaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgagatcgtgaagggaagtgttgtgaacgatgcaccacttgccggttgggcgctccctgctgggagcgccggcctccttctttttgtcgcccgcaggcctcccctttcgggtggcccgcgaagcgccctcgacggcgaggacatgaccctcgtcgtcggtatgggctgacctcttcttcctcctcctatcacgccgccctgtctgagcagcggatccaggggcggccgaagctgccacaccggaaccggaggggttccaggtccatgcctcctccttacgagccactcggtccgcgagctgaaaaagctccgcggtagtctggggctctttggaggtgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctggactgcatgcagatccgcttcttcacctgggcgcggatatgtgccttgaaagttcatggtgaactgttggcacaaatcctcccaggagtggaccgacgcgggtggcaagttcattagccaaccccgtgcctgtcccttcagggccatgggaaaaaaattcgccatgactctgtcgtcacccccggcggcctcgatcccggtcgtgtagacctggagaaactcggcggggttgacgctcccatcatatttttcggcgatggtgggccggaaccttgggggccaacggacgttccgaaggctcgccacaaaggctctacagccgacaccaccaaccggggggcacggagggctgatccccgcgtccgtgttgaggtgagactccggacgaggaggcgccctccgttgcgtggggagtacgccgaccattacgccggcgctcgatatcgatgcgggcatctggccccccacgctgatcttcctgggtcggaggcgctgacgaaggagtggcggccgaatggcgagcaacagccgccgctcgccgcgccctccgccttgacgacacggagccagtggtagcagcgccagaggtcttggtggcggaggaccgcccaccagcacctaggcgctgccgtgccgtcatgaccaagttggccacgtcgtccagccaacgttgggctggagactccgagtcagggacaatgggcgggtgacgtaggagcgcgcccgcagcttggagcgcgccctggggcgtgctgccgtcgccgtagaggaggagtcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggtttggctccccatcgtcaccgctaacgctcggagagaggttgtgcgcctttgcttgttcggccattgggctgaacaggaaaagcttggcgcccacgaaagagtgcgagagctcagaagatcactcgcagagccccctacctggcgcgccagatgacagagcgtggggctcctcaccgggagaccgcgcaggcccccctttgccggttcggccgggggccctgggtgaggttctaagctcctggtctgtgtgtggaaggttcgcgagagtggaaaaagcacaggacacgggcgatgtatacaggttcgggccgctgagaagcgtaataccctactcctgtgttttggtggatctgtgtatgaagaagctacaaagtgcgagccagcccccgatcgttccaggatcgttttttccttttctccctttccctaagtgggcaaggtcctccttttatacctcaaggggataccacatgcaccatttctctcttttttgtggggacttatcctattttttcctaaacagacggagacttggcttctcttcattaatggacggagatttgtatggctgccgtccgaatgaccttctgatgggacggcccatacctacctccacttccgccggaagcaggcgcgacgtgggaacatggttgtctgctgacgacatgaccattgttagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaagagctaacacgccggctccggctagggacgagtgcttggaggctctcgtcctgacgggatggggcgaggcgtgcgtcagaccacctatcgcctcctaacccacgatctgaccggtctgtgactgatcacagaccagatgaacgagcgcgctgcactgcgctacatgcggcgtgacgcgctcgtccaaaccgcaataaatgcggttag

SEQ ID NO: 10527 - DNA, 2497 bp, Oryza sativa
ccccccccccccccgagggggtcaggcctcgtgggcgattgctcctgcccaagcctctagtcatgatactcccggtcccatgtcaccgacaagtggagccaggatcaagttagttatgatgcatagaaatattttttacataaaaattatgatgcacataattttttacatgtttttttcccattatttttgttgtttaacgtcatttttgtaaaagttactatcagctacgtacccatcgccactcttgacgtacataatatagtctttaaacccgttttaaaaatttaattctaactatgaaccgacatatatacttatcaagtacataactagaattaagctcttttttagacggaggatgtataatgcaactcgggcgcttgcgatcacccgaggtatcttttgagttaggggcttagggccaggaagaggccaaaacaaagcagaatccatacagttcgttaattagccttcagcaattaaaggcgctaggtatacattgaaggctgccaaggaccaaaagttaataccacaattagagcaaagaacccccaaaattagctggtgctttataattaagtttgttggagctaagctcttaactaaatgctttcattagcagatcgatctattgtaggcagatatatttactttccatttcaaaatataataagtttattatatatctaaacaatatgcatggatatatatctagatacttaaatacataactaaaagttaaatttagaacgacggtagtaataataaggcctataacaacccaaacactccctaacgtccccttaaaatacataaaataattttgatgagtactacatccgttctaaattaatgaccgcttttttttcttgtaacgtcattttatttaaaaagttaatgtaaatataaaaaaataagttatacttaaagtatttttttaataataaagtaagtcaatcaaaataataataatttcataattttttaaataagacgaatgattaaacattacaaacaaaaactcgacaagtattttaggacagaggaaacaaaaactcgacaagtattttaggacagagatagtaccatcaataatggtcaaagtataagctagaaagggtgcgtgtgcattattttcaaccagaaattcctatgcaattaattagctgccagtacgcccgtacattatccactgattgctcgtctgtgcgctataataaattttctggtagaaccgtatattctcccatcgtttaccctgcacgtcataagacgctactaaaatttaaaattcaaaagttgattttaagttttttatcatagttatttttcacattaatttttaaatcactaaaagtacatataaaatactatattttttctgataagccgtacagcctaaaatcagaattatctaaccgataaaccttcatcatctgcctttttttaaataaaaatagatctaacattgtagttaattttaacaaataaaagcatggtctggttaaattggtatgaagtgcatatactcctttcatcccaaattataatgtagtatctagatgggatatattctaatattacgaatctaaacaagaaccaaattataagaatctagtactggatgggtagaaagcctgtcttaggacgtgtcccatctagtaatattcttatattttggaacagagagagtattaaattggtgattgaaatttttgaaaaatttctcatcccttacatcacaattcaatggttcgcatcactcttacatgacttattaagaacaagagaaatttgtataaactacctcataagtcatctgaagtttatattttaccatgtaagttgtttgtttgtaaatatccaccccctacttagggcccttttgaatcgtaggattgagaaaacgtagaaataggaaaaatgtaggattttgataggaatgtaagtgtaaaacagatgattgcaaaacacaggaaaaacacatgaatggccgtttgattgaaccgcaggaaaaacgcatgaattggatgagagagatacactcaaaggaaagttaccaagagattgaagctcttactaaatttcctccaaaatctctataggattgttcattctataggaattttaaaggaatggattggattcaatcctttatttcaaagggcttcataggaaattatcctataggtttgaaatcctctaaaattcctatgtttttcctccaattcaaatgggcctttagttttgtttgaagaaccaccgtaatacgcatgtgcttaaccggatcgatatgtttttataaattgtgagctgttaatgtggtatttgccaaaattaaatagagtgaaagtgcaccagctgtccctaaacttgtgtgggtgtgtcatttaggtccccaaactctcaaaatgtatttttaggtccccgaacctcgtctagttgtcttgatgtcatataggtccatccgatgacgtggcatgccacggtggcg

SEQ ID NO: 10528 - DNA, 26244 bp, Oryza sativa
  unsure (1)..(26244): unsure at all n locations
gcaggatcattgcatcatattaccattgcctgagctatgatcaacctaatgggagaagaaaaacacatataacatcccgagtagtttgtcacttgatgaataaatgaaccaatgaaatctcttttcagtgaaacctcactaaaaggagtaatcagtacatgtatttttctgcagttggtatatcttacaaagaaatagttgcactgccataaaaattgagaattttattgaccatttcgtaacagtgtgcagtatgcccagatgcataacaaataaattaaaagtgagtttagcaggtaaaagcaataacaaaacaccatgctactgcatcataagaaagaaaagagaaatagtaaactgtggctattagtagtctgaactaggagtacatttagttcaagtaaatcatcacaaggaagaaaagagaatcattagaatgtgtctgtaagtaatctggcctagtactaaatttagttcatataagctacctttgagaagtgcagcaccatgatttggacatactgagcagagcatgttcctgaaataaattagacacaagggttaattgatataatctacacacggcaaataaaaggcaaagaaaccacatgcttattaccctaccatgtttatgcatgttgcctatgtctaaactgatgccaaatatgctcaattaaatcagttttcagttgggtatgcacagaacgagcacgaatagtagattttctacgtagcacatcagtaaaacatggattatcaccagaagttacttcaggaggtaggactattgatgtcctaggaattctattgaggtcaatgtcacatatcgcatcctctctctcatcttcaacaatcatattgtggagaatcacacaagctaacatgattttcccaacactcttccgtttccacttcttcgctggacggcgcacaatgttgaaacgggcttgcaacactccaaaagcccgctccacatctttccttgccccttcttgacgtttagcaaacaatttatgcttctctgtttgtggaagtgatatagattttatgaagctagcccaatatgggtatataccatcagcaaggtaatacccattgttatactcattcccgttaacagaaaaatgaacccgaggagcctcccctctaacttgttcaaggaatagaggggactgattcggcacgttgatgtcgttgttagaaccagcgacaccaaagaaagcatgctaaatccaaaggtcatgtgaagcaactgcttcaaggataattgttgggactttgtagtcaccacgggtgaattggcataaacaagaatggaccatccttgaaatcattctcatacattttcactgccttagccatcagatcatcatgagactccccactagcatataatgaattagcctccttccaagagcaacaaaaattcccaaccttcttcttaattttaccaaaacgatccttaacttgcttaacttgcctaacccggctttttggggtagtgctgttgtaagctgcagcaacatcgccccaatatttatcattcttcttgaaatttgattctatagaatcatttgagttgttcagccaggcgctgatctgcaatttttaggaaaaagatgtttactggtgttagtaatgtgagtgatgtacatcacattgacaaataaataactcacacaggccacttaccaatctcaagtcttcatcgttcgtccataataagcgtttcttagtcctagagatatctccattctcaacattgataggctgtgatggactcccttcggcgacatgatgcatatggtttgatggggcattgataagattaacgaacccaccaggaggacgagattccactcccctgtatagaaagcaagaacattatagtttcaccataactaaattgtttatgttggatccaccactgctgcaattgtaactaaaacaagctaaggtactgatatcctaaaaacaagctactgaaacttataattagcacaaaaacaaggtattgatatcatttttagtgtataattagcacagaaatttcgtgcttcatcttttatatttaaaatcatacacattaatattaatatggttcattgtttgctcttttggagagcacactattggccattgtacatggtgatattttctgatcccttgatcttcttgccataaatatctccttacaaaatatattttctctttaacatcattaggatccgcatgcgttaaaccagatcggttctagtagatcaagatgatatgccgtgacgggactgtttttctcttttactggggagagatgtacttggtctttgtttactgtggggagagattgatttacagcaagggactaaaaataattttagataaagatcccagctcaggatatggtataggcattttttagtaatgcagattaagtaataaaactcacatgctatgttttatgtaaaaaaagtgctactacagccaatgtcatctgattctcattttaatcgatatcacgtatactaaaattcatgaaaaaaaattgtaaaattttaacatggtccttaacatagatcgcaaaaatatcttttcaaattcatttaacgcacgaacacaatagtaacaggcatataaaatctgaaatattagacagaactatgacaaatttgtattttaatcgatatcacgtatactaacattcatgaaaaaaaattgtaaaactttaacatggtccttaacatagatcgcaaaaatatcttttcaaattcatttaacgcacgaacacaatagtaacaggcatataaaatctgaaatattagacagaactatgacaaattcgcaactaacttaccattcttcaaaatcgtgttgcaactcgatgttggtcttggcagccatagggagaggacatacagatgaactcggcatggcttgcgatggtggagaagcaaaccaagctggcggtggggtggcgaaccaaggacctccataaggatatggcactgccgacggggtaggaacaccgggaggattggcgcaacctccctcttcctccggcgagacatggctattggtggagaggaactagggttttcggtaaaaatatgttgcgtgcgggcgggagagattagcgagggggaagagggaaggcggatagtgggaggcggagacagtaaatcttaccggatttttgaggccggcaaaatagtagatggggatttttttttttcagtggatttgtgtcgggaggggaagagctcttcacgcgcgagaggggaagagatggcgcgcgtgggagggaaagagatggcgtgcggcacgggagatcgagcgccatcacccgggatcgcgcgggagatcgagcgcaatcgcccgggatcgtgtgggaagggcggagatcgggcgggcgctgggtggaggggaaaggggatctcgatcagctacggtggggaagggatcggctgcggtgagtgggtccacaaatcgcgttttttatcgcccaggtaggctgcaagcaagcgataacgcgtgggaaagagagctatcgccgggcgatagatttgtcgctcgctcgcttctctctcatcatttctctcccctccacataggaatatgatgatatggcatatttttggagcctgcctagtcagcttattgtacctgctctaacaaaaaattaagagggttggctctcatgcaagagctagcttaacacaatctccaagacaaatacattaaatgtataagtgagagatagagagagaagaagaaaattgtagccaaccttatagctaatctcattatatatgttggctttaagatgagctaatagtaggaggtgagctatactattatcgttgctcttaggaggaaacatcggcaggacagggaggcattatgcaggggagggtgcggcagattcggagcattcgagtctttctattagtaggatctaagaggtactccatataccaaaacacggatgttagggaatgacctaatattaaattaatagaaaaggtatggctttgaactcaggccggctagtccaccacattgtgaagttagctggaaaacccctagacgtttctatcagctatcctacataaaattacacaaaattatgtagggaaaatacctagtaaaattaaagtgcgcttcgattatatagaaggccccatttcgtcctcagatcctggctccccacactgcctatatatgaagacggtgcaactgcagagttggtcatagtctcatagactcatagtggctgcaagcttatgcaaagcaacaatggccacctgcatcaatggcggcgagctgcaagttcgggtcgtgagccggcgactcgtgcaggcctccgacgagtccctccggccgcacgtcctcgccgtctccaacctcgacctcctcccgcagtccatccaggtctccatgatctgcatctaccccaacccacccacctccgccggcggcttccacgacgtcgtcgcggcgttcgccgccggcttgccgtcgttgctcaaccacttcttcccgctcgccgaccgcatcgccgtcaacccttgctccggcctccccgagatccactgctacaaccaaggcgcggagctcgtcgtcggcgaggccgacgtggctctcgctagcctggactacggtagggtcggggagtcgatccagaagatcctgctgccgtacgccggcgacgtggcgctgtcggtgcaggttgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccagcaagatcgcgcatgtaacagactcttttgtggaggtgaataaaaggaagaaaaaccccagaaaagctgcgaggtttttcagcaccaaaactctgtttttgctctgtttttctatgttgtcgtattttcgtcagatactgttcatcgttctgaactactcagacaagctaggatagccacaatctcgcgtgtgttcagagtgttctagctaacaattggtatcagagcagtactggaacgatccggcgatgtcatacacaccgcctggccgtcgtggtggcggtggcggcggggggagcggcaacggccgcggcggcgcaagcggcagcggcggggggaatggagcagacggcgcattacttccgctcgtgtctcaggggagagacgcatcgcacaccgctcgcctcccagtcctctcgaggacaaactacccggattgggcgctcctgatgcgcgtcaacctgcaggcgcaggggctgtggacggcgatcgatcccggctacgcggagtttcgtgaagattgggcggctctctcggcaatccttcaggcggtgccgcgtgagatgttgcgcgggctggcaaagcatgacacggcgaaggcggcgtgggacgccatcaagaccatgcgggtcggcgttgaccgtgtgcgtgaggcgaaggagcagggcttccgtcgtcaatttgagtcgatgcgattcaaggagagggagacgccggaggagtttgcgatgcggctcactgccgtcgtcgcggacattcgcgacatgggtggagtcatggaagatgaacacgtcaacaagaagctgctgcgcgttgttcccaagaagtataagccggtggctatctctctcgagcagctgctcgatgtgaagaccatggcgctggaggagctagttgggcggctgtcaacagtggattcttacagcgatgatgaggagggaagcgatggcggaaaattgtacctcacggaggaacaatggcaggcacgtgtgaagcagcgggagcaggagggctccggcaacagcggcaataagggccgcggcgcgcccggcacgcagaatcaccgaggcaagcccggtgggtcgccaaagggcaaagaggcggccactggtgcgaacagcagccgcgacatctcgagggtaaagtgcttcaattgtgatgaatttggtcactatgcaaggcagtgccgcaagccacgacgccaacgccggggagaggcgaacctggtgcaagccgccgaggaagaaccgacgttgcttatggcacatgtcgtaggggtgtcacttgctggcgaggcgacactcggacgaacacctggtggacaggaggtacacctcacggagaagaaggtgatcctggaccacgaggatggtggtgaggaggaggtgacaagagattggtttctggataccggcgccaccaaccacatgactggagtgcgttcggcgttcgccgagctcgacaccggcgttgttgggacggtgaagtttggcgacggctctgtgattgaaatccaggggcgcgggaccgtggtgttccgatgcaagaatggtgatcatcggtctctcgacacggtgtactacatcccgaagctgcgcaagaacatcatcagtgtcggccgtctcgacgcgcgcggctacgacgcacatatctggggcggggtctgcacactccgtgatcccgatggtcttctcctcgcaaaggtaaaacgagacataaattatctctatatactcaagctgcatattgcaaatccagtctgcatggcggcgagcggtggcgacacggcatggcggtggcatgcgcgtttcggacacttgaacttccagtcgctccggaggctggcccaggggaacatggtccgcgggcttccgatcattgatcacactgatcaactgtgcgacggttgtctcgcgggcaagcaacgacgactcccgttcccggaggaggccaagtttagagcacaggaggcgctcgaactggtgcacggcgacttgtgtgggccgatcacgcctgcgaccccaggcggcaggaagtatttcctgctcctcgtcgacgatatgagccggcatatgtggatacggctcctctccggcaagcatgaagcggcgacggcgatcaagcagttccaagtcggcgttgagctggagtccgggcgaaagctgcgggctctgaggacagatcgtgggggggaatttacctccgtggagttcatggactactgcgccgatcatgggatgaggcgagagctcactgctccttactcccctcagcagaacggagtcgtggagcggcggaatcagaccgtggttgcggcggcgcgctccatgcttaaggcggctgggatgccggcgtgcttctggggggaggcggttgtggcggcggtgtatgtgctgaaccggtcgccgacgaaggcattgaatggcgtgaccccccatgaggcgtggcatgggcgacgtccctcggtcgaacacttgagggtgtttggctgtgtaggctacgtcaagacggtgaagccgaacctgcgcaagctcgacgatcgaggtacgaggatggtgtttattggctatgaacaggggtcgaaggcgtatcgcatgtatgaccctgtggtgcggcgcgtttgcgtgtcgcgtgatgtcgtcttcgacgaggcggcgacatgggcgtggcgtgatcctgagacagaggcgactgaagaggaggaattcacggtggatttctttgtgaatcccgtggactctgttgttgccgacttgggcgaacaggctagcacgcctgtgcagggaggcacgtacccggcgtcgacggccactccgccctcaccaccggaagtgccggcgggggtggagttttgctcaccaccaaactctgtcacgccagggacaaatgaaggccctatcaggtatcgccgagtgcaggatatcctatctgctactgaacctgtccttgattttgattatagcgaccaatgcttgctggcaagtgaggaaccaatgagtcttgcagaagctgaacaacagttgtgttggaggcaggcaatgcaagaggagctaaagtccattgaagacaatcagacttggagctttgctgagctccctgttggacataaagcaattgggttaaagtgggtctataaggtgaaaaaggatccatcaggagttgtggtgaaacacaaagcaaggttggtagcaaagggatatgtgcaacaacaaggaattgattttgaggaagtgtttgccccagtggctagaatggaaactgtgaggctcctgattgcagtagctgcaaacaaaggatgggagattcatcacatggatgtgaagtctgctttcctgaatggtgatttggaagaggaagtttatgttgtgcagccacctggttttattgagaaaggaaaagaaggccaggtgttgaggctcaagaaagctttgtatgggctaaagcaggctccccgagcatggaatgcaaaactgcacaacactttgatttctctgaatttcatcaagtctgaaactgagagtgcagtgtatgtgagaggaacaggaagctcaaggttgatagtgggagtgtatgtggatgatctgattatcagtggggctcaagcaagtgaaattgatttttttcaaggaggagatgaagaagaaatttcgcatgagtgacttaggtctgctgagttactatctgggaatggaggttgtccaaaaggatgatggagtgtttctgtcacaaactgcttatgcagcaaaaatcctagaaaagacaggaatggaaggctgcaattctactcaagttcccatggaagctaggttgaaactgaagagggagagtggaggggaaggagttgattcaaccatgtatagaagcactgtgggaagtctcaggtatttggtgaacacaaggccagatcttgcttactctgtcgggtatgtgagcagatttatggagaaaccaacttctgaacattgggcagcagtgaagcatattctgagatacattgcaggtactcttgatgttggctgctggtttgggagaagggaaaagggtgaactcagattgattgggttcagtgacagtgatatggctggggatttggatgataggaagagcaccacaggtgtactgtatatgctgggagacagtttgatcagctggcaatctcagaaacaaaaggtggtagctttgtcgtcatgtgaagctgagtatattgctgctactactggtgcttgtcaagggatttggctcaataggctattggcagaattacttggagaggaccctggccaaactgtgatgaaagttgataacaaatcagcaatcaatctctgcaagaatccggtactccatgatcgaagtaagcacattgacactcgatttcattttatcagggagtgtgtggagaagaagcaaatcgctgtggagtatgtgcgaacagaagatcagcttgcagatatactgactaagcctgttggacgagttcggtttcttgaactccggaagaagatgggtttggagcaggcacatcaagattaggggggaaattgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaggtttttcagcaccaaaactctgtttttgctctgtttttctatgttgtcgtattttcgtcagatactgttcatcgttctgaactactcagacaagctaggatagccacaatctcgcgtgtgttcagagtgttctagctaacacaggtggtgtcgttcgcctgcggcggcttcaccgtggcgtggggcaccaaccatgtcgtcgtggacgggagagccctgagcatgctcgtcggctcgtggtccgagctcgcgcggtcgggaacgctcgccgccggagcacggcccaaccacgaccgctccgtgttccggccgcgcgccacgccgtcgtacgacgcgtcgctcgacgaggcgttcacgccgctggacggcgacggcgagcgccagatcaacgtcctgacgagcgacgagagcttcgtcggcgtgcgcctgtactacatcgaggcggcggacatcgcccggctacgcgagcaggcgcgggcgacgcgggtacaggcggtgtccgcgtacctgtggaaggccctcgccgcggtggtgggctcgcgcgacgcgcgctgccgcatggtgtggtgggtggacggccgccggcgtctcactctctcctcctcgccggagctccgcgccgcgatgcgcagctacgtgggcaacgtcacgaccttcgcggaacatgtgtctatttgccgtgtgtagattatatcaattaacccttgtgtctaatttatttcaggaacatgctctgctcagtatgtccaaatcatggtgctgcacttctcaaaggtagcttatatgaactaaatttagtactaggccagattacttacagacacattctaatgattctcttttcttccttgtgatgatttacttgaactaaatgtactcctagttcagactactaatagccacagtttactatttctcttttctttcttatgatgcagtagcatggtgttttgttattgcttttacctgctaaactcacttttaatttatttgttatgcatctgggcatactgcacactgttacgaaatggtcaataaaattctcaatttttatggcagtgcaactatttctttgtaagatataccaactgcagaaaaatacatgtactgattactccttttagtgaggtttcactgaaaagagatttcattgtttcatttattcatcaagtgacaaactactcgggatgttatatgtgtttttcttctcccattaggttgatcatagctcaggcaatggtaatatgatgcaatgatcctgctatcaagggtctatcttcgatgaagaaatcagtctatcttcgatgaataaatcattctcacttgttggacagcatatttatatgtacttttgcttaatgccctattgttgatgtgacttttggatctgtaaaccgttatgtttattttgctttatcctctattaccttgtcagttctttggaactacagatatctttcgttaccatgtccttttgttaagacttgtgttcggactggtatgatattatcgattaatctatggtatttgagttattgttatgtagtaatattgtcttgtaatttttgtactatagagattttggttgatatggtatgtgaatatgctattggcacaactggttacaaagatgcaattcactcttgatcacacacattgatacacacattgatatgtgcatgatataatttactatttgattatgaggtgtagccagccaacagacaatctattgtactagtagctagctttagcaatgggctattagtcagcaactggctatactattagccttgctcttacctctctcctccacataagcttatagtagtcttatagctcactattatacttgctctaatccccaagccaggtggcagcgaggtgtctccccttctccaaatgtctttccacaccattgctcccactacctcctatccactgcagatttaacgctgccgcggctgaccccatctaccaccttcctcccaacaccttggctctagcagtatagccgccatctgccgccgaccacctccccgtgcgcccttccgtctaaagcagtcctcaccgtcccctatcccgctccacctcctgacccccgaaatccttattctagaattattttgatgttgctagacaccgatgttgggaaagatgaagggatcgttgaggaacttgatgtcgtcattgctggtaagccatggtagccacctcaccctctctcccatctattgcctcaccgccctcactggtccatgctggcgctgtcttcaggttgtcgctggagaagacgtgctcatcgtaggaggggaaaatatatagtgtaaacaacatatctagtgaaacctggaattaccacaagatgtaaaaatggagagtaaaagttttactcatagtaacgtgaacaaatttcatagatccatttttgtattctatggtaatttttatgtttctacgatactagaaaaaatacccgtgcgttgcaacgggtgaagactattttaatcttattactgttatattcttcagttaaggtgaaattcattatggtaatttgcttggatatattttctttttaaaaatcatgaggtgcggttaggagtctgatcatctcaagttagcatgcaagttcttttaaggatatttcttatatgactccttttgtatttgcgaaagcgaacaaacttaaaagccgactcacatacagacatgtattttcaaaaacgaacgaatttaaaaaccgattcatacacggatgacgtaccaaaataccggcaaaaacatcttcaatagtagagatatatgtttttttcttgtaggacaagacctgctcactggtgaggaggaatttgattgaaattgtaaaaacttcgggtgactaaactctagcaataacctaaattttcttggcccagctatatatatacagatcgactcaatatgaagtcacgcatataatttgttttactaatctggttgtatagtttttacctgccaaatatgcttatgatttatactaattaataatgggtacaaactttgactttttgattttatagtatgtctccaaaaaaaaaaacagagggactagctagtgaagttgagttttgaaacaagacctagtgtgtacgtgactccaaacaagcactgacgtacgttgcgatgatacgaggatgcatagatggatcaattctaaaatcaaacaaagtccgataaattaattaagttgttggttaatcattattccttaaaccaaatgagcatgatctcagacttcttgaacgaacactcaacacgtacactaatttcataatttgattccaagcatccaaaggaaaacattccacaggtcaatactatgcttggttctcatgaaaaccactactagactaaaactgtggatcatctgcgattggcacctgcgacatttcagctatttgcagatccatgtgcgtacgtagtctgatgtctccttcgaatgaaggaaattttagggcttattcggtttggacgagtttgaattcacaggaaaagaaaaggtagaggaatagtaatggttgcacatattaattgattttttccgagtggtttgaatggatagaaaaattcctatgttttcccgtacaactggtagaaaaatgtgatgtgacaacttgtataaccctcttacattatgttgttgtacgcgcttttagtattactagctagttagtgcatgaaaaacgatgtaaaccattagtatatgattaattaattattatccattgtacacttcgaaaattggattaatttgatatttttagagaaacttctctatataaagttttagcacgaaacacacaaacccaggttgggaaacgtggtcgcgttaaaccagagattagtccagctcaaacccagtttagagcaggtacaataacagaatataagccaactataaacatattttaaagagataaaagatgggagagaagagtagcgagctacagatctgtagccagctgcagtacggactctaagatacaatgcgtgtatgatatgtgtgatcaaatattaatagtgtagtaagtacctattgtacgaattggctattaatttggctatagatgatttggagctagtagttaggtatactattaaactttctcttaatcttaatttagaacacgaccttaaacgtcgtgaaacacacaagattcttttgacttcacaaaggtcacacgccaataaatatactgtacaccatcattcgacaatcagcgagctatacattattcactcgaccagcttacaaagcactgcatgccctatagctagtttcagtagctagcaagccattaggaagacacacatcaacaagaatggccagctgcatcaatggcggcgagctgcacgtccgtgttgttcaccggcgactcgtgaaggcctccgacgagtccatccggcctcacgtcctcgccgtctccaacctcgacctcatcccgcggaccatccaggtctccatgttctgcatctaccccaagccttccaccggcggcgatttccacgacgtcgtcgcggcgttcgccgccggcttgccgtcgttgctcaaccacttcttcccgctcgccggccgcatcgtctccaacccttgctccggcctccccgagatccactgccacaaccaaggcgcggagctcgtcgtcggcgaggccgacgtggccctcgctagcctggactacggtacggtgggcgcgtcggtcgggaagatcctgttgccgtacgccggcgacgtggcgctgtcggtgcaggtggtgtcgttcgcctgcggcggcttcaccgtggcgtggggcaccaaccatgtcgtcgtggacgggagcgccctgagcatgctcgtcagcgcgtggtcggagctcgcgcggtcgggaacgctcgccgccggagcacggccgaaccacgaccgctccgtgttccggccgcgctccccgccgtcgtacggcgcgtcgctcgacgaggcgttcacgccgctcgacggcgcgcgccaggtcaacgtcctgacgagcgacgagagctcgcctgtactacatcgaggcggcggacatcgcccggctacgcgagcaggcgcgggcgacgcgggtacaggcagtgtccgcgtacctgtggaaggccctcgccgcggtggtgggctcgcgcgacgcgcgctgccgcatggtgtggtgggtggacggccgccggcgtctcactctctcctcctcgccggagctccgcgccgcgatgcgcagctacgtgggcaacgtcacgaccttcgcggtcgcggaggccaccatggaggagatccagcggaagcccctggcggaggtggcgtccatggcgcgcgacgcgatcgccgcgccggcgtacggcgagcacttccaggagctcgtggactgggtcgaggagcacaaggccgggaagcagcggtacatcgacacggcgagcgtcgggctgggcagcccggcggtgagcgtgacggcgttcgcgtcgttcgaggtggacaccgacttcggccacggccacgccgcgatggcgctgcccacgtcgtcctccagcgcgaggctgtgcacggggttcgtgcagatcgccgcgcggcctggcggcggcgacgggtcgtggatcgcgagcgcgctgctgtggccgaggctggcggcggcgctcgagtccgacgagcggctggggcgcatcttcaagccggtgacggcggagtatcttggtctccggccagcgagtggtagctcggcgaagcgggcaggcatgatcacctctaaaatctgaactccaatagactttgcctatgcgggattcaatatttcagaaatttgactgaatttgaataaattttgctatgtacaaaataataaggatgatgattcttccgctgtcttttgtttttttgcaatagtggaatgcaattctgatttaactaattaatgagctgtgcgcatacatgtgcctatctcaggatgaaaatggtcgggaaagtactccaacctataagtgccttatagggaactcagaatattttttcacatgtatttgaaatacactcgtaattcctaaattactagtgaaaaaagtcaccggtatgcttggccgaagatggtattatgccaaatcgcaccatcacacttgagcacgttatgtgcaactcacaatggcacacggagacgcgccaccgtaggagaaggtagatgctgccaaacaaacacccaggaaagacagcgtcagaatgtacgcacgttggtttgttctaaacttagtaggccagttaggatgccctctaatgctatagagatgagaacaattgaaggaccggaggaaaatatactttagaataggtagcaagaagtaggaagatgcagaatatagagggtttaggtaataaattgattttgatgatcgattgattgttgtttcaattgatcttggctctcaatacttataagagtgatatacttgatatacttgcttcccagggtcttttccacttcaattaaacgtagagatcaattagctaggactctaaaatcttaagtccaagcaagaaaccccaagagagattaattggatttggagtcggactctgccgttctaaccggccacatgccgttggtcagaccgatcacctgctgtcggtttgaccgaccctatgagtactgtcaaaccggcctcgcatggcaagccgagtcattttcaaatttaatcacatttttatattcttattctaggtgctaacacatggttaacaagcggaaaaaccattattcagaattgctaccacaaaattatgcggaaaatcagttgatttcgttgaaatcctttatgaatatggatctcagtcgattcattcatatatacaaaatcgcttcggcattactaaatgatgaaattgtcggcggtgttggcatgacgcgagagccttgtggctttgcttttttgagatggtctgaagtcaaaaggaatttttcgtgtatttcaccggggaacaagttaattaagacgaatatttcgtgctaatgcctatgatttggacgagttaggagaaaacataaactatgacagatcgagagtttattaaaataaccatcttgggaactatatatgaaaacagtgtagatcctcagtatttgcctttatattttgaatatgactatacgagaccaaaacatagccttgactcagcgatttctttctttagaggccagagatatctaatctgacacgtatcttgtttattgcatttcgaaggatttagccccttgttagtccaaaaggaaggacaaacaagcgctatatcaaattcacgtgttcaccttattgtttcctcgaacacgtgtaaattgttctattttattggcttttttttaaaaaaaaagggctaaaacagctattacacgtgactagatggattaccattcatcagcgtctaataagcaagaccggttcaaaataaaagaacgtcatatgcctcattgcctcctatatatacagttataatttccaaattttattattaaatcaaggaaaataattaattaaagaggcgactatacatggcattagtgaacgataaagatagtgaagatgatgtcaatgcacctgcctgtgcacgacgagccgctcctctggtcatcggggcgccatggggtttcgtccttcaacttgcaagaagactaggggaatgcgaaccccgcgacttccgagcgaggaagatggcggtaggagttgcttattgcaggcggagctaattcgcacgccggcccacggcccacgcgcgcggcccctaccacgtccgtcccctcctttgttttttccttttttttttccgcgtgtctttcccttttttgcgattttttttctccttctctgattttttttcgtgccaactagcaagttttaaatcatgacttaaaaattttcaaatctcgagttgaaagctttcaaatctcaagttgaaagttttcaaaattttcaaatctagacttgaaagttttcgaatctcgagttgaaaattttcaaatctcaagttgaaagttttcaaaattttcaaatctggacttgaaagttttcaaatctcgagttgaaagttattaaatctcaagttgaaagtttttgaatctgagatgaaagttttcaaatctcaagttgaaagttttcaaaaatttcaaatctggacttgaaagttttcgaatctcgagttgaaagttttcaaatctgagttgaatgttttcaaaatttgactttaaaatttaaatcttaaattgaaagtttttaaatctaactaaaaaattttcaatctgttagtaaaaaaatcttaaaaatattttctaattactatcattagtgttaagtgttaactaatatagataattaggtggtcaggaaagtgagggctagcagcgcgtacgcgcctgctaggcgcccccgcttattgcacggtcaacaagcgattgtccacgcgaggccctaatggaataattaactatttaccactcttacgagtggtgctaaattatttgccactggacccatatgtcatagacacatgagggcccacatgttatagacagcgagtggcaaataattaattgccacatcttaaaagtggcatggagttaaatgtcccggccctaataggccgcgcttcaacctaacaagtgggtctagctgacatagagggatcctagcttggcctggtaaggctaatcgttttggtatcgccaaaaaaatcctagctccaaggagcgaactagcccaaaggggtgagaaaaggctggctcaccagggagagccaaatcggctcgcttccataaaaaaaattaatgatacacgcgaagtgattttctcctaaacctaccaacaactggcccatatctcaccttcctcttcctcaatattcttggccgaactctggggttagtagtcattaataaaacactttatttttttattgtttcttgaataatgaaccataactcttgtttttcagataatttctttttgcgcattatctctgttgtttagtaagaatactcgtatatatatagtcttattatgctacttgcggaaaaattacaggccactaatcgtaaccaaagagagcaaacgaaccaaatgctgcagaattacagcgagcctagcaagccggcatggcgatgagttggtttgcctttgccgagctaggctagctagctctgccctcgatcgtgtcgtcttcaagattcttaaaaccagtgattttgtgttaatggtactgaagagatggtattatgtgaaaaataaataaaatctatggttatgcgttacattgatcccaaaactcggttttctgaaattcactctttataaagtagtataaactaggcaaaaatagatatgtttgatttaggataaagctaaaatgatagattaatttgaaatctacacatctaatagcatttgtgttatcaatccagtccatatatcaagaactcatggaagctcaatgtatagcacgctgcccgacgccgtgccgtaccggagtaccgagaggctagccggcggcattgtcatcgactgcacgatcggtggataaatctttgaccatcgcttctataaataaataaatctaagatttatccaggatatttaagtcacagcaagtttgagatgcatataatatagagtatatgcccagaaccagtcactcgaatggaagaggacataatggaatatataattttttgggttcatagttccagcaaagcacaaaatcaaaacaattcacatagttatatacacatgctaaacgtcaacattcctatttgaaaaagaagattcgacactccaagaatccaaaatactctgcaggcctgatttataggttgggtgaagaagctttacaccaagttcctcttttagccgagcattagagacccgcttctcagcagctacgattctgtcctgagtagctggtagtactacagaatccattatcaggccaggatgcttcctctcaaccaagctccgagcaaatgcgaaaacctcagatcttggggcagggtcgtcatccactacgttgtatatcctcctagaaataaagttgccacacatacatggaatcagttatcaaccttcaaaggttgtttcttctaatggaaatgggggagctcatgctctcctagttcaaaaaaaaatcaaccttcaaaggtccagtagaaaggtacagtacgtaaataggttactgggattacaaagggagtaacactatcagtatcaggacctgattttagttcttggtttgatggtatacaacaccacaaccaaatattgtacccaaagtggttatactcagatacagtattttactaataaaaacagtggttgctactacatagaaattttatgatacctgaatattttgtggaaaagtgattatgaaaatggttctgtgctgtggacagatatacagccaaagtgagtctcttttggcagtgcagtctcataatttgttcttgtgagagttgcacaaggtaatactaaggaagattcaaactagtttgaaaatatgattgaaggcagaaaaactggaaaagtagcagccgttttgaagacctgaagtaaaaaataaaaaataaacaaacaaaccttgcacttctgatgctcatgctagccaggatagcctgacaaatgtcagccacatgaattcgtgcagtgtactgtttggattccctcgatttctgtcttcgtgacaaagatttgctcttggctattgtgtccactgcactgcaataatcaacacaaagggtcataatagtggcacttttagaaagcaagtattgggaactgtaacaaaagcctcccatgaaaaagttctcattttcatccattacatacttgacaagtttgtagcacaagttgtacaccgtattggttgaaatcagataaaaagtgctccaaatctttaattttaaaaggttgattttattggtggaattcagaatttcagtagccaagtcatgcagttctggagtaaatataacttttggttcaaagactacaaaataaaatggattgaaattttagcagactgaaaccttcttcctggcccatatattccacctaaacgaaatacaaaggctgatagatctaagtcatctataacattcaaccatcctttttcggcagcatatcttaatttcacagactcggtcttcggattcaccgtatgactgcatgaatagcagattcttcagctttcagttaaacaattattgcagaagcacttacagaaagccacttatcttactcctcatcaacccatgcaccaccacaatcaccatacacacctgaaaaatgataataataattacaagttattgtatggcagaaaaatttttcagggctagtttgcacatttatgatacgttcagttaacctgaaaagttggtatcgacttttgaatgctagctaggattttataagagatgtgagtatgatgcattgtttgccatgaaaatggtgttgttgcctgatgtacctcagatcgaatcgagcattgaaccaaggaaaaaacaatttctgcaagccattgcaggtgacaattactcacaccttggtgcaatgcaggggtcagttcacaagtccagggaggaatcccagtctggataaactcattcttgattccacattggtcattggtatgcttggtacataaaaggttccagcacctgtgtcatcctggtgaccaaggaaggagagaatagccgtatgtttggcagcaaacgtgcaacattttactagctcaatatctcttaggtagtgaactaggcaggatatggttgcttatctagtttactcaagtagtcctttctgtgttagctaggtaacggttgtttgttttcttccctagaaacagcagtccactagccatgtagtttggttgctgtgttgtgcccataccaccaaaaaagcccacaccaccaacttctcttctatgttaatggaacgagaagcagatattatgcgtgtttagaaaactaacataaaaaagatgttgctacagttgaaggacgaattgaaattatgcaggtcatactagagatgatcagatgagcatatgtgcacttacttgttgaagaaaggtaacatagccattgaaggttactattgcttagtgtagtttgcaggttggaatgtgaagaaagcaactgtagatattagatgcaaatttaatcattattatgttaaatttagatggaatttaagtcaatcgaactgacatcaacaagcaattgagaacgtacaggatcaccaattcccgggatgggtggaatggagatgagcaaatgagttgcatcttgcaaagaccggagatttgtcagactgtaattgacatagacatcagcaatcatgtaaactcatttgaaacataacaatgcacagaaacacaaacaaattggcaacacatgctgaacaaatgagagatggtagacatcatatcagcacaagagttgtgcatcgaacctaaaaggaacaagaacaagaaccggagatttgtcagactgtaaattgacatagacatcagcaatcatgtaaacggattcgaaacacaacaaatcatgtgcaggaacacaaaaatgtagcaacgcatgctgaacaacaatgagggatggcagacatcacatcggcgcaaaggatttgcaattactattgtgcatctaacctcgaaggaacaaagaacaagaagagcaagaagaagaagaagaagcagcacctgctgcttgtggcatcgaagatcgaagcatccatgcccagcatctcgagctccgtcttcttggcagggctggtgcacgtcccggacacccttctgcatccaccaatcaatgaatccagccgcaaaatcgggaatggtccgtaggagaaacgtacggcggcaatagcagcagaatccgatccaaaatggaggagcaggggaagtaagtagctggccatccttgcgcgaggaggcgctgggagacgtatcgggcgaccaaaccggtgccgaacacgagcatgtgcccgggcctcggctgcggcggcaaggcggaggcggcggcggccgccatcggcttgggggagcggacgcctcgtggaagagccatggggattgagattctgcagcaaagcggcggccgccgtggtgggtggggggaagcgaggattaaacggtggcgacccgagagctatcggcgagcggcgagcgccaccgcggcggaggaagcggcggatcctgtggggttttttgcggcggcgcctccctgccacttcaggctgagggtatagatggcgaattttttttatttataattttttttattaaaagttttacaaaaataattttccattttgaaaattaacggaaggagtcgcctaccgccctctgggagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccggcctccgctagggcgattttgtactgtgggggggggccgcctgcaaatgggcggcgagggggcatggaattttgcaggtgacccccttgctgtcctgggggagggcgatttttgcctctccccctataaagcccagtccctcctatgtgaaatttcattatattcactaaaaatccaaaaaaaacaaaagagagagaggggagggcagcagcaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtcgaaatggcttttgaatggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggattatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttatggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccatcattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtaatgggaacaaccaggttctacctatggctttagcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccnnnnnnnnnnnnnnnnnnnnnnnnnnnnnnnnnnnnnnnnnnnnnn

SEQ ID NO: 10529 - DNA, 24828 bp, Oryza sativa
taatggtaggatgtatagtacgatgttggtttttttaatggagggagtacgctgagtacctacgtactgtcacttattgaaatatactctctctgtcccataaaaaaccaaactagtactggatgtgacacgtcctaatacaataaatctggacatagtccctccatctcaaaaaaatgaatctagaactagatatgatatattctagtacaatgaatatggatatagatatgtctagattcgtagtactaggatatgtcacatctagtactaggttggttttttatgggacggagggagtacatctgtctagattcgttgtactagaatatgtcacatccaatcatagattcactttttttgggacgaagggagtacatgtttttaaaggaaagagttgtatcctatcttactataaagttatccctcactaactccttaagcttaacatgcaaagatgccacatcatcatccactaacaagatgccacatcatcatccactaattaacaagatgccacatcatcatccactaacaatcatcatatttaaacaattaaacatcatgcaaacatactatatctttatagtttttataatttaagagcttttcaaatacaaacatgttaaattatcatccaacataattcacataatgtttcaatgtatatctttattaagttttatgatatcctatatacttatatagtttatcctcacttagtgcttaaatgattaatctatggtctaaattatctttctccttttttctctaattaagtcatatcacatctattgtttttagcctttagatgattaatctacggtccaaactatctccctacttttcttcttccataaagtcataccaccttactttttatgtttaaatcaccattctacatactatttaaatttaaattatcataaaccacattagtttacttaagctgatattatctagctatcttacacgttattttttttattgttatcatactaaattcccgcagcaatgcgtggggtttcacctagttgttttaaaattttaccccatgagctgctgtgcgtttaagcggactggggtcaattagctagcttggtggccgggtccctgcctacaaaatgttgaggatatgttgttatatggtcggatgactcgggtcatctgaccctggtggtagtaatgtggatcctccttgtccaaatatctttgtttcaaaatataaatattttaaaatcttttagcaatgatttagattattttaaataatgcacagcgcctttcactacataaaatgttatgcgtaagatgaagacaaatttaaattagtgagatgttactataggacacgtaagcttttatttttgaacttttcatattgtcggcttttgaaatcctttttttaaaaaaaaatggtcacctcttccatggagcatcctaaacattttttataagcaaaataaagtgtaatttcgccacagaaaacggtgcataaacctgatgaaataataataacctaagagaaaatataattaaacttatgtaagattggccggctgctcggtgtggggatgttatatttcacatgtagcaggggtacgttcatcacctgcacattgtctggacgccgccacgtacgtacgggccagctgccacaccagctagccggccggccgtgtatgaatgtgacgtcgaatccgacgatcgaggggaccgtctcgatcgacctgatgacaaaccggacgaacgatgcagcaatccgacccatcgaacaggggatcgatatcatgcatatcggagtatcttgcatgtcatgacggcgcgcgcgcacacacacatacatacatacatacatacatacatacatacatacatacatatatatatatatatatatatatatatatatatatatatatatatatatatatatatatatatatatatatatatatatatatatatatgtgtgtgtgtgtgtgtgtgtgtgtgtgtggttacgtggctacaatatgtaactccctccgtttcatatatatataccttttggactaacatagatttatctattgatcaatgtatatgtttttttatatatgtctagtttcattaacatctatatgaatttgagtaatgctaaaaagtcttacatcgtaaaacgaaggaagtatgtcttagtacgcagttagtacattcgttttttatatacactctccatttttatatatgacgtttgttgattttttacatcaccacaactccagaaaagcacatcggtaccagttgggaatccccttgggtgccggttttcccaaccggcaccatggaggcggcacggatgacttcggtcatcggtgccggtttcaaaaccctgtatctatatgtgtgtaatagatgccggtttgtaggttttaaaatcggcacctttgagacgtacgcgatccaaaaaaaggctcgatgcactggattgaatagagccgatacatcgagcgcatccaccccgcatcactgaactcccaaatcattgtaagcaaatcacctactgataaagtggacacagtgacttcaaaaccgctgatacaatgggtccccaccaaagaaggacaaccacaaggacccactggtgggacaaccacaaggacccactgtcataataggactctaatgatgatgactactacgagaacggtgacaaggaggagggcatggaggccaaggccgaggctgagaggaggcctcggtcaccatgatgtggtgatggcagtgtcttgcatggccgaggcgcaggaggagggcctagcacggttgtggcacaggtggcgggcgcctgcgatgtggaggtgttgctggatgaggcgaaggctagggtgccagccagatggtactgaaaacggtcacggaaactctcgatgcaaccgagcatcgtttctgtataaggggtaccatttcctaccgtactgtttatagctatttataaattttgtttttttaatttctttatgcgtcgtattaatgtcgacactgagtagcttaaatgataaatatggtcaattatcggccgatccatcgtcgtttttgaagagatcctgccgattccgactattttcacccctggtagaaagcactagcagaaggggagacggaggagaacgcgtggcaccagactcatctcctttcgattgaacaatttattcccatcgagaaataggcttatatatttcccaattttgcatagggtactctgctctaggtaggtagcctaggtgaggacacaggtgagggctgtctgaactaacggttggcaaatgagctaacagccaacaattgtgaagtactcctacctgtgctaattgcatgaattaagaattttgtatagaagtgcagaacagtagtgaaatacgaagtagtaacatagattgtacatgaaaaattaaggattttttattaactatagtggttggtccatgattatatataatgaaactgtgtgaaaaaccaaccaaaagttacaccccaccatcaccagcttagactcattcaagctctactatccaacatcactcgaggttcttttggagagattacgaaagaagaaaaagaccatgatgctctcattaaatagggtgtgagtagtggtagatgggtgatcgacggtaagatggtaaaaaatattaaatactaattaattaatggaataaatatactataggatttcttatattttgagataaagtttgaattttggatcatatattatatattataagacagaggactccatccgtccaaaaaaatatttgtcctcattgtcataagatatataggtcacatcctattttaaggctgtgtgttcatgttgctccttgttgggaactaatgccttgcgcacggaaaacggagcagtccattaatacgtgattaattaagaattagctaattgtttttttaaaaaaatagatcaatatgatttttttaattaactttcgtatagaaattttttataaaaaaacacactgtttagcaatttgaaaagtgtgcgtgttaaaaatgagggatatgcgttgggaacctaactaactaacgcagcctaagttggctctaagtaataagcttacagcttttttttaacctctctctgcccaacattaacccgcttcactccaaagcacccacacccatccaccagctcacaatgtcatgtcactatgcatctcacacttctctctccatccccaccttcacgttcctcgccacaacaacacgtacaaaacaaaaattcccactcacatgcaatatgtgcatatgcaaacctctcctacctcacactccaccctagctagcccactacacctcctacaccctcaccatccaatagcgcagtgacagtgccaatggcctctcacaccaccctcatcctcctcctccctctcctcgccgccgcggccgtcgccgccgcggacgtcgcccctgcgccggcgccacctgcggcgcagacgatcaacctcacgggcatcctcgagaagggcgggcagtacaacacgctgctccgcctcctcaacgccacccgcgtcggcgagcagctgggcagccagctgaagaccacctacgacggcctcaccttcttcgcgccgacggacgccgccttcgccgcgctgaggccgggcacgctcaacggcctgagcgaccaggagcaggtgcagctggtgctctaccacgtcctcccgcgctactacaccctcgccacgttccagacggccagcaacccgctgcgcacgcaggccacgggccccgccggcgtgtacaccgtcaacgtcaccaccaccacggggcagagcctcgtcaacgtgtccaccggcgtcgccgccgtccccctcggcaccacgctctccgccgacttcccgctcgccgtctactccgtcgacggcgtgctcctgccggagcagatgttcgggaaggccaaggctcccgcgccggccgccgcgcccgcgtccgccgccgggaagggcgccaataaggagcacaagaagggcggcgccatgcccaagaatgaggtcgcggccaccgcgccgacggccggagctggaggagaagattcagatgacagcgccaccaccaatgcggtggccgttgcaggcgcggccggtgtggtgtggactgctgctctcgtggggattgccaatcttgtcatcgcgtagaaagtgtgtgcttgtctttttctccttcgccgttttctttcgttttcgtcgttgcatatgtttcattgcacgtgtcctattttgtatgtatgcaagagtatttatatatgttgatgatgattcactcagtgaaatttactggcttcttttggtctttccattgcatgtgccctactttgtctgtatctgagaatagttatatagatgattcactcagtgaattaaattcactcttttatatttctttcctacggcatgtatgtataagagttcaaggtggcctttctgggaacacataacctatattaacaaggatgatagcccacgcagggcatgtatattatagtctgcatttgagaaacttctaacaattgaatatcaaccatatgggaccatatcctatatgaacaaaagcttcccgtgcacaatcagtgcacaccaactatagacatttactcctaatagtattacatgtatctataaagtctcatattcaaattcattatattttagcgataacaaaaaagtgaaaaaaattgacagatttaagggtaaaaatctgttagaattttgtctttttctttatgactaaaatataatgaatttaaagataagatttcacaggtaggtgtaatactattggaagtatgtgtccaatttttttaaaaaaaatttgtgacatttgctagttgatgtgtacggagtgtgcacaggaagcttgtgtacatagtatatattccccaaccatatagcacttgccaaactttagaagtatgttttcttcataaatttatttgtcatcttttcttaaataacttttcttacataggagtatttttcacccatatactatctaatatttaattcatctatataagctatttttttcttcatcatttaaaaaggaggtagaatagtttgtttaggaaacatgtctaacaaattaagtttaaattaaaactaaggtgttttttcttttttaattgaatgttttggggctcttttttgaacaaatcttggaaaactattattgctaataatgtaccatcaagctagccctctttttaattggttcacattgatgcaatttgttatatatatttacatatgaatcaataaagagagagtagatatacatatcctagatcttgcttccgagaaacgtacacatgtcatacgacaagagggggggggagttatgtttcctttgagatagatccaatggtttcaacagtttgatttataaatataataatgacccaaagtaatgtatttgttttatacttgttaaatatctattttctaatcaaattgtgtattatcataatattatttataaattttatgtgtatttataacattaattttatgtgttgcatattgttctattaaaagctttgtgtttttaaatagatcattaaaatatctatatgattttacctataaatgtgtttttatctcttttacttattaaatatatagttagtttggataatctaataatgtatgtggataaaatattagctatatgatttagagcatataattgttcggaatttattatcacaaaatatgttttctatctaatatagaatgagggaggaggtatggcgtacgtacgtgtgctggtgcacgtgcacgacacggacggcccgtgtggatcctttttttttaactctttttattaactagcaaaatacccgtgctttgttacgggtaaaagacaaataaattttttattatgctaagtattgatcacaaatttaaatgataattaggatggatgaaaaccagtattgcatattgatatactcatattctcatcataataaagatgggcatcggtgctcgggcaacgaagaaaaccagaacaacaggaacatggccggcaacgacgtggccctgatagagagagaaatggcattggcgagctctggtggtgaacacgagcagatgagtgtgttaaaacatgttcccagacgaggggttccattttccttgaatgcgtagaaagaacgaagatgaataaaaacaaccaacactattcatcatcttccctagccgaagcaagaaacaaaaaagagggaatatgggcgttggtgctctggtgatcatatggcggtgaggaaggtggtcggacatgtaccacgatgtgacttgtccatagatggtggcggttggttataaagaaaatcaaaacagcgggaacacaaccagcgacgatgtggtccccacagaaagagaaacggcaacaacgagctctagtggtgaacacggtcgagtgagcatgtcaaaacgtgttcctggacgagggggttccgttttacttgagcgcgcaagagggagggaacacagaggagaagaggggtgctgggaggagaggtgccagggaggagaggggctacggggagagggggatcacgaggcaaagatgggaggcgttgagagggagggagggagggaggcgaaagcggaggcacgtgggagggagagagggaggcggaagcaaagacatacgggatcgagacagggagagaggcggaaacggaggccatgcgtgatggggaggtggatggacaaaaatttgtccgaaggccttacatatttttttaattaggtatagaggtgcacccaacggtagaaaatagtgatttcaccgtatttaaagtaaaatcgatggttagatatttttatttctttagaattgtttggattttactctactttattagagcaccacgaggcagcttacgagagtttgtaggaagagcgttttaggaaatatataatagatagatagatttcatacaaaaataaatatacccttgtaagttgaaaaccataaatctgtgcgatggggctttaacacccatcagtaatgcatatatggtacgcacgtataagaattgaacatagttttacactaatattattaattacaacaaattgatactgcagtgtcaattttccaataactaagctatattcttatttacaagaaatgtaatatatattataaatatatatccaaaggaattaatcgtcaaagtatatatgtatttacatgtttattacatatatatctcacctctttgtgatgaaaatttggctcagtccgtggttacccactgatgttttctcgtgacttttatatctcacctctttaattaacacattctgtatcctttatagtcctgtttgaagagaccatgttttgatttaattgagtgtgtgttttaaatatttgttttcacttttatgcgtattcctgttattttaatgcagtttaatcgtaaaacaagtaattcctgttagtttaatacacagtttaatcgtaaaacaagtactacctatgtttagagtatatgaccggcttttgtacgtacgtctggccttacaacttattaaaagatagtgcaaatatcatttattttgttataacttatatgtgtactatattttgtaataagacaaataaaagatgaatgataagacaatgtgtccaaaagccaactgcttcttatatttaaaaatggtggaagtaccaaactatgggttaatttgtgcagtagtattttccagtgtgaaggtggtaaaatacacagggcaagtacagtagaattcatattgatttagagatgcaaactaatataaatcattccacactgaaggacaataaatttgctatatataaaaatgatatgtcatataagtactacatccagttcggattgaattacaaattgttacaacgcaataacaacatatgaagattcataatgacaacgctacattcagcagaaaatttcactccagataatcacgatgtccccaagaactatttttgagcttttttcgcagagggcctaccaacgtttttctttttgctgccagaagatccaccaacggttttctttttgccgccagaagatccaccaacgtttttcctattgctgccagaagatccatcattctctctcttcctcctaggatttttcaagatttttataatttcttcaaacactcttgccttctcttctttgatagtatcaatttcatcaataaatctcgccatccgcctacttgacattgcagtgaccggtttgttgatgatcctccctatcttcttctttatacttcttatctgtgacaggttaaagaaccaaattaatatcacataaaatgaaatcaacttcattttatatgcaatgaactatgtacaacatatattactactccctccgtcccaaaataagtgcaattttagcactgttcatgttcaacgtttgaccgttcgtcttattttgaaaaagattatgattagtatttttattattattagatgataaaacatgaatagtattttatgtgtgactaatttttttaatacttttcataaatttttcaaataagacggatggtcaaagcgctaagcacggatatctatagctgcacttattttgggacggaggtaatactcaacaactagaggcatgtagatgatcgttttccatgcacatgcatacctgctccaccgagaaggttattagagctttgtcttccccatcacaaaccttgaagaaattgttcagagtctccagttccttgtcagtttccaccgctgtggcgcgcagatactgtatcacctcgtgtggagccattcttgatggcgtcgcctgcgccctcttcctcttcctgtctaccatgctcgggtacatggtagcagtagcagcagagctacctccagcttgctgggtcacttgagatgattccagtatcttcacgtctgcccttttcgctgctggacgactgtttgcagcggcatagaattcttcaactttgaacagtaaggtagcaacaacagcattctgctcatgggctgctggcggcgccggcgccggcaccggcgctggaagctctgctgctggaggagctccgatgaactgtgccgccggcggggacgctgcatctgtagttactgcgcacataatatcaatttgtatgaattaatacacaatgtacaaattaaaatggttcaaatgaaaacatccatgccttatcactcgctccactgtttcagtatcgaaaatttgacgacggctcgatcatttaccgttctcaaatggggctgacacgatcgtatggagcatgttcatttccatcgccgtgtgactgttggccatgtcggtgcggaccgctccggagaagttgtagccagtgtccagaaaatgatgcccagtcgtatcatttttcagcttctcaacgttgcttgcgatgaagtcgctcgcggactcaatggtatgattggtaaggctgaaaacatttgaaaaagaaaattacgatatagaaactgttctgatcccttgagaggttgtctcctcgcttgtttaaatccatccaaaaagatatgagaaaaagtctcaaaaatttcgacaatattcatacaacatatatatatacaagtacacaacatcatgcaaactccactcacactaagatataaaaaaaaacaatgcaacaacgaatggaggtgaaggtgaaaaacaatcaaagtatttatatggtttcacaagaaggtaatcctaacaatataacatttttaaaaataattgggggaggggggataagcaatgttgtttttcatgcacaagagacaattcaacgtcttctttttgaaagtcacatagcacgatttgtttgacaaagtgttttctttgcatccaatattcccactcctcatagtgctcaaaatatatttgaaaattggcttgtcaagatacccaagtccaaaaaaaaaattatgatctgagccaatgcactatgttgttcaatttggcgttgcccaaatggtaaatctttttgtaataaaatttcgctaatcctatagagtaggttatctttatgtgaaccagctctacacttggtattagaagtaggaaactatgcgtagttatatatactgcagttggaattagtagccaaatggtattttgttctgttttatatgtctttgtacctatagaattacttactggaatttgtgtgatttgtcttagcttttaattcaaatggttatcgttttagaggagttggggacttgtcccatcactctatatttttttctttttctttctcaatactaaaatttatttgttgtatccgagttggtagagaccgggagatataaaccacttctattaactaaaaaatatataaaaaaagtactattcatatgatgaatttatcttttatttactgtgcaggacaaacatgaacgtgatttttggagtgatagacgtcattatactcactattgtcaattttttttacactatttgtattgaatttgaaaaaaaaaaggtacacgaggagagacgtacatctcctcaagggattataatctgttttctcggtaacagcgtgtgattgttgggaattttatgaacagccggtgttggggaaaaaacattggatacaacaaaacaaagttaatttaatttgagtcgatcccttactcgaagtatagcagttgtctcccggggaagtgtagtccttcagcaccagtagcagtgtatctgcgatccacaatcgcatgttgaaatgatccaaccccggttgcatgaaccaagaagtatattgtccggctagctgcgcggcacaaagggcaacaatttcacaaaatcacacgccggacatctattcataattcattatcaaagcaataatcacagtcgacattgccaagtaattctcattttgatgcgtattaatctgcacataattaaacacatgaaagcatatgaaatattgatagaacttatttaccgtttgcatgcatcatctccctgacaaggtggcagttggagcagtccagatctccggcctgaaatgggacgaagtcggcgtactcatcgacgacgacgggcggagcagtgtcgccgccggcggcggcgccgtgtgtgtcttggtcagcccacatcaggacatcatccatgtcgacgtcgcccatgtcgacgttgaagtccatgaaattgaacatcacgggggagcatggagcgtcccgtgatggggcggccaagaacaaaccgtcgtcaccgcctgagggcgccatcgtcgtcgccggcgccggctggccggcgaagccgtgcgccgccggcaacggagccagcggttgctgttgctgttgctggtgatgcatcaccggcggcgacgcctgaacctgatgagtgtatccaccggcattcatcgccggcggcggcggcggagactgaaaattcaactcgggaaagaagtcgagatcgacatcgaagccgagatctgcaagcaccgggttcccgagaccgaaatccgccgccggagcgggctcgacgtgagccgtcgccgccggcgccggcgccgtaggaagcggctcgacgtcggggaggacgggcaggggcaatgtggtagccgcttctgcctcaccgaacaagggaagaaactccatgtcgtcgagcatgtagcggctcacatctccattggagtcgtagaaacggtgctcgccggccatggagatggtgatggtgatggaaataaatcgcaaaggcggcgcggtggggagcaaggagagagatcgagtgagagagagatcgagagagtgtggtaagttagggaatgagttggggaatatatatatatatatatatctcgcgagcgggagggggtggtttcgaacggatcgaggcagcggttggcgatttcccctcgcgtgcgcgtttctttcttttttgaggtttcttttcggccgtcggatgcgtatcgggcggcgcttggcgatggctgcgggggcaagtggtgattagagcaaaggcggcgcaccttcttggattttcaatttagccattttgggcaagtttcgggatgtgaacatgtccttgtcataacgtgtggatggtagaagagtgagacttatataccagtgactgtcataacatgtggatgatagaagagtgagactcatatactagtgattgtcataacatgtggatgatagaagggtgagactcatataccagtgactgtaatgacagtaatattattgtcgaggattctcatccaactattatttgcctgatctgcgttagaataccaattatagatggagcaaatatatggattctcgttcacacatatataaggatgaccatccactccttaccagtataagctaatcaatacttcaacatataaatctgaaagagcataaagtcagaggttgtaagcctaaggccatgaggtaaccggtagtagttgcagaaaaaaagtccaaatctgaaataaaagtttgaaatgaaaatctttaattagataagaatgaaaaaagaagctgaaaatcagagaaaaaaactttaatattggaaaatagtgataaaattagggaaaatcagaaaagtaaacaaattgaaagtactacgaagaaataaaaattactgagcatacaaaaattatgagaacttatcaaaacgatccaaaacctaagtaattgttttactagtttgaaaataaaaacatctcaaaaaaaaccaccacgttcattataaagtctagtaattcctacattaatcaaagggaaaagtatgcttttagctagaaatataatttagaaataacttaaatttggaataacgaaaactgaaagaagtgtctaccaagaagacaacacgatattaattaaaatttaaaataaaaataattgcaaaattatattttaatgtgaatttaagtaggaatatataatatagaaataactgaaattacaattaaaaataaataatattgaaatataagtccatctggaacacaatacatgattagttaaatatctgaaaaatataaaataaattacaaaattggattttactaatttcaaataaacttaaaaatcacaggttcacctctgacagggtgtttcagtgcccattatgcatgatcatcggtgacggggtggagtttagaaccgacaaagatgtatgtcatcagttacaggtgtttgttgcgacccgacaccgatgaggcttttcattaaaaaaacaaatcggttttattggctagcctcaaatgctagccacgcccgctataaaattcgcagtattcctgcaacacataacttcccccatagtcccatatatttgacattcacatacaaaaataagattcagaaacgaccacaacacataaattcaaaacctcagatgcatgcaagtctcaatagttggattacctcaattttttcaattctctcaacgaccaatacctttgatttcttaccttacaaaatcaccgaagcatcttcaaatgagaaccatcaatcacaacatgtgaatgcagttataatttaaattaaccaagtgatgaatatattagttaatatgaatattaccaatgtacatacatataaacagaagccaagaaaaatcgttttccaatagagaatgtcacttaatcatccatttaacacatatacgtgtagctatcctatgataattcagctactactttgcacaaaaactgccctttggagagacaatttttgctaggatgaaggcagccaattcatttctaatatcctcgaaattatgctctagaatgtttgtaacaactgttggtatttaatacggtcacagataaaatccgcaagcgtacggatataccgatgtagcacttcccctacggagtatttcaagggtatcgaatccaagaacgtgtgtggtcaaatcttcctccggttcatccaaggacaccaaccaaatgataggccaggatagagaggatttactagtgagaaacagtgtctagggaaagcttaactttaatcctaacgcaatacttcaggcacaggcaacccgctgttcccagatgtcgctctactacgtacccggacagggaggacttaactaatctcgagggctgtcaccacctctacacctacctcaacacactgtgggatacgcaacaattactggataacaattacctaaacaccacgtctaagcaattaatatctactttagtgtttataactcaccaaagcaatcactatattttaattaattatagtgaacaataatcccgtatgctatttacgaactaaccaagagataattctcacaagataaatctaaattactcaagaagaatattatattgaattcagagtaataaatagaaaaaaaaataggagaagattaccgacaactccggaattcttccgactccttctactctacacttttcctattctagtatacaatataggacaatagagcatcttgtaattcagctcaagcttggaagtgtgtgtgagagtgaatgaagtgaggtccttttatagggcagttatgacggttgtgagaagggaaaatgtccgaactgccctgcaaccgtcattgggagaacatctggagcgtccacgccaaaccccaggatcaacggtgatcaggggggttcggccgaacctgggctgggccctcttggcctggccttcggtcggtggactccctgagacgtcctctatccatttctcggagttttgggttgatttactaatgtttcgatgaagttcacaatccctccttgtatggatacataattctcctcactcgagtctgattttcctcccaacactggggtttattatctgcatacaaatatataccaacacttgtgtaatatttgagatgaaacacctatcactatgttggatgttttattatccaaactttatgcagatgttggcggtatagagtcggcatttaacagccgccaacaacaacctcctgaaagagaggcgttaagttagtacagatcctaggtgcaaccataccaacgtactaatttgttttcccaaatcaatataccacaaacctcgggatctagcgcagtcacctgtcctgtgaggaccttcatggtatggcacacgtggaaaccacaggtctcgctggattgttgcttgcatttgaagtcgtcatggtgatagaggttggatttttccttcttgatgcatgcccatttttgcacgtattagtcccatgctgtgttcaatgcctctttgagagcgttaaagtcatatttgtcgcttatgcggcagttaagatagtaaaacctactccattttggcactatgcacaatagaatccaatggaacccgcaaagttaatatagtgtaagttaaaaaccacacttttagatgtaactagatgatgccccgcgctttgttgtgggatatatgttagatattggagaaacgatgaaatgatttggattgaaatattacgaaaatgatttgagaatgatgatttagcatgtgtatgtctagttttagaatgaaataaattatatatataaataattattactgcctccgtttcaggttataaggggctgtttggttgctatcctgaggagaactagcctgacacggttttggtcctatttggttgctggcctgagactgttttcccctcgcctggcctaatgcatatctccgcgcgtgattagcctgagtcaggcgacttatttcggtcgcgtgagctccaggcacagcagctagcgagattaccgtcgtataattttcctccgtcctccgggcaagccatcgctaccgtcacgcaagactccgccgccgctgggcccgatgtcctcacccgccatcgttgtcgcatgcacatgaaaagcttgcctcttcctccgccaccgccattacgcgcatgcagtgaaaagcttgcctcttccaccgccgccgccgtcgcgcgcatgcagtaaccttgcctccgccgtgggaagccaccactagcttgccagatccggcgtcacacaaatctgcggtgaagtatctcaattcgtcggttccatctgcgacccatctgatctcccacacgcagcagcaactgtcgctgatctgccgaaacaattgaagcactttacacgcagttggagtcttgaagaaatcgttgtaggtttgggcatttatgttttttcttttttttcctcttctttacgtacgtgaagccggcaaaaattattaggcaataaattgatttgttacagttagcacttagcaatacccatctaaactgtagattctttttcctctcagacaactgtccacaaccaaacaagcaaaatgtcaggctgcctggccaggcaagtttcatcaacttctcctatgcctttcaggcacacaaattcctcaggcatgatacttagggcaccaaccaaacagcctctaagactttttagcattgtccacattcatatagatgttaatgaatctaggcacatatatatgtctagattcattaacatatatatgaatgtgggcaatgctagaaagtcttataatgtaaaacggaggaagtatacgcttgcatgttgagctttgtgtgcttaatgggttgatctggcatgcttacatgtaggttttaggagtgctaataaatactatgcttgcatgttgagctttaggtgtttagtgggcattagctttatagaaagaagggattattaattatttagcatactcactattgattgtgtgctaatatgatgaagcctttgtcctagtgggccctcaagttgttcatgatgtaaccgaccacatcatccaatcaagacttaagttgtgtctcattgacttgacgtggatctaggaatctaacttgacttctggtcttccgtgcttccatccaacataaccttcaaggttgatctgtatggctagaagcattctacatggattgttattagctaagtttagtgttattagtacttacaatgagtagcactttgggagatcggtgtccaccgctcgtagcctaaagaggttgaaaagatcagagaagcccactatgatataactgggtggccccaggaagggcgcttggtcatgatgacccagtatggacatatcactattcttcctcttggagttcaatttatccacgtagtaccgacgcagctctcgagtaatagtgcccattctggctaattcattgtcttgatccaacggcatccctggccagaatgtgtcgtgatctaggatcttgagagcaacgtacacctccttatctagatctagccgtttgggaggtaaggacgaccctcctacctttccttttcctttcaattttccccttccatgatttggcctgctagacaccatcggtggagatgaattggccttttcttttctttgaaggaggacgatctatggccattccaccaaaatccaagacgtgggacccaaaaggagcttcaatggccatctgaggtgcatgagctttagctgaccgagctagatgagttgggcctgctgcaacatttgaccttggaataatctttgtggtgatgaggtcttttggccattggataaacattccacgtgcatgagcgagtgtaagtatctcgtcctttggtgggattggtagttgccaattcagcaattgtctttgaccatgtcaacttggactttggcatgtccagctaccaaatccacgccgtacactcttgtttctggagtagatgttgacggtcgttacagaccaattttgaccgtcaatataactaaaataaaggagaactagctatgcttgcaatacatatttattttagaataatatatttccacttgtacttggagtattatttgtttgcagagattagcacatgaataaagaagaaattaatgaaaacttcactcctaagcaagcttaagaatacaagggcccacatgtcaggtgtaaccgtcctggaaaccgtcataactgccacaactgccatgaggacccatctgtcaaccccctgaccaaatctagaggcctgctgggccggcccaggttcggtcgaaccctggtagcaccggctcagctcagccctccacatggacgctccagatgcactcctaatgacggttgcagggcatttctgacaattccaactgccataaccatcattgggaggctatataaaggggtcactttcttcattccaacacacactcaagcaagaagctttgatatctctctctctctctctctctctctctctctctcaagtttagttaatgctctagtgctaagtggagtagaataggatagttctcgaagtcctcgagtattcagaagatttcagtatggctctagtagcttttctttcttctttcgtaagactctcggaattaatagaatattcttctttatataccttcggtactttactctgtatgagtactggatttactttatatttgtgccgacatagttgtatgactagcctaccagagaggtgcagtggtgtgggtttaatgttcatggaaatgattgatctatgttattctagaggatatagagtaatatttgataatgtaagcatggtgcttagattattagatatcattaattgggcatatatgctgcaggacagtagaggtgggccgctgatggtgacaacttagtacgggtattcctccacgttagtatatattcctaagccaatttctggggagggtactcctccgtatttagctccggttggacggccatgacaggttgttataagaaactcagcaacccgaggtggtctctggaagctaaccaattgttataagatactaacaattgtaaacttttactttgcaagagctaacatgtgatctattactaggtttgtactgaatttatattttcgtttgtatcttaaaagaagttcagaagtggcgttgtacagattctttctttgtatctattgtggggttcataccgtatttacgtttcctgttacacaagcatggcttttttcaattgttcaaatcctattaagaaccatgcaaaaaaaaactattaggaaggtacagccatgcatctatggaactaagagttctcatgatttggtttctctttccaggtgctttctcacttccaatctttcatggaatggcatccatattgtgtattattaatcatgtcataagaaatggatcatttcaccaatcatatcattttattgtatacctctttgatatactaacattttggtgtcatttagatactggggtttgtcttcctgcttataaatactttgggatctatcaatcttattgtagactgcaaagcataatagaagatctaagaagatttaaaggtgacaactgacaaagtaagcatcatgatctgcaaaagatattcaggtttctcaggggatgtttatgcagtcatagcttcatcagtattcagagcgcacttcttaacctgtagatcttggatctctaatttccatttgtatcagctacgttgtgtgtttcaactacatactatcttattttctgagattttgtgggagtaagggtgtgtctctaaggtaatatttatcttgactttctgttcaattctagaattggttgattacactgccaatagaatttactaaaatcaagagtaaacatctagagacagaaaaaatctatatggaaaacagaattttattgaaagaaagagtcaaaatccaatgactaccctattgcattcttacctcttgcctattttgctttaatttttatctcagaccagaccattgattttattccaatgcaatctcttcaatttttgatggtttctcattgttaatgtggttcattttcttttgagttgattcgctctcaatgtaaggcattcattatcatgtaggtactgagtgttatacttgatttatcctgctaaaatatcagctcatgtgataagatggctaaataggctccttttcttccaaactcaatcttaatatgaacagatgtgctcagggccagtcctatgattttgagggccctaggcgaactcatcgtgatgggccctctaagctatatataaaatttattgatatatatatacgctaattttacttacaaaacggaaacaagtacatccatatattaaatttaatatgcttggtaattatcaagaaataaagtcgaccaaaataacaatatatttgtaacttggaactaatatcattattcattaacttaatgaagaatagaaccctattccattgcttcctatgaaaagatacttcttctgacatttcttgatgtaaaatcatcaagaatggtattaagatcaatattgtccaagatatcattctcgattgagtacatagccaagccatttaacatttcttgcgacatagttgatctcaaatagttcttcaacaacttcaattttgagaaacttctttcagctgaagctaccgtcacaggtacggttaagagaattcgataggcaactgaaacatttgaatagaaatctgcatccataacaaacttcagaatctcaggtgcggacattgaagaatctagcaaactcacttgcaacacctttaattctaaataaaaatcattgatctcaatatcggatgacgtactagattactagtattaggtgttggcccctcaccattatgggtccccggccgtcgcctcggctgcatagggccagggccggccctggatatgcttcatttatatgctagccttgaggttttcagaccgtcatcggcattaagatcatcaaactgcttgtcataatagtatagatttaagtatcaatatgctctgtcatagccatattatcaagttgacctgacttttttagttaatgaaaactttattgaactcagacaattaaagttgaccaaactatgtgaggtccacctttaatatacatctagatccttctttgatagcaaggtaccacgcttcatgtaacaactctgcaagctatatgacaaattggtcagatttaggtataattttgcatgcttatgcatgatactttcaacgtgatgcttgataatagttggattatcaagtttgaagttaaattcatgtcaaatatgcatcatttattgactcaggtatccctgtatgcagtgtcctccccgattggattttgagcagcgtgagtgtctcctggcacagccattatatgctctgctagctccacttgatatccctgccctggcagtgagcggcaaatacaccaacattttgcttagatgttacaactggtgtaaaagaaattatgattccacagcaactgggtacagatattattccctgatatattttgggttgttgctgtggaatgaagattactcacagccgtgtccagtcgagccagcctcttccggggtaccagaactactttggcaaggggcagcagccaccttcccactaccagccatcacaagatcaccaccccaactccacgaggatgatgacccaggcaatccgacaagcttctaaggtgctgattggatgctggtttccaaagattagttatgctgtgcatcatggacaaattatgttcatgtagttataaaaattttttagcccaagaattagatggatccgaacatatagaagttgtgatgatatcgtgtggctatgtatttaataacaaaataaaaaataagtaatggttacaagagtctcagtagcaccttagttcttgggtttgacttcccatggaaacgatttttttaggttttaacggtattgtgctttcagtgataggcgatgtacccgtcaacagcgaggcacctgtggtgacttcgtcaatattcaggatttgccgcccatgggaacgatttttttacatgcattttaaatttatctaattatatgcttgattgcgataatatatgatctctttagtttatttatatgcattatcaaatattacggtagtgttagcacagacaaattactagttttataaattacactataacttacaagatattacactgtgaatttgataagttcacagtgtaatttcaaaattccattataagttttaaagtacaatgtaagatccataagtattaactttgaatttcataagaaatcaccataatttaaactttcaattttaacatcccagatagtcaccgttgtacaatcatagcacaggacacacattaaaaactaacaggcatattcttttagcctatgtaggccagccaacaaacttccgttggcccatattgcttgcatgttaacccatcaactgtaggcccatgtccgaaggacagttggcccatgaaaacacacagatctagggatggcaacgaggctgcacccgtcgggttctactaccccatccccagagtgagaaaaatattccgtcaccatccccatccctgcacacggggaagatttctcctcgtcccgtccccacttgggtaagaagcacccgctgggtgcccatccccgaaaattatcagcaacatcaatgctatacggaagatagaaagcagcaagaagcataccaatgctatactccctccagtttcattttaattgatattttagacaatgacacggtttacaaaatatacctttgatcttatttttctattataatatatataataaataaatgcatgtttatttttattatagtgtatcttattctagtttatgtaaactaaatattttaaaagttattgatggttaaaattataaaagtttgaccttaaccttgtccaaaacgtcaattattatagaacatgcagcaataatgatttcatttagccatcggcaacaacaatacatggctaaacactaatgtacacagagttgctagaaatatggcgccactttttgtgtaaaaaaatagtcaatttttagaccctaggatatgtttcaagattcgtgcgagtgctctccaagagaaaacacgatcgataagttacagcaaaaggcttttgaccaactgagcacaaagatggtactcgttctttactcaaagtaattataattaataaaaattacactatagtaacttacatgccacttacattgtaattacatactaattacatatataattttaggacttacatatgtaattttgaaacttacagtgaaaatatattaaaattatatatgtaaattttagggacttataatgtaaatacatatcgataaaaaatacggtgccatgtatatagatagtcccataagaaaagttatggtgagaaattgtgtttaatactataattacactgcacttacaccttacttacattgtaatttatattaaaattacactgcacttaagtgtaaattttgtgatcgctagttttctatcttaatttaatttatattgtgtattataatcaagttacttatttgctatattgccacggctcgttaatggtcaactttgtgtttgaaatggcggtaatcagtgtgaagtccaatccgagactaaattttgtggcgtcatatatatagatggacccgatgaaaatcgtactttagcgtcaacaataactaacggggctgtctatatatcatgtgacggaaaatctcacctcctatcattcaaattttaaaccattggatgtgctttaagattcatgcagccccttaaccctcactcctcctcctcctcccccggtttctagatcacgccgccaccctccttcttccgtcccacgcgcgatccgccgacgtcaccactgccaccgcccaccgcgccgtcgactggctcgtcggctggccggaaaaggtcaacggcgccggggagggcccccc

SEQ ID NO: 10530 - DNA, 2072 bp, Oryza sativa
aacgatgaggtgtccccgtcccacggtcttccccgtcttcggcggctccccgccgccggatccgccacctaatcccacccttgctttacccccaccgccaacaccggcccactgccctcctccatccccgcggcttcggcgccgccgccgcctcctcgccgcccgccggagtccaccgcccacggccggtcctccgccgctcgccggagtccacagcccaccgccggtcctctgccgcccacggccatccctctaagccccgaggaaaccccctcttccccctcccccatcccccctcctaccctcactccaaaccctaaccctctggagtcggggtgtcgctggcgccggagaagaaggggagcctgtcggagttggagagaagccgatgcacgaatcttggcatggatccaatggtctaaaatctgtaagatttcatccccaaatttcatttgaatgccatatagcaatcccgataacgaaaatctttgcgtaaatgtgttggagtaggtgacaccgtgacaacagctgagcggtggtgctgcttgggggtggcgactatagttagccaaacaagcggcacggcccaggcatggcatggcccgaccaacacaccgagccatgccgtgccggcccatgggctgcaccaccggcccaagcacggcccaccagcagtcgggctatgccaggtcggcccgaaggcacgggtggcccatcgtgccttttttaaaataattctatttttttctcccttctctttgggctgtgacatatatatatatatagctaaaataagtctattttccctcccttctctttgggctgacatatatatagcaaaaataagtctattttacatccctattctttggaccgtggcatataatatgtctatttttgctccctatgctttgtgtgttgggcttggcctgtcgacccatcgtgccgtgctggcccaacgtgccggtgggggggggccaggcatggcctagtggccaggcagggccggcatgggcccgacccccgtcgggccgggccatgcttgggtcgggccaaaatatcgtgccatggaccgggccgtcgggcttcgagccttatggctatctatagtggcgacggtcgcatggcgcggcgcggtaccccggtgtagacgacggtggcaaggaagcagcggggaggatgagatgaggagagtggaaacatgggacggaggacgggatgccgcaccggcgtggcctgagtcgttgaagtggcgatggactcgagcaggcagagggtggcggccagatctgggacatggatagggttcctagtgtatgtgacctaaggttttcacgaaacataggctatgtttagttccacgccaaaatggaagtttgactaaaattggaagtttgaagaaaaaagttgaagtttatgtgtgtaggaaagttttgatgtgatggaaaagttgaaagtttgaagaaaaagttgggaactaaactcggccaatgttacggaaaagttaaaagtttgtgtgtgtaggaaagttcgatgtgacggaaaagttttttcttcaaactttcaactttttcgtcacatcgttccaatttcttcaggcttccaatattagcgtggatctaagggtgtgtttagttcacgccaaatttggaagtttcgttgaaattggaacgatgtgatggaaaagttggaagtttacgtgtgtaggaaagttttgatgtgatggaaaagttggaggtttgaagaaaaattttggaactaaagtcggcctaaacacagccatggtctattagttttgatcctgttttaaaacttattagtttaccttagcttttatttagttccacgccaaaattgaaagtttgaagaaattagaacgatgtgatggaaaagttagaagtttatgtgtgtaggaaagttcgatgtaacggaaaagttagaagtttgaagaaaaaagttaaaatagtttggaagtaaactcggcccttgtttagattcaaactttggccgagtttagttctaaactttttcttcaaacttccaacttttccatcacatcaaaactttcctac

SEQ ID NO: 10531 - DNA, 4913 bp, Oryza sativa
  unsure (1)..(4913): unsure at all n locations
catcgttccaatttcaaccaaacttccaattttggcgtgaactaaatacacatttttcttcaaactttcaacttttccgtcacatcaaatgtttagatacatgtatggagtattaaatgtggacaaaaaaaaaccaattgcagagtctgtatgtgaatcacgagacgaatcttttgagcctaattacgccataatttgacaatgtggtgctatagtaaacatttgctaatgacagattaattaggcttaatagattcgtctcgcattttacaggtgaaatctgtaatttgttttgttattagtctacgttttcaaatgtgtgtccgtatactttaaaaaattttggcacacgaactaaacacgccacaggccgtgtttagattcaaacttttttccttcaagcttccaacttttcagcacataaaatgtttggacacatgcatggagcattaaatgtggaccaaaaaaacaattgcaagtttgcatgtaaatcacgagacgaatcttttgagcctaattacaccatgatttggtaatgtggtgctacagtaaacatttgccaatgacggattaattaggcttaatagattcgtctcacagtttacccgtggaatctgtaatttgttttgttattagtctatgtttaatacatcaaatgtgtgtccgtatacttaaaaaaattttagcacaaaaactaaacacagcccttataggaaagttagatgtgatgaaaaagcaaaaagtttaaagaaaaaaattggattctaaacaggcccaaaccaaatatcctaccatgaacacagcgtcaaattttgaaaagggaggaaagttaatatgcaacttttgcatggctgcatgtcaaacccgtaacagtccccttccttatttaaaataaaagagaaaaaagaaaaagaaaatgtgaataaatctgcaacgttcacctgtggagtccgatccaatccaagccgtaaatacgaacgagtcttccatcggaaggaaacccgccagagagagagagagagagagagagagagcgcaacggcctcctcgcaccaaatccgccgtctctgcggctcctctccttctcctcctgcaatccaaccgccctcaaaaatacttgcaacccccactcatcgtctcccctccccgtctccacgccatgtcgtcgtcgtggttccactccttctcctcctcctcctcctgctacttcacccaccaccaccaccgccacgtcgtccaccacgcgtcgacctacttcgacggcgacgacgacgagggcgacgtcaagccggcggtgacgcagcactggcgttacgacgcccgcgctgcggcctcctacggcggcggcgaggatgtgaagccggcggtggtggtgaagcagccgccgctgcctcgcccgagagtgggaaggggtgtccacgaccgcgcggaggagaccacggcgctctcgtggccggtggtggagcccttcaggtccacgctccgcacgcaggagtcgctcgccgggatccgcgccaggtacagcgtccccgaggggttcggcctgcaccccgccggggccaaccagaccgcgtgcgcgccgcctccggtgactccgcgtggcgggcgcgggggtggcgcggcggcggcggcggtgccgatctgcgtgtacgcgcaggcgttcgcggcggggatgcgcctgccgctgcacccgttcgtcagcgacgcgctggcccacttcggcatcgcgccgtcgcagctggcgcccaacgggtggcgcgtcctggccgggttcgccgtgctctgccacttccgcggcgtcggggcgccgtcgctcccggtgttccgccacttcttcaccctggcgccgctgcccaaggggaaggggtgggactcctttcgcgccagggagagccgtgccgcgctgttcacgggcctcccgtccttccgtaaggcgtggaaagaggagttcctnttcggtttggcgccggccgccgcgccgtggcgcttgcccgtgcgctgggggaccccgtccaaggaggccacgagcgaccccgcgctcaccgagagggaggccgccgtggcgcggcggctcacgcagggccaaggcgtcgtcgacctcaagacctacctctcggagagcaacctcgtcgccgccaagatcagcagcgccccggcatgtctgggaggtacggacggacgatcaaatgccaccaacaaaacgtacatcggatggtgcagattcctcaattgctcgattgttttcttctttcttgcttccagggacggaagcttcacggggttcgtcggtggcggccgggaagaagaggaaggtgctgggcgatggcgtcagcaccggcggtggcgtgcttcggtcagagctgcaggcgaaggacaaggctctggccaaggcgcagggagagatcagccgcctgaaggcgcagctggggagcgccaaggcgagggagctggaggaggcgaggcaggcgttggagtacgagcggaagctggggacgcaggtgctcaagtctgatggcgccgccgccggggccagcaagcgtcgccgtggcggccagtgatccacgttccgccgctgaacgccgccggccagcgattcggtgatgtgctaggtatttactagtactactactacttgccaggataatgagtagctttgcggagtagtgttttagcaaggacctttcatgtttcttcataatcagcatcagctgtgacagacagtgctgatcttggttggtatcatttcgcaacaaactgctaatggaaaatctgttcacagacaccaggtgatgttatgaatcgcaatctgcttagtttatctaccatgttaattagcagcagaaattgctagctactggaatgatcatgggtatgagggtatcccactagttgagcgaaatgaactaaatacatagataatatgcatcagaaagaacacattttatagctgatcttgtaaaacaagagcaaggtcaagttgggtaaccacaagtgaaccgcgcccatactatcgccaaatatccctgcaatctgccatcttccatgaacacaacacgagcatcaggcttctaaaagatggtattttcacagcaaagggtcattataatgttattccacaagtacaagggtagattctgccaaaaatattcatccagttgcaatcagaaagtgtccccaaaaaaactgcttgctaccttttttctttgtacatgttcagccgaaatgttactacagtaattgcaattcaattggtccatatttgcgctatacaatgacactacagctcaagatgagaaaactaaatgcccacaaagattatccaattgtatgtactccaagatttggctagtgcatttgcacggtccactccagctaccctttactcttatcattgctagttgattcgttgtcacttgttgaatctgtggagctattagatgatgccattgtgttggactgctcactgattttctctgcagcgctgctggaattgtcatcgcccatgatagaagcaaaagtgagctggagaccatagagtactaatccaattgagttgattccaaacacaaatgttgctaggtagcatatcccatttataattgttctgcagagaaaacgtggttcattcattagataaaaggattacaatatataacaaacaagagaacagtgaatgaatggagttgtaccttattgttattgttatttgacgaacctgcagaaaacaaaaggaggattccattagatgaattgtgctagttacaaaaaatatgacgaagactgaaattcagttcctctgtaagtatatggaaagttggtagcacgaaatagcacattttacggtgcataaatgtgttaaccgacccacgggaggacaacaagaaataatttttgttgcagctctcttagtatttgttccctgcatcattgttgaatttgtatgtgttggtaaaacacaacaataatttgcattttccatgccttattctccatttgtgaaataatattgaaatgggattcaattccttgctgtaaacttcaaggcacattggcgacaaaaaaatggatggtgattacagcagacaattactcaaagcattgcatagcagtagcgctaacttctactagaccattaacgaaggataacaagaaaatggcaggtaataatacaaatgaagcaaacttcaagttggaaaattcatttgaaaccaaaaaaatgtcaaaaacagcataaggtagaggggttcaaattgctcaaaactaatctgcaatccttacaagaatatagaattattcccacaaaataagtgttaccacactgaattatggtccacactccacacttcatcagagctgctacgaaaattgaagtgtcgacctagggctgtgttttgttcaccacaccaaaattggaagtttggttgaaattggaatgatgtgatggaaaagttggaagtttatgtgtgtagaaaagttttgatgtgatggaaaagttggaagttcgaagaattattttggaactaaacacggcctagataacatagccgcacaagtttcatcggcaaacttggcctgcaataaactatttttgttgaagtctttatcacttacactttcagcctttgaccagaaaactgcatagctctaacacaacttcacttgtgccgtgtttagttgttttggcaaaaaaatttgacgcatacggacacacatttgaagtattaaacgtagactaataaaaaacaaattacagattctgcctgtaaactacgagacgaatctattaagcctaattaatccatcattagcaaatgtttactgtagcgccacattgtcaaatcatggcgtaattaggctcataagattcgtcttgcaatttacatgcaagctgtgttttttggtccacatttaat

SEQ ID NO: 10532 - DNA, 13568 bp, Oryza sativa
cattcattgtccactatgatatattgaattatcatccatgtggttagttcacaacctttattaaattgtccacgactccataaaatttatttgtagctattcacataggttcaatggcgcatagacatggcaaactagttccaaacaatggcgtatatacaattatacatttatttgtcggaacaacaaaaggattaaccgataaagtgaagtctgacaaaaatcaaagcaacacagatacttgtcatcacagacacaatcggacacatacagcacagcctcaagatccctgttactcatgctagatttcctccaaaacttatatgaatttggcaattccaatggaagttcaaagggttcggtcctttgttccaaaggagaacataggcaaatcttcctaaaaggatattcatattctaaaaaatttctcaaagaaaccttagtttgaaaggagccctaaacagcctaaatcaatttaatgtgctgtaaaaaaaacatgtatattgttgcaacaagaaaaatactaaaatattgtggagggggaagagagctgaccgagaagctgtcggagatggtctggcggttgagcgcggcctcgatggtggtggtgaacttgtagaggatgagcgcgatgacccccgcggcgatcccgccgagcagcgcctgcacgggcgacggcggcttgtcgacctcgatcggcgacgcgctcaccagcctcagcccctccagggcctccttgctcaggttgttgggcttctccaccccgccggaccgaaccctctgtgtcacggaagcaaaaaggatttttagaccatttttctccagtcgagaaagcgcagcgcaggtggatgaggagggaggggattacgagctccttggcgcggcggacgcggcggcggatggagcggaagaggaagacggagatggcgccggtgaggaggacgctggtggcggtctgcagcggggtggggttctcgtcgatggagaagagcgtcggggtgcggagctccacggggccatctccctcgccgtcgtcgcccgggggaggctcggctgccgaggtggacagctccggctcggcgcggacggcgacggaacggcggaggcggagggcggaagcggaggcggcggggaggaggtcgcgggacggggggaggaggaggcggtggcggaggaggaggcgcggagaggagtggagcagcagcatggtgggagtggagagctgcttggcggtgctcggggagagagttcagtggataacgaacgggtcgggcgagaaagggtgtgatgaattattttcatttctaaatttttattttttaatatttacagaaatattataccatttaaaatatttacagaaatggcccccctgccgccaaagtggagagcggcaaggtgtgcacatttttcattgaggtctcttgccgccctcgtacaaggggctaaatgcaattttcgccatgttaaaaatgcattttgctaatttttcttttgcatctcggctgtctctcacgtcaccctgggtctatttttgtaaatatttttgccggtataatatttctgtaaatattaaaaataaaaatttaaaaatgaaaaaaattcaggtgtgatcggtagatgggctactttgatggaccgaggccttctccatcgtttcttggtggtggcctggtgtgcgtacggtgggggtgggtgctaagggacggggaactgacggaaagttggagaaataagtttatattgactccctcaactcatgcccctcattgaatcgcatccctcaacagtaaaatcgggtataacccattgcaaatcgactccccgagcagtttcgaaggtggttttatcccacgtggcatctttgcctccgagcaacgaggtaaggaataaaactgcagacgcagttgaacggtggtcaggctagctcctgcaacaaattggtattacaatgtcctaaccactttcatttcgtaccaaggaatctaattaaatattataaaatctatgtgcaaccttacaaactatagtccaaattggtggaagaagccttatgattctattttctccgtttcataatgtaagtctttctagcattgtacatattcatatagatatcaataaatctagacatatatgtgtgtctagattcattaacatctatatgaatatgggtaatgctagaaaatcttacattatgaaacggatggagtatctctcaagcagattgctagggtggacatctagtcaaactatagtgaggataggctcaaagtttaagtctaagagcctgttcactttgatttgatgttattttcaaccttaccaagttttggtaaagttgctaaaaaattggctacatttagtttactgtcaaatttttaaattttggtaattatataagaaatgctgtcaaaattttgacaagttgtcaaaatttcggcaactatgccaaagtgaacaggccctaagtcaataaaagcaaagtaaagtacgtacctttacctacatcgaattcaatgttaacataatcaaatagaaaagaaaacggaggagtgcattgccaacataaaagtgcattcttgattagcaagatactagagaaaaatacagaatcctcattggttagcacaaggccattagctaattagcacaaggttattagctaaggagcgaacgagatgagcagagtagcaataatagactagaaccagttgacttgcccatgccagtgacttgcgcctgcattctgctggtagcctaatgcctcgggcactctcccctgtgtggtcgcatcgccacctcacaccatctgcctcgtagatttcaggcatatagcctccatcccaaccctagcccccaaataccaaatgaatgaggggggttcctgttacacgcttaagcgctagcatcagaggcagcgcgcactttcacggccctaagagcgcttagcgctgttttttttttataagaatgcgtatgtttcttccctttgtttaattaactgaaacaaactttcaactttgatttattcaagatttggaaacttttcaactaatatttgaaaactttcaagtctagatttgaacttagatttcaaaattttcaagccaagattttaatactttcaacttaaatctaaaagttttcaactcttattttaaaactttcaaatctttatttgaaaaatttcaagtcaatatttgaaaactttaaactcaaatttaaaaactttcaactaaagatttgaaaacttttaactcagatttaaaaactttcatctcagattcaaaaacattcaactcaaatttgaacactttcatctaaaaacttaaaaacattcttctcaaatcttaaaaactttcaactatttaagttaagatttgaaaactttcaactctgatttaaaaactttcatctaaggttcaaaaacattcaactcaaatttgaaaactttcatctcaaaacttaaaaactttcaactcaaattttaaaaactttcaactcaaattcaaaactttcagcagcaattaaagatgaaagattcaatttctaaaataaaaagatcacaaaaaaaatcggcaaaaaaacatttcacggcgcggcggaaaaaaaaagaagcgagaaaaaaaggaaaaaaaaggaagagatgggacgcgcgtgggggtgggccagaaactcgcgccgcttgtgctaatagcgcatacgcgctaattagcaatttcgaagaatgaggcctggtttagttggggaaaaaaattttgggtttggttgtcacatcggatatacggaaacatatttgaagtattaaacatagtctaataacaaaacaaattacagactccgccagaaaactgcgggacgaatttattaagcctaattaatccgtcattagcaaatgtttactgtagaaccacattgtcaaatcatggcgcaattaggcttaaaagatttgtctcgcattttacatacaatctatgtaattgtttttttcctacatttaatactccatatatgtatccaaacattcgatgtgatagcgtgaaaatttttgttttgggaacaaaacaaggccgaatcacgcctcgctgctacctctaacctcctacccccttcagttcctaatttgttgacgttttagacaggattacacataccaatgagtgattaattagtgttcctacttcctgttttacccctaacaaatacggtttcgaggtacaccaaaccacaacctgctcttggtttgagtggccatcgcatgcaaaactaaagctactagtcctaagttcgattcttggtgtccacttatttttgcactcatgcacaacgccggcagcgtcaaccacaacggcggcgccgtccacctgttgtgcgagcttcaccaccatggcgccagcgtcgacctactccacggcagcggtggcgtcctgcacgacctgctccatggcgaaaagtagtgcaaggaggcgaatagaaggcagcgccccgcgcagcatgcatgacgttggaaataatgggagtaatggccggctgcatgcatgcagggcaagcaggtccaagatgcaaaaaaaaaaaaaaaaagctaaaacgtcaagaaatatcacacaatacaatggttcaagagctaaaacgccaacaaatttcaaaccggagagagtagtccaaaagtacccaagtgacctatgggcccgcactatgtaacgccaaatcaaccaatttgaccgagcgcgtaccactttatcttctccctaatacagatcatcctcttcatcttcttcgataagcccaatatagatagaaagctctcatgaatctcaaaattaggatatacgggtctacctgctggcttcatccctgcttatttgtaataaataaatacgaaaacggttcttctcattttcctcggtaattttcattttcatttttcaatgggcatagcatctaaagtattaaaacctccccccgctgctcgctcgtccgagttttgcgctggcgtggatgctgccggagcacggcacgtcagcgcgcgtgggacggcgagtagatttcacggcctctcgtgagtccgcgatgattctgtgaactttgcagaaaagccctctccgttatagctattttgatatatgtcctcgccgtacttgttcctgtttaaatatattacgtttagacccttctatttctacgaaatctaatacgaacgtgacaaaaatgagaaaaaaggaccgcgccctgaatcgtggaaactgaggggtcttttcgtagaatttccttttcttacacgccatctctccccctccggaaacccccagccgcgtcaaaaaagaaaacgaaaaagaaaacgaaaaaactcccggccgctagggttccatcgccgcactcatctctctcgctctctcttgcgcgatgcgtcgcgccgcctagatctcacggagccgtggccgccgcccactcttctcccgttcaatacgcttacatttaagaatttaccacttaattcgtaagccattaagattttaccactaggatagcgaatttcttcatttcataccactcccgtcaaatttacagctcatccatctccttcgttcacactagtgtagggcgccaccgtcaccatcgccgggccctcccttgccaccatggcgcgtttctttcgccttcgtttgtcatccccgccatcgtgctcgaaggccggagctgcactccatgccattgcgctcgggtgagcataccagcgagtgatgatggcggtggccaagttcgagtactgcacgggtgcaacgacaatggcgtggtcggggatggcttcacgccgctgcatctcccctcctcctcgctcctctcccctctctcctctagcacgtgtgggtcctaccacttgagacgaagaactcatagccaaaacttgcttcgcgttcttgaggaggccatgtggatggatgacgtggcaacgaatatttggtttggggaggaggctgaacgccacatcggcgcaatgtgaatgccctaagggtgttcttagcttttcatgtcagcttttgccatcttctatttttgtcctcacatgtttttaaactacataacgtataaaatttagcactaaacaccctaaaattcagaaacaaggatacaatttctccccttccatcattctctctattccccaactaccacaactcaacagcggctggcagcacagcgagctccaacagaggacagcggctccccaacctcctcccaaacagcggctcgaagggcgacagcggcggcgcgagagctcgctgggacccctcctctcctggccggcaacgagcgctcagcgagcgacggcagcagcgtgggagctcgccggggcccctcctctcctggttggcaacgagggctcggagggcaacggcatcaacgtgagagcttccggggcccctccattcccggccagcgacgagggctcagaggacgacggtggcagcgaggatccgaagcggcgtgagagctcgtcggtgccctccacttcctgccggtgatgaggagacagagcgccgagggtgacagtggcggcgcagatccagagcgacagtgactccgacggtggagagagaggtttgtttcgatggtggggaggtggggatgatggtctacagcctggattccatgcttttatctgctttttccgttgagcttctcgtgtctcaagttaggatgtgtttagttccaggggtgtaacgtttttgaagtatacggacacacatttgaagtattaaacgtagactaataacaaaacaaattacagattccgcatgtacattgcgagacgaatttattaagcctaattaatccgtcattagccaatgtttattgtagcatcacattatcaaatcatgtcgcaattaggctcaaaagattcgtctcgtaatttacatgcaaactgtgtaattggttttctttttccacatttaatgcgccgtgcatgtgtccaaacatccgatgtgacgttttggcccaaaatttttgggatctcaacaaggcctagtcccgtattcctcacaaagaaatggtccccactgccacattagcagctgtcctacgtggcgagctgtgccaactcgccacattcctgcactgtgaagggacaacatcacaaaagtcagtcaacttgagaatcatatgaatcattgaatatggtgacagccaaaaatatcatcttgacttgtctagatctgtaggtagcagagagagtagcagatagcctgtgaaagagagcaattgcagagggaggcttgcagctaagaactagtccccatggagcatggcggaatcgctgcttctccccgtggtgtgcggggtgatcggcaaggcgaccgacgtgcttgtccagaaagtcacccgcatgtatggcgtcgacggcgaccgccctaagctagagcggcagctgctggcggacgccgagttgaagagcgagaccaaccccgccatcaagcgttggatgaaagacctcaacgccgccgccgacgaggccgatgacatgctcaacgagttccagtacgaggcgctgcgccgcgaggccatgagcctcgagtcactgggacacaaggtacgaagctgcatgaccccactcgagttccgttttaccatgagcaggaagcttgccaaagtgctcaagaacatcaacgagctggttgaagagatgaacatgtttggcctgttgctgcaagatgagccagtacatcaacttccttactggcagacgtactcagtgctgccatcaaatgaattagatgatatctttggcagagacgacgacaaggaggcggtggtgatcaaactgttgctcgatcagcgagatcagcacaagtgggagaacctcccatcgtggggatgggtggtttaagcaagacaacgctcgccaagatggtctacaatgactacagggttcagaatcacttcgagctaaagatgtggcactgtgtgtcagacaactttgaagttgtttcccttctgaaatccatcattgaattggctacaaataaagcatgccaactgcttgacaacgtcgagttgttgtgaaagaccaagaacagctatagaggggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacatggaaactctctcaccgagcatctcaaaatgattaccaaaaggagcaacctccacccttgcatccatctctctatttatagcctaagacccctaagacattgtctcaaatacccctagggcgaaaccctaactcagaacagatctggtccatccattgttccttctactcaaaggaaaagctccagatgattgccacctcatcgatccgaaccttcacatggtcttcttgctgatgaatccgcgtgctctccgtcttgacgaatccaaacttgccacgttgcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccattgctgcttggacgatgcaggcctgccgagccgagccattcaccatcttgggccacgtggaacggctagattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaaactccccctatgtgccaaactccccctttcaccaagatttaaagcaagttttaattttcaataagtgcaaatttctctccccctttgtcaatgatgctatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaacagagataaatcttgtaaagcatgattgatacaaagtatggacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcactcctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacaagcactagcagcagctacgtactcagcctcagctgttgattgagcaacagaagactgcttacgagaggaccaagagaccaaagaagtgccaagaaaatgacaagtgctagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaagtagaggagggagccgatcatgcttctgtactcgcgctggtcaacttcttcatcgtcctcatcaggaccaagcgatgaagtagttgccatgggagtagcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttgaaaattttggattttcaaaaccaggaggttgtttgacatagacctattcaacaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttggttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctaatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcatcatcatcatctgaatccacatccacaaagatgctttcatctggaacacctgaaatttctggtctagctcctgggctagcctcatcaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcaactccagaagaatcacagaaagattcaaatgcagaatttttgaattcagagccattatcactgcgaatggctcgaagagcaccaggaaactccaaagccaaactacgagcaagagactgaaagaagccaaatgtttcctcctttgattcaagaaaatagacccaagagtagcgagagaaatcattctcaaacaccaagacataccacttccccccaactgactggacccgagcaggaccaaccgtatccatgt

SEQ ID NO: 10533 - DNA, 3634 bp, Oryza sativa
gagaaaaatcatccacaacaaccaagacataccacttccccccaactgactggacccgagcaggaccaaccgtatccatgtgaagcagttgtcccggtccatctgtcataaccattgtaacaggcttgtgggaggaagatgtcattttcccatgacgacatggtgcacacacaagatctttcggaactttcaacttaggcaaaccccgaatcaaatccataccactaatgcgagacaagtggtcaaagccaatatgaccaagacgtcgatgccagaaaaacaaatccctattctctgtggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcatgcgtccactgctcgcatccccaaaagtgatggtctcatcaccggatgcacgagtgagagaagtaaaccacttggcttcaccggtcatgtggcgtgagcaaccggagtccacaagccaagaattacttctccctactccaaaatcctacaagaaggacacagcagatctcgatgattcagtactggggttagtgaaaaatgacttaggaatccagtactgaaccatgcgagaagtacaagcatctttagtgttatgagcagaattatatgcaagatgaccatgtctgttttgccccaaccctgctaggtcacgtcgagggtgcacatctcggcgaggaaagcgagatacacaacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtctctggttttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttataggtatgagttctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaattattcttggtcctaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcctagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttttatctctcacatttttgtaagctcttgagaattttctagcaaaaagagcaagatcatcttcagggatcttctctaattgctcctcagtgactgagtgtaaagcggcaagagagaagccaccatacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgagtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaccttattccacacattatgcccttgcgactggaggtaggcctccattcgtgccttccaaatgacaaaattgtgtccatcgaaaacaaatggtttcgcagagtatttttcctccatagctgcgttcgttgccatggttaggttacaacgaacttaaccgggctctgataccaattgaaagaccaagaacagctatagaggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaa

SEQ ID NO: 10534 - DNA, 8967 bp, Oryza sativa
gcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccattgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacatgttgcaaaaggaactacataaggtcgttggccggagaaggtttctgctcatgctcgacgatgtatggaatgaagaaaagaagaagtgagaggaagacctaaagccactcctgtcttctgttggtggtggtgatggaagtgctatactagtgacagctcggagccaacaagtagcatctataatgggcaccctagaatcccataacctagcttgtctgagtgacgatgattcatgggaactattctcaaagaaagcattcaataaaggcgtacaacagcaagttgaattggtcaccgctggcaaacttattgtcaagaaatgtaaggggcttcctcttgctttgaagacaatgggtgatatgatgagttcaaagcaacaagtcaaggaatgggaaacaattgcaagaagcaatactggggacaatgacaggggtgaagatgatatactacctgtactaaaattgagctacagacacctaccacctgaaatgaagcaatgctttgccttttgttcagttttcccaaaggaccatgagatggacaaagaagtgttgatccaattgtggatggcaaatggtttcattcaggaagacgaaacaatgggtttggaacaaaagggggaatatgttttccgtaatttggtttggagatccttcctccaagacgtgaaacaggaaaggtttttttttccgtttgcaaaatgcatgatttgatgcatgatttagtaaaagatgtggcagatgatagtgtaatttcagaacagttaatcccacaggaagcatataccggacgttgcatatcagcaatgagtcaaacagtgggattgctcaaaacatcatcttgtctccgcactttgataactctgtggttaccagtacatattaataacttaagacagatgtcattaagagatattggtactgacttaagactgatgtcattaagagctttgggtactgtccgtatgcatgattgctcttttcatagccaggtcatcaatccaaagcatctacgatatcttgacctttctgggtctgacatggatgtgctgccaagttcaatatgcacgatgtataacttacaaacactaaggctgaaccgttgcaaaaaactgagatatttactggaaggtatgagaacaatgagcaagctcatccatctttatctttttagctgtccattgaagcggatgccaccaaatattagcctactgaaaaatcttcgcactctaacaacatttattttggacactgaaaaatcttcgcactctaacaacatttattttggacactgaacctggccatggaattgaggagctcaaagacttgaatcaccttgccaataggttggaattgtacaatttgagaaaaataaatagcaggaaaaatggaaaagatgccaatctccatctgaagcaagatctaagtgaactagtactttcttggggtagtagtaaattttgcatgcctttatgctaaacataaagggaaatgctgaacatagccatcattaaatcggacgtgatggctgcgttgctgaaattttgctcagccaactctcagaatttggaaatgctgaacatagcgattattacgttgctgccaaagaaggaggcctctacccttttgaaggattatagacctattagcctcattcacggctttgccaaattggcaacgaaggtcatcgctctgaggctcactccgagaatgggtgagctggtctctcgcactcagacatcgttcatcaaaggccaatctatccatgagaacttcattttcgttcaagggctgacaagataatttcatcgacagaggaaagcaatggttctccttaaacttgacatctcgaaggcctttgattcagtttcatggagcttccttttggatatgttaaaacacagaggttttgggaggagatggagaggttgggtgtcggctcttctcctaactgcagaaacaaggattgacatcaatggcactttaagtgaccccttcaagcctatgagggggctaagacaaggggatccgttatctcctcttctttttgtcctggtgatggatactcttcatgctatgttgcagaaagcaatgtcagccgggttgcttgacaaagttaaccagtggagcagagcaccaaataattctctctatgccgacgacgccgtcatcttctttaaaccggttcgtcatcttctttaaaccaaattttgcatgcctgaaaacaagggatgcaacgaggaagaagtgttggagtcgcttaaacctcatgctaagctcaaaattttggaactacacggatatagtggcctaaagatcccacaatggatggaagacccacaaatgttgcagtgcctaacaactctccacttttccaactgttcaggatgtaaggatctatcgactgtgtggtttttggtctcgattgagtgtatgtctttatctaaaatggagaatctaaccacattgtttatgaatgtcgttggtgtgaaagccgaaggatactacatccctctacaaattttcccaaggttaaaggatatgacactaagccagttatcgaacttggagaaatggacagaaagtactgctggagaggccaatactagcttagttacgtttccgaagctcgcaacgctatgtatctctgattgtccaaaacttgcaagtgttccagattgctcagttctaaaagaattgaaaacatatggatattgcagtcttgcaatgagcttacttgcacatctaaccactttgtctgaactcatttaccgggaaaatgagtctatgagaatgtcgttgggctcatggccatctctcacgaaactacatattagttcgtcatataaccaaatggccactctggaggtcgacacaaaccaaggcccactagaaaaccttaggattttgaggctatatggcctcaacttcttcacagctgcatccggtttatccaaaatgcatcttgggctatggaaatgctttgcctttgtggaggatttgtgtattggtgcatgcaacgaccttgtgcattggccaatggaggagctcatgagcttgattcaccttcgatccctgtctattgaacactgtgataaccttgaaggaaagggttcatcatcggaggaaatcatgccactctactatctagagaagtttcacatcaaagactgcaaaagtctattggatattccgacgatgcctgcatcccttgaggagctgtgtctgctactttgccccagattagtggcactgccttcgaaccttggaaatttggccaggctaaagactatgagttttgagcactgtcatgacctgaaagagttgcctgatgggatggatggccttatttcccttgaagaattgaagattatgggggtgcccagagatagagagatttccacagggtctcctccatcagattccgacccttcgatacctaatggtagcaggctgccctagcttggaaagacggtgcagagaaggtggcgagtattttgatctgatctcctccattccacgtatagttgttccagtagcaaaacagaagtgacggaatcaacatcaagcctgaagaagcttgtaaaggggctcctcccctcctgctcactctcaaagtgaggtgtgtatgctttgctcttccattatttcactctgccattattcacaagctaattaattaattacataagctaagcgccgggagtttgctttggaattgccggaaaaattggatcctttagagtagtaatattttttcaggaatacgcaaggagcgcatcttttccattaagagaaataaaagttatttacatttgaaagaaaaaacagcatgggactgatacaggacattgacagttaatcctaggtctatctatcgcactgagtttggcaaccaaactccagccgagtttagttccaaaatttttcttcaaacttccaatttttctattacatcaaaactttcttacacacacaaactttcaacttttctgtcacatcgttccaatttcaatcaaactttcaattttagcgtgaactaaacacaccctccctcctgaattgcagcgcaggaatcgctgggtttgctttatgccaaagagaagcctcgtcagccatccctttggccacatctacccaagatctgcactgctgattgagagtagtagtattctttagagtagtagtattcacgtaaactttgtgacttaggcgcagtctccatgcctctggtgatctttgtattctttttctgcagcgaacatatagcttgttcttgaagatgaacagcatcaggaggatttctgggatgagcaaaagtctaaggtcccctctgcaatttataaagagaaatatgagagcatagttttcttcagggagctgtaaaagcgtgacaaagataatatcgattaacctcctggaacacaagtactctgttgagtttgatgctatccaaggtgagatctttgcctcttgcatttctatttttcctacacatgttgtcagaaatgttatggacatattcacaatctcttaatatgtctaggcgtgattcaaagatggataaactcactgcagtttttgtattcctctcaatctgaatctgtgatgggtggccacaccagcaaagccccatcagggaaggaggatttcctcataacagtggatgagaagcatgattatgacaggtaggttataattcacttgttctagatcatatacctgtgttgttggaactatttttgagaagcacagctcgtttcaggctgaagacgcctccagttacaccactgtttctttccatagagacggaaaccaaccaactcctctcaaatgattttccagaagaagcaacctatccctcaaccagttaaaccttcagcttccagggtatactatctgctctgtattatcctacatctaaaaaaaaaatcccagatgcagcttttctcctcaactgaaaaccacatttctagaacctgtttctttttttttttttttttgccgggtcggcgaaggagccgaccaaatttcattaagattgaaaggggaaagttatagattttacacaacattaaactgtcgagccggggactaacacccctggagagcagaaaccgggggggaggggggggtgggtggcgtttcctactcctcacaacattgaaaaacacccgcagctctccaaactgcaacttcctctttaatatctgccacaaggtgcttagccgtcttgcttctttggtcgaaaactctgatattgcgttccttccaaattagccagctcaccaacatgaaaaaggtgtcaaaagcagtcatgtagcgcgtctgaaatagaacttgtttcttcatcgaagagcttatcttgatcttgactttatccatgagagctttctgggaggacaaaggcaacaaaaaaaaatcggttacccacacctgactcatcatcaaagaacttgttcagacgggctgcaccatccatctccactgagaataaccaaccttgcacaattgaaaagagatcaacttacgcaggcataatgagcaggcaaacctgttgctgcaactgcacctacagtttctacagcaagtaggaatgcaaacaagaaacactctgacagatgctacgtacgcaagccaaggcagtaccacaagtggactcaagaatgtgacgaaacctgaactcccttacaatgcaccgaagaatctgaccacaacaagatctatatttacatgccgtgcgccagcattggatgtaggtgagaaaatagaaaatggcaggataagaagaaaatcatgcccacctgttgcaacaatagggaccaaggagcagagattagatggcaagaagaaaggcctaccagctaaagtgaaggctgtgagcagtagcaatgagtctacttctaataatggtggccgttctggtgaggccacaacaatgaacggaacgagaaaaacagatgggaagaaagagcacatgtcaaagcatggaaaatcggctgaagaagtgaacatgtcattttatacaagtttgtttttacagtttctagtgttctctgcttcgtactcttctttttctaatgattcaaaggacgaaactgttttgcatgatccgaaaaacatacatgttgtaaccaattaactatccggtgcagatgtgacttcaaatgaggaacttatgtgttttatgggttcgaagtagaaggcttttacctgtgctattaggtatctaggcaaaatgaacagacctctttttcatctacatattctagtaggtaagatttgttcacattgctagcaccattgctgtatcagtatacatgcatgtaccagtaatacttctatttgaagaatcttgccacaaaacgaaccaacacatggagtatctagctgtaatatgaatggtaatcggtttggagcctgatgcaaggatcagatttgcaagagaaaacagcacagcaggctatcaccagcatggccaccaccagggttcacaattccgataccaccttccatgccaaacgctggcagcacgttggttttcacgaaatccgattgaaaaccaacaaattcatatcggtcggtctttgtgtcaaaaatcgattggctttaccaaaatttcgaatggaaacgttgaaattcttatcgacagttggaagtgaaaacatcaatctgtttgtatcgaaaaccgattgattttgtcaagaaaccaatgtgaaatttcaaaaaaaaattgtttactaaaaatgtggaaaatagtgaaaaaaaaaagctagaaaattgggaaaatttctaaaagttttggcatgccatttctataaatttgacccattgcttgtttctgatcacaaataatgaaaacaaatgtttaatcttctatgtaaagataaataaatatatgcataggattgtaggaatgctaaccttactaagctagtctaacaagttttttttctggagtattctgttattaaatgaaatgccaacaaaccaagctaacatgtatttccaaacgaaaatgttataaagggaaatgcatgcacctagatataacatagcaaaggacgatggcaccgaaaacctagaatgaactaagtaaagtgcgggaacagacaaaggtattggacctgtagacttttttttttttttttgctagtagtagctcaaactaggtggaaggtttggatatatttctaaattcctcagcatgaactttaattttgaagccattgcctctttataatggtaaacagcattcccttgacagttgattggtcaccctctcatgatatgttattagcgggatgtcacgatggaacggtaccttttccttacccaacaaaattattttcttatcttaaatcatgtgacctttgagtctttcaagttgctgttctgaaagttctgtgattgacttttttatattccaggttgctttagggtgtgtttagttcacgttaaaattgaaagtttgattgaaattgaaacgatgtgacgtaaaagttgaaagtttgtgtgtgtatgaaagttttgatgtgatggaaaagttggaagtttgaagaactgctttaccgacaacatgtctgactgtagaactgctttactggtttaaaagcagccagttactggagttcccaaatcttcgcttttcttattctgttctgttttcaaacaaaactaaatcatgtgttctgttgataaacaggttcaaaaccttttatgtgtgtaactgctgaatctgctcccatcagaaccgtgtcgtgggcaccatctgtgaggtagccagttgtactgttactctggtctattccaaaagataatttttgagttttgactcttgtcattctatcagtaaggaaaacgtgaatacctttgtcactggtggagaggatggtctgaaattcggggatttaaggtaggtgttggccttgttgtgaactgaagcaatgtttaaaacatctttcgaactactctcttatcctgcatgaatttctaatattatgtatgggtcctcagaggtctgaacattgagggtagtctctccccctt

SEQ ID NO: 10535 - DNA, 24734 bp, Oryza sativa
cagtaatgtatagactacagattaaaagttttctttttcattactacttttcttgcatcatcacaaaaacaaaatcttggacaatgctgaactgttttcagaaaatgcacaagaaaataagggaaatgcatttgcataagccatcaagcaattgttagatcaaaacctcttccattcaataagcaaaacacatgaattgagtgatgatgttaaacaaaaattggggatataaaccagatagatcatctcatcagtgcactaccttgaattcattgagaacaaattgctgccttgttttgaacctctagtcgaccagaaaaacaaaaatgtgaaaatgaacaggaaagcagacagatggatattcagacttcccaagtttccatacttatcaaacgatgatgtatacatgaagcacagcaggtttctatgatctgaaattccgggttttcagtttttacttgtatgcatcatgaaatttcataatttggctcaccacaataaaaaaattattcaaaaaaatatctgttgagatttcatggaaaattgggactagggtacaagaatgaggtcgatgaggtctggtagctaccataccactagggctagtccataaatttaggggaaagtaatcctaaaatatatggaaaggacttcaaagcttgaacatattcctctacttgagcttctatacaagtacacataaactcataccctaagcactaggaaacctagcattttaagcatgaatatgtttgacaacacaccagggcaatatattacattggtaacatcacatgataaaggtaaatttaattactgacctacacatcatacaagcaaaagtcaagcagataaaggtaacagtatcagtatgccataggtaggccagaattgtaagcatgaatatgtttgataacacaccaggagaacactcaattacatcaataactccagatgggtgcagtctgctaaatcatgcatacataaaaagggctgttgcataaacgtcaatgcgtgcatgagacagcataaacatttgggaaatagcaaaggaacaggtgtttgttgaagaatggacaacacatagagaacacatgggatcaatatttgaagaagctgaggcttagcaacaaagtgggatcatcgaggtattactcaatactcaccgtctgatcgtatgcatcaatgccctcagtatcaagaagcaaaagactatattcagttccatcaagtgcagttctttttattggggcactccacatccaaaggcccttggtgcagggccgatgggtgcttgctacttgaaatccgctgcttcttcctagaagctgtcaaaaacacagaaatagagcagattactccttgacaagataattagctggtatataaagtactccgtaatcaaaatcttgatatatatgaatttgctaacgaggcttcaaatgcaagaaattgagatgtcaaaaacagactcttctccaaactacaaagtctaatagaaatacttttacaggtcatgctctgataggagtaaaaggacatctgcagtcatttcacacccaaaaaaaatgaaacttatggtaaaccttgttagcatacatcaattccacaaaatagaaaatataccacacttagtccatcttcctttccgattttattttcaagacatcataatccttaataagtcattatataaataccaaaggatgtttcatggtccactagaccagaatcaatgttaaggtctaacaaatataaaatatcctcaggagaatcttgtaagtgtcatcagtcatccataaattcatcgaatcaatgaccaaagtaaccgggcagcaatacgccaatatggtagtacacacaatgcataagaaaagttggccctctttgattatttaggaaagttgcatgccttaatacacccaacctttatcacggttctgaaagaatgtatagcggaaagaagaaaaaacagggaccaaaactgattcccgcaggtggaaagtttattgagaagaaaaaacacggtaagcaaaagttttacttttgcaatgcaatttctgcacgagacatacaacccacgaaatgttgtcttttcttcctatttctaaatgaaatgtttacgccgccaaccaagaccccaaccttccctaccagtgtcccctacagtgcctcgaactgatatttatttcttccagattcttatcaggatcctactagtgttccagtgccgatccacaggacagatttgttcaaccattggtaaaaagaagaggggggcgagagcgaacctggttaaggatgaagctcttgccctgcctggcgcggccgcagacggagacgaccccgacggggcccttgacgagctgcagcgcggccaccgcctccgggtccatccggaacctcccccgctcgtcgcagtacaccagccgcagcggccgcccacccccaccccccgcgaacggcgaccgcggggaggacgccgacgacgacggggtccacggcgagccgtggcccggcgacgcctcgtccccgccgcggcggccccggtcccggtccttggacgcggagccgcgtagccccagcatctgcatcatcgcggccggccgcggggagagagagagagaggggaatggaatggatcctagggtttggggctcgcgagggtttgggggtgttgggggattcaggggatggtcgcgcttccccaggaagggaggaggagacgagagcttcggtggccggtggaggttgtgggctgcgcctttccttttcgtgaggacggttgccttttttttcgctgtctttggttggaggtggggcccacttgacgcgtgtgaggagaaagttttggatatctttcatttggtatcaatgctctgtgatctgctcaactgttcccagcatcaatcggctgagcgttaatgggagctaaaatttgccaggattggattaaggtccacacctctctcataaaagcacagtcccataaaaggtgatttgtgtcctcgaaagcacatgtgtagaggcaacaaatccagttgcaaggccaatgccttcgcagcagattttgagctgtcaacgttttttatggagaatgagccagccaaaagacctcaattttggttcagctggggccgaccagagggaattaaaatcgacacgtgtgtaggatctttcgaattaataagagtaagcactcttacttgtgtagcaacccacagtagtccaattctaggaaatattatcagaaccttgtggtagttgaacttcttgccgtaaacctcccagctgcactaggtcattgatttcttcaattgatgtaagatatctaaaagaggtaatccagttgttggaagagagttccatcaacacacctttgttttcttttagccagacgaaagcaaagaggtgctatgtctttcggacatttaccttggagccaatgatcgtgccagaaattcatttttttaccatctcccaatacgtttgtggttgctgcttggaacaaccgtctatcagtatcatcacaaggcactttcatgccaacccaaggtttatcctcatctttccactggaaccacaaccagcgtagacgaagaatcctggaaaatctttcaagatcagggaccccaagtcctcctattcttttcggtctgcaaactgttttccaattgaccaagcagctgccaggattagtgtgatctgggtcttcacctttccaaagaaaggaccttcgaaagcggtcgatcctcttgaaaacccatttgggcatgtgcagagatgaaaggtggtgaattggcatggagctaaggaccgtttttaccaacgtctcgcgccccgaagaagtgaagaatcgacctttccaagtgggaagcctttcccctattttttcaatgagggggagaaaatcaattttccttaattttcgataatgaagtggaaggccaagatatttgcaggggaaagatttaacgatgccggggaaagcttgcagcaaagaagcaaggtctacctcttcacacctaatagggaaaatctctgtcttggcaccgtttgtatgcagaccggacactggcgaaaacaattaacagctaggtaaaaatgttaagctcagaaatgttcggctttgcaaacactgcaacgtcatcggcatataacgagcatcgaaatctgacccgatttctatcaatcggggaaagtatggaggtattttcggctgcttatagaatccgatgaaaaggttccattgcaaggataaaaagcattggcgataacgggtcaccttggcgcaggcctcttgcatggaagatctgttgtcccggcgcgccattgacaagaatttgggaagacgtcgcaacaagattcgagatccagttgagccattgagtgcagaaaccaaattgttgaaggacatcaaggaggtaaggccaacataccgtgtcgaacgccttcgcaatatccactttgatgaacaggctttgctttttagtcctatgaaggagctgaaccatattttggacaaaaagaaaattgtcatggatggcccttttacgaacaaacgcactttgattttgcgagactaactcattgagtctcggtgccagccgattggccataactttggtaatgatttttttgaagctgtgaacaaactgctagcatcatcttttttttgggaggagacataaaagccgaattcaaatctgcaaggtgtgaggtattaaggttcatgaaagaagagatggctgccagcaaatcccctttgattatctcccaagctgacttatagaaggcttcgataaaaccatccggtccaggtgctttttctgatggcatctcgaaaattgtgttcctgagttcttcagaaatgtctccttcaagatcagccaagtcccgaaggtatttgtagtgagttccagttcaaccgcacacttctttggaaattggtacccaatctttctttgtagaaacggtaaagttcctcttctttatcttggtttgtgacagcaattccggttggggtctgtaaagactgaatgaaattctttcttctccttgagttggcttttaggtagaaaaattttgaattaacatcaccctccttgatccaggtgagtcgagaccgctgtctgatcttaattttgttaagcactgcaagccctagcactcgagatttcaggttagagattaacagacgttccttgtcagatagacttcttgattcttgtgctacgtcaagctgaaaaatgactacagtcgccaccgcaaattgcagcgcaatgtcccccacctgacttttgttccacctcttaagatcacaagctagtcgacaaagcttgatcctgaaaactgcaagagggttggtggcaaagattgatctgtgccaggattcttgaactacttccaaaaaacctggaattttcaaccaaaaggcttcaaaacggaattgaggtggtttgcttcttttctcttttccaacaaggaaaagaggtgcgtggtctgaacatgtagaggagagggggaaaaggtgtgcttctccaaacatgaaatcccaatcagttgtgataaacgctcggtcgatttttgtttgtgttggatttgtcccatctcccgcccacgtgaagcgacgaccaggaaggtgcagctctttcacttggattttatccaggagaccactaaaacgttgtatcatccttctattgagacgatcattatttttgtcagaaattttgtagataaaattgaaatctccgatcaccatccaagctggtttcatggtgggttgaagtgtctctagttcagccaggaattcaattttttcagcttcgagttgagggccatatacaactgtgatcgaccattgaagcccttcttcgcgcatggttatagtagcagatacagagtattgactgagaaagacatcagagagatagaaataattttcatcacaggcaagcagtattccacctctttgccatcagccggcagtgcagcatattgctatgcaaatctctgtccaagagagttgaggaggatttgggaagagatagctgaaagttttgtctcttgcagacagacaatcgacgcgccgtattgttgaatgagaagttttatagcatcttgtttggctctggcatttagacctctaacattccaattaaagtggaaaacattttcttgagacatggaaacacagatcgactaagatacaaactagcaatccccagttatagccgttcttgccgaaacacaacccagatagacagggagaaacacaacaagaaggggtggagagctgcatacagaggtgatgctgagttgcagacacagtttctaccaacagacacaagacactcatactgaagcaagtccgggacagctgattgcgaagtgagctcgggaaagacttcattaaattgcttggcgaccttgcagcacagctccggtcatgcttataccggcgccaccgcagacttcttggttgtggccttcaggcgaatgctcttgcagccacccttctcgaccaaatgcgcgattatctgcagagacaccagagagagtggtttcttgtacaactgcaagtaaattttcttgatgttatcatcaaaggcagatttatcatcaaacaacccaaaattttttgacaggatttcctgggcaaatgtttcaagttttgcacccgtgcgccgtttacaaagcaaatgctcacttgctacgctcacatgctttgccttctccgaggtctccgatccgagaccacgccttccttcaagctgacacttgcttctcctcgcaggatgatgatgtgctcagcttgctagagcggcaccttgatcccttgattcatgaggcttctgtgcagcactccatctactcgcctgactttgactcccagcgtatttcctcccctgttttcactacttcctttgcagctcagggaggctctgatgctgatcagggggcgaagtaagttgaggcttttgtcaacaacataacaactacaatccagccgccgctccttcccaccccagcaaccaagttcgtcgccctgcccgtaataaggtggtaatcccgattctttctccggtacagcttatcaatttatcatcctggttttttggctcctctattcctgtcatttgacaatgatggaaaaggtgacaagagtgagataatggaagagcaaagcgtacgcacctcattcgagagtcaagaaagaggggaggagcctctttacaagctgcttgttcttgttacatcttgattcggtctgttctgtttctgattcgggccattcggccagttctgtttctggttttgaaatgtctatgtgttggacggacgagaccagatcaaaatactcactgccttctctgcacagtctttgcaagctagggcatccccatagaagtagctctttgagtgtggggagctgctgtaggagaccctacagaaatttctctatctctgggcagttccaaatcttcaattcttcaagtgaaatgaggccatccatcccatcaggcaactctttcaggtcataacagtgctgcaaactcataatctttagcctggccaaatttccaagcttcgaaggaagcgccaccaatcttgggcaatatactagacatagcttttcgagggatgcaggcagcatcgggatatgtaattgaccatcctccgatgatgaaccctttccctcaaggttacgacaagtttcaatagacagggatcgaaggtgaatcaagctcatgagctcctctattggccagcgcacaaggccgtcgcatccactaatagacaagtcctccacaaaggcaaagcatttacatagcccaagatgtatttttgagaaaccagatacatctgtgaagcagttgaggcgatatagcgttaaactccgaaggttttctagtgggccttggtttgtaccgacctccagagtggacattttgttatatgacgaactaacatctagtttcgtgagagatggccatgagcccaacgacattctcacacgctcattgtcctcataaatgagttcagacaaagttgttagatgtgcaagtgagctcattgcaagactgcaacatctagctgagttcaattcttttagaactgggcaatctggaacacttgcaagttttggacaatcgaagatatatagctttgcgagctccggaaacgtaaccaaaatagtatcggcctcgccaacagtattttctgtctatttctccaagtttgataactggcatagagtcatatcctttaaccttgggaaaatttgcagagggatgtagtatcattcggctttcacaccagcgacattcataaacaatgtggttaggtttttcattttagataagaacagaccctcaagcgagaccaaaaaccacacagtcgatagatccttacatcctggacagttgaaaatgtggagatttgttaggcactgcaacaactgtgggtctttcatccattgtgggatctttaggccactatatccgtgtagttccaaaattttgagcttagcgtgaggtttaagagactccaacacttcttcctcgttgcatcccttgttttcaggcatgcaaaatatactaccaccctaagaaagtactagttcacttagattttgcttcagatggagattggcatcttttccattttccctgctatttattttactcaaattgtacagttccaacctgtttttgctgggtcggcggaaggaagtcgaccaaatttcattaagataaaagagggtaatacaatatacacaacattatactgtcgagtcgagggaaacctcgaaaaagaacaggaaaactatttacagggggccaaaaaacatgctgctactccccgcaagaaaaaattccggccgctctccagatcaggacctcctctttgatgtctgccaccaagtgttctaccacccttgatctgtcataaaaaatccttgcgtttctttctttccaaagcttccagcagaccaacatgaacagagaatcggaggcggccctgtaccttgaccgaaaacagagacgcacctgcagccaccattctgcaagctgtagaccgagctgatcaggaaggggaaacgccacattcagctaagttctcaactgatgccacactctgttagtgaaagagcattttgtaaacagatggatgcagtcttccggcgcagctcgacacagtgtacatgtcgtatcatgtggccagcctcgtttgctgaggttgacagccgtaagacaccggcccttcgcagctaaccaaaggaagaacctcactctcgccggcgctttggtcttccaaatcagctcaccgtgggggcacttcaccgaagggtagaagaagaactcatatgcagaggaaaccgagaaggcgccgcttgctgtaaacctccataaaaccgaatctgactgcccgtcttgaagagacacttgttgcagctcatcctataaattcagatagtcagcaagggccctattggaaatggacccctgcaagtctctaacccacctgttgttcgtcagtccttgagccactgtgatcttcgttcgaccgacaaagcagaaaatgataggccaattatttacaatactttccccacgaggcagccagttacctctccaaaaattgatgcgacggccatctcctaccatgtgctgtgcaatcgagctgaaaatgtcgcggacatccttatcagattcccaattagccattgtccatggcctatcttcatgttcaagcctgttaaactcccatttcagtcgtaaaaccttcccgaaaagctcaatatccctgattcccaaaccaccaaattcaactggcatactgacggctctccaagcaactaggcaatgaccccattaacttcttcttgacctttccacaagaaacccctgcagcggcgttcgatgtccttgatggcccattttggcagctgcatcacagagagaaagtgaaccggaatggccatcaaaattgatttgatcagacagagccgcccgtcaggtgaaaggaactttgatttccagcctgccacctttttagccaagcgatcaaaaagaggttgtaactctgcttttgttggtttcctcacggagagcggaagacccaaatagaggattggaaggttctgaagtttgcaatgtaaaatatcctgaaccaaggagctttgttcctctgtgtagcgaattggtgaaactgcactcttggagaagttgggaagaagatcagtggcttcactaaagagatcaagcacggctttgactagcatggcctcatgacgaaccggtttaaagaagatgactgcgtcatcggcatagagcgaattatttggtgctctgctccggtggttaactttatcaagcaacccggctgacattgctttctacaacatagcatgaagagtatccatcaccaggacaaaaggaagaggagataacggatccccttgtcttagccccctcataggcttgaaggggtcacttaaagtgccattgatgtcaatctgaagttgtaatctgaacgagctgattttccgctgtccccatttaccaagtgccttgcttaatcttgccatcttcacatacaaaatacagaaaggatcagagctatcgacctcactcccccaagactcctgcactacgtcattgaaatcatcaagctttgtccaaaaggtttcaaatttgaaccttttttttgcttagggactcggttaccccaggttaaaagaagaggacagtggtctgaacctgaagaacttagagcctgcagatgagcttcagggaagagatcctcccactgagtggaaatgaacaatttgtcgagtttcaccaaagttgggattgcctgctcactgctccaagtatatcttctaccaaaaagatacatctcctttaattctagatcgttcaccttactgcgaaaagcattcatcaagcgccgattgatccttgtgttattcttgtcttcggctgctgtaatgaggttgaaatcaccggctatcatccattcccccaaacaacaattcttgatgacagacaattcctccgaaaacaacagcttctcatcatccctttgagggccatacaccgaggtcacagcccaggatctccctccctggcgccaatccagattaactgtcaccgaccattgtccaacatggacaagagtgccctggaatagatcccccttccacgccacaatgattccacctctagtttgaagagcaggaagaaattcaaaacgatcaaaatcagggccgcaaagttcaaagacagtgacacgatcaacaacttctaacttagattcttggaaacacacaaccaacgcattggaggaaacaacagactccttcaccagggagcacttcacagcgttgtttagccctcttacattccatactagaagattgaaactcactcctgacattacaacaaccagacacccccagcccccggctaacacagcatacaaaatcaagcaggagaagcaactgccaaaggtgccacatccgctagcgcctggaactccggctccgccagttcaagatgaagcagctccgccaaggcctcaaaatggtgaggcggcagcggttcgtcgaagagttgaacatattcctccatcgcctcatcgtttgcttcctcttcttcttcaatgattcccagattcttcatagtcacccgctgtgccttggagatggagtggtgtcgggcgcctgagccttgcagagccagccgtgggcttctccaaggcttgaaatcaactgggatcaccgggcggcatctgctcttggtgattgggacggaggcaggcggcttgctgaggacggacgatgaggacggcgtggagatagcgtcgacgaagatgttgacttgtacgcacatgttctcatcggccgcaacgaggattgcttcctgggccgctgcggctgcgctctgcacttcctgggttgccgacacagcgatctgagttggcaacatgcccaatttagagccggcctcctttcgtcgagagtagacacggtcaaaaggcaccacctgttcctgggctacttgaggaattgccaaatacaacccacggacgacttcagtaggagccggacctccagctcgaaaatgttcccccgctgagttcccaccttgggggctgctgccttcaaccgcccctattaatggaggatccaaacagaggtcgtcgaagcaaaggcgtctagcagggagcggtgtggtctgcagcgaccagcaggaagcaggcgccgaggctggccttggactgctctcttcgtcttgggagttgcgaccgtgaaccttgtccacagtgcaatggtgtgccacaggagaggttgacctcgtgacctctctgtaccgtgggccaccgtcatgtttctcgtccgccagcatcggcgaactgcaccgtgaacctccgccttgctcctcgaccgccaacacgaacgagactgtcggggcgtgtacctcgaccccgccgcaccatcctccgccgccttgctcttggtccgtcagacgcagcgaatcggagacaacaggcgagcacctcgttggcaacatgagctcagcaacaggggatcatatcgcccctgcacccggtacagcaagctcgaacacacgaggtagggacggcgagatcacctcgacagtgtcgaccaccacttcgggcgagaccagcaccatcacctgagtcaacggcgagaattgttaaacgtcgttgacttgcgccacctgaagcgacgcgttgatcgtctcagctgaggagagaaccagaccccataggacgacggcaagcagcgccaacctcaggggtaaccgaagcagccacaccaacagccgtcgccgctacctcgaaaccctgcgttaccggcacttgtgtgcccagctccctcgtcccgacgacagcagcagcgtctggagaagacgggagcagatcctcccccgtagccgacgaaccgaaacgaacgatggccgacacagcttcctccgtgttgaaaagacggactggttgctgtatcaccgacggcaggagatcgaacgcttggcattccaaacccccggctgaacctgatgctcctccatagcgagtgctgcctccccggtccgatggccacagacctgcgctgttgaaccacttagcccagcagtcgaaggtgttgcgccttgtcacatcatcgtcaccatcatcgttgtagaatttatcaggggcatgcagcagcatgggatcgttcacctcttcaacgtggaggaagacgccatacagtaaaagagggccgtgctctaggcgctcgaggaggagcagagctcgaagacgacttcctccaggagccgcccgcccctatcttcttaggcacctccacctgaagccgttgaggaagcttgttaggattcttgaaccaggcgaagaggcccagacatctggtgtcgttggcagggatgctctcgatgagctccccctcgagctcgttgacaaggttgcgcaccacttcgcgctcccacaggtgagcagggagcccatcgagcgaaatcttggtgaagaacttcaagtccgagctgtctgcccaactccggcggctccacagcttgaaggacgtgggaacccccttcacgaaaatctcatgagagcaatggagaacaaggttccgatcttgcagcatgcggaacaacaccagaaaatcctccgtatgtgtcacgtcgacacggacgttgctctcgttgatgccggtgtgctggacgatggcttctaacatctcccccggtgagaccgatggtcttgtcttcagaaccatggccaacagcgagtgctggttgagccaagcttcattgtgctccatgcccaccgtccaggacagcacgcaacggccagtccccagccgcagctccggctcgccgactcgaaaaccctccatgtaggcgtgctccctagccgcgcagatttgaaaacctgccatctccttggaagacttgacgacgtcccgcggatgagcttcttcctcagctcgcccaaccactctgtagtcggcaggcggagcaggccgggacgcgtgcgacccgaagcagcggacggggatggcggacgctggcgagaagtaggagcagctgtatgcggtgctggacgagcagcaggacatggcgtcggctgaacggggcgagcagcagggtgcacgcgagctagagaagcgagggaagcaggctgagcaactgagcacgggcgagttgaagagacttcgtcatgctcggtgcaaaaactcgcaagatggcccgaaaaccaacaacggaagcaacgaatctggccggtacactgcgccttctgatgccctaggccaaggcatttgaaacacctccctgcaaccactaggggatatccctcaccgccttgaatgctgatggacgagtggttgggcgccggtaggtcgccattgaatgaactcctttcctccttctcacctctatccaagccgcctccttctcagccttacctaacgtgtggtccccaatccccaccacgatgtcgcgccaggaaccaaactggggtttggaatgtggccgtcggacaccggagtggccgtccaccgggcggtgagggcgctccctcacgcgctcgctccccagccattttccccctctcccctatcagagaactctctgagtagcccaaccgaccggttccagcttggccgtagctctccagttccaatctgttggcaaggtgattcaagtccttgagctcctcgattccacggccaggttcagtgtccaaaacaaatgttgttagagtgcgaagatttttcagtaggctaatatttggtggcatcctcttcaatggacatctaagaagataaagatggatgagcttgctcattgttctcataccttccggtaaatatgtcagaagtaggcaatcgttgagccttagtgtttgtaagttatacatcgtgcatattgaacttggcagcacatccatctaagacctagaaaggtcaagatatcgtagatgctttggattgatcacctggctatgagaagggcaagcccgaatacagacaatacccaaagcacttaatgacataagtctcaagtcagtaccaaaatctcttaatgacatctgtcttaagtcattaatatgtactagtaaccatgcagttatcaaagtgtggatagaagatgatattttgagcaatcccactgttagactcatttcattatcataggaaaattcggtatatcatcttttgctaagtcatgcatcaaatcatgagttttgcaacaaattatagactcatcagcagtgaaagaaaatgtcttgatcggtttcacgtcttggaggaaggatctccaaaccaaattacagaaaacatattcccccttttgttccaaacccattgtttcatcttcctgaatgaaaccatttgccatccacagttggatcaacacttctttgtccatctcatggtcctttgggaaaactgaacaaaaggcaaagcattcttcattttaggtaataagtgtctgtagctcaattttagtataggtatatcatcttcgcccctgtcattgtcccctaattgcttcttgcaattgtttctcattccttgacttgttgctttgaactcatcataccacccattgtcttcaaagcaagaggaagccccttacatttcttgacaataagtttgccagcggttaccaattcagcttgctgttgtacctctttactgaatgctttctttgagaataattcccatgaatcatcatcactcagacatgctgggttatggtattctagggtgcccattatagatgctactcgctggctctgagttgtcactagtataacacttccatcaccaccaccaacagaagacaggagtggcttcaggtcttcctcccacttcttcttttcttcattccatacatcgtccagcacgagcagaaaccttctccggccaacggccttctgtagttccttttgcaacaactggacggtttcaggcagttagcatgctttgtttgtagccaattcaatgatggatttcagaagggaaacaacttcaaagttgtctgacgcacagtgccacatctttagctcgaagtgattctaaaccctgtagtcattgtagaccatcttggcaagcgatgtcttgcctaaaccccccatccccacaattgggcccacttgtgctgatctcgctgattgagcaacagtttgatcaccactacctccttgtcgtcgtctctgccaaagatatcatctaattcatttgatggcagcactgagtacgtctgccggtaagaaagttgttgtggctcatctcgcagcaacaggccaaacgtgttcatctcttcaaccagctcgttgatcttcttgagcactttggcaagcttccttctcatggtaaaatggaactctaggggggtcatgtagctccgtaccttgtgccctagcgacttgaggctcatggcctcgcggtgcagcacctcgtactggaactcatcgaggacgtcatcggcctcgtcatcggcggtgttgaggtccttcatccagcgcttgatggcggggttggtctcgctcttcgactcagcgtcggccaacaggcgctcgacggccagcagctgccgctccagcttgcggcggtcgccgtcgacgccatacatgcgggtgactttctggacaagcgcgtcggtcgccttgccgatcaccccgtgcactacggggagaagcagcgattctgccatacaattgctctctttcacaggctgtctgctactctctctgctacctattgatgatacacccaagaagcaaagcaaggaggctatgagtcctctgctctggcctcatccaatctaaatcgtagcacaagtcaagatgatatttttggctgtcaccgccttcaatgattcatatgattctcaagttgactgacttttgtgatgttgtcccttcaggccttcacggtgcaggaacgtggcatctcgccacgaaggacagctgctaacgtggcagtgggggaccatttctttgtgaggaacacgggactaaggccttgtttagatcccaaaaatttttagctaaaaacgtcacatcggatgttatgacacatgcatagagcattaaatatgaaaaaaaaaccaattatacagtttgcatgtaaattacgagacgaatttttttagcctaattgcgacatgatttgacaatgtgatactaagtaaacatttgctaacgatggattacttaggcttaataaattcgtctcgcagtttacaggcggaatctgtaatttgttttgttattagtctacgtttaatacttcaaatgtgtttccttatacttcaaaaactttacatccctagaactaaacacaccctaacttaagacatgagaagctcaacggaaaaagcagataaaagcatggaatccaggctgtagaccatcacccccacctccccaccatcgaaacaaacctctctctccaccgtcggggtcaccgtcgctctggatccgtgccgccaccgtcgccctcggcgctccgtctccttgtcgccggccggaagtggagggcgccgacgagctctcacgccggatcctcgctgccaccgtcgtcctccgagccctcgttgctggctgggagtggagggccccagaagctctcgcgctgctgccgtcgccctccgagccctcgttgcctcccgggagaggaggggccccgatgagctcccgcgccgccgccgtcgcccgtcgagcgctcgtcgccggcaaggagaggaggggtctcggcgagttcttgcgcctccgccgtcgccctccgagccgctgtttgggaggaggttggggagccgccgtcctttgttggagctcgctgtgctgccagccgtcatcgagttgtggtggttggggaatagagagaatgatggaaggggagaaattgtatccttgtttctgaaattgagggtgtttagtgctaaattttatacgttatgtagtttaaaaacatgtgaggactaaaatagaagatggcaaaagctgacatgaaaagctaagaacacccttagggcgttcacaatgcgccgatgtggcgttcagcctccctccccaaaaccaaatatttgttgccacatcgtccatccgcgtggcctcctcaagaacgcggagtaagttttggctacgagttcctcatctcaggcggcgggacccacacgtaccagaggagagaggggagaggagcgatgatgagggaagatgcagtggccagagtgaggaggggagatgcagcggcgtgaagccatccccaaccatgccactgtcgtcgcacgcgtgcagtactcgaactcggccactgccatcatcactcggtggtatgctcacccgagcgcaatggcatggagtgcagctccggcctccgggcacgatggcggggatgacaaacaaaggcgaaagacgtgcgccatggcggcaagggagggcctggagatggagacggcggcgccctgcattggtgtaaacggaaggagacgaatgagctgtaaatttgacgggagtaggggtgaaaacggtacggaatatttccggattccgggtaggttttcgaaaacggaatcggccgatcggaatttttcagaaacggaaacgaatacgaaaatattttctcggaaacggaatcgaaaatgataagagcagtttccgtcggaactcggaatcggccagaaactttccgaaaattctctcggaatttcgaagttacaaagtccataatacctcccgcttgcctagcccaacccactacagctaaccctagttgaggagagtgagagtcagaggcagaggctagggattttggagcaatggtagtgcattgtgtgcaccacgcaggcacgccacacgcagccagatctggcgctgtcggccgccgtccccctacgccgccgccgtctcgcgccaccgccgtctcgcgtcgtcctccccccgccgtcactcgccgtccctgcccccggcgtctcgcccctctctgtgcttcaccgtcgccgtccacgccgctgacaccaatgcctcaacgccgatgcccactggcgactcttcctcaccaccaccaacaccgatgacgcctcgccgcctgacctcgccgcccgacgcccgggcgtcgtccccctgcctcgccgccgcccccctctctgcctggtcgagaagcacaaagaagcagagaaagaaaagagatagggagagagagaaaagagacaaggaggaaagagagaaataaaagaaaagaagataaaataaaaagagagtgggacccacgcctctccctcagcgcttgactcatcttggaccagcttatagtcgggccccattaaaatatttcatttgatataattgtattttacgatgaattgttgaccgttgagacttgagaattggacttgataaaagtttgaagctcagtttaaaaggttttttattccgataaattttcattaccgtatccgcgcctgttcgtttttgttcggtatcgataatatttgtttccggggtttcctttttcgattccgattctaaaaataatatgaaaacgaaaataataaagatggttttcgttccgttttcacctctagactggattagtatgaaatgaagaaattcgctatcctagtggtaaaatcttttaaagtcttacgaattgagtgctagactcttaggctgtgttcggacgtccattgtcccaacctatctccctcgttttccgcgcgcacgcttttcaaactgctaaacggtgtgttttttgcaaaaagtttctatacaaaagttgcttaaaaaaatcaaattaatccatttttgaaaaaaaaatagctaatacttaattaatcacgcgctaatggatcgctccgttttccgtgctactgttccaagttgggaacaacccatagcgaacacagccttaaagttcagcgtattagattgtacataatgaaatttctcccacacctcccaacccaaatccgtcacccgccgccgccgacaaaaccctagacccgccccgccgccccccgccccccgcccccggccgtcgtcccatcccgccgctcccccacagtcgtcgcatctcgccgcccccccaatccatcctccggactccccacatcgccgcgccggcgcccacatcgtcccgtcgaccgttgaacaccgccgccctcctttctctagcactcatcccgtcaccccgacgccgccgactcctccatcatccctcatcgcgccttcctctactcgtaccaccgccgaaaccctagacccgcaccgccctcgaccgccgcccgtcgcatcccgcctcctccccgagtccgcgacaactattcccaaggttggtgtactccccgtcctctttctcctaggtctctaaatctgcatattcacatgttagtctcatccgtatggtagttttttttctttggtttcattgccgtcatccgtaagttgacatttatcgtcaatctttcactgtaaaattgtggctaggaaatggtgtgcctctgatagtatgtgagacaaacctataaattaatagccgcacaaatagaaaaaaaagcagttgtcacaggaatgctttggtgccgtttcattattcctgttctggctattagaattcatttggcttttgccactgcaattggccatattcttacttccagtgtcctttggtaacaatattagctcaatgcacaattctgtttttctattgattagaatgatacaaggtttttttttcaggtcatgaacaaaatgcagttgcacttttacttgttttattactaattcactaagtttaagtcacttttgttctggtagatatatttccttaatctgtactcatttgttgtttgatgactctaatcgatgatcatttatgcacattgtgactttctagcttaccatttgatgttatggtttaaggcacagaggagtagcgaaacatgatcccctttatctagaagtcactaagtcagtgagccccacctttatttgtgaagactacttgttagctgttactttgtattcaggattggcagtttcagtaacagctttaggcttagttcgtttcccctcgttcccaactgcccactctcgtttttcgtgcgcatgcttttcaaactgctaaacggtgcgttttttacaaaaagtttctatacaaaagttgcttaaaaaaatcatatagatccagcgtcatatatacaaagatggtggtagtataaatttagttagttttatttcgataataaaacgaacgagcgatatcgtagcgaacactcttcgtttaacttatgatattctatcaagcccatttaaacaatgatattataacgaaacacttctctatctctgctattataaaaattgaagatgtttttatcggtattttggtacgtcatccgtgtttgagttgttttttaagttcgtacgcttttagaaatacagatatgtgtttgagttagattttaagctcgttttcttttgaaaatacaaaaggagtcgtataagaaatcttttttttaaagaacactcacatgctaacttgagataaaagttggacttgtaattgtagcttgtgattttcttaaaaaaaaaatccaagcgaattcctatagtgaattttatcctatctaaaccgtataacaataataatgttaaaatagtattcacccattgcaatgcacgagtatttttatagtatatgtaaatttatcaatgttcacaccacaactcatcattcatgattagccagagacaaacatccatcaggtgccccatgaggccatatgtgagtcgaacacgggacacgggaagatccgagcagtcataaatcaacacggattgaaactgcctaattcaatggaagctttccaagcgcagccgccgaatcctccatctccggtcagcatagctcccgctcggccgcgccgctcatccctcaccggcacaccgcaccgtcctccaccgctcgccgtcgccgccgagaagagggacacagctgccgtgcgcgtccgagtggatgtggtgtgaggcggccgggtttgaactagccaacgtcatatatacgaagatggtggtagtataaatttagttagttttatttcgataataaaacgaacgagcgatatcgtagtgaacactctttatttaacttatgatattctatcaagcccatttaaataatgatgatataatgaaacacttctctatctctgctattataaaagttgaagatgtttttgtcggtattttggtacatcatccgtgtttgagtcattttttaagttcgttcgcttttagaaatacagatatgtgtttgagttagattttaagctcgtttgcttttgaaaatacgaaaggagtcgtataagaaatctttttttaaaaatcactcacatgctaacttgagataaaagtcggacttgtaattgtagctcgtgattttcttaaaaaaaagtccaagcgaattcgtatataacaataataatgttaaaatagtattcactcattgcaacacgtgtatttttatagtatatgtaaatttatcaatgttcacaccacaactcatcattcatgattagccagagacaaacatccatcaggtgccccatgaggccatatgtgagtcgaacacgggacacgggaggatccgagccatcataaatcaacacggattgaaactgcctaatttaatagaagcttcccagtgcagccgccgaatccttctccatctccggtcagcatagctcccgctcggccgcgccgctcatccctcactggcacaccgcaccgtttctatcgcccgctgtcaccgctgagaagagggacacaactgtcgtgcgcggccgagtggatgtggtgtgaggcggtgaggcggagggaacgcggggagcttggggcacggcgcttcgagacccgcggccgggcgcgccgcaccgcctcactcgcactctccaaccgcaaggagttcaccaccccgcacaacggcgccgtcaactctctccaggtacacccccttctcactccctcactccccttctccttctctcaccttagtggtttagatcaatttgatttgtacaccctgtagatggaatcttgcgtatttggtgtgcaattcctgagtcgctcccgctggtgttttgtaatttgacaatatggtcaggttgatttgatagagcggcggtacctgctctcgggcgcatcggatggatcagccgctatatttgatgtgcagaatgcgatcgaatacgaagctgggttcattgccaagcataggagcattctccttgtggacaagcagcatgaaaatggccacaagttcgcggtatctatggccgtatggtatcctgtggacactgggctgtttgtgacagcttcttttgatcagtatgtcaaagtgtgggatactaattcgactcaagtatgctttcatctgctttgtcgattgctaatttttcttttgtcttgcctcctttgtggtggcaatggtgtgatcctgatgttctgattttttgcctggttttcttttctaggtcgtaatggattttaagatgcctggaaaagtgtacagtgcagcaatgtccccaattgcaacaacacatatgctgatcgctactggaagtgcagatgttcaggtccgtttatgtgatattgcttctggagcctttacccacacgttgtctggtcatcgtggttagttgcttacttctagtgtagtgatgaaaatatgcttgctttgtttgtatggttaccaccttatccttggtatctgacatgtcagatggtatcatgtctttgaagtggtctacttcaagtgagtggattttgatgagcggtggttgtgatggagcaatacgattttgggacataagacgagctggatgctttcttgttcttgatcaatcacggtctcaactaggaaggcggcctccttttcttgagggcacctcagataaggtatggtcaccattatccatcacttacatttgttttcaaaatatttggttgcaacgctaaagctggacttccacttttattttctgcaaaagcttcaaaaatgttgcagctttaagtaaaacattatggttgtaatgctacagatcaatactgtcagccttcaagtaaaagctgatttctgcggctattaatttataggtttgtctcacatattagtgtcagtatataggtgctatggatcagtttagtgctccaattcttacaatataaggtctgcatacattgtttcttgttgattgttgtgccctagaaatgacgcgcaaactcattgatctagttgtgcaaatgatcaatgtattcatttttaattttgactaggatcctttgaactctttacaaccttcatcttcttcaaagatttactctgcacagcagaggacaggcaagagtaagaaacagtcacacaaattgcacaaaagtcaaatccctggacatggacatatccaacagagattgcaccctggtttgtcttctagtcaaaatcgtgcaacggcgcattatggtgctgttacgggattaagaacaactacagatgggatgtaccttcttagctcaggttgattgaatttaattgctatttctatgagcattcgattgctattgcttgaaaggaattattgcctatggctatcttcttgttatgcctgtatgcagtatgcattaatgat

SEQ ID NO: 10536 - DNA, 742 bp, Oryza sativa
caaacattccgtgggcactatgaacctgttaattgctgctactatagtgcacaagaacaagtaagtcttccctctactcctatcctctgttaaccctgaatgttcccgcatcaataccattgctgagtcttttgaattcaggagctttatactggcagcaatgacaggcaaattcttgtgtggtctccatcaactccagcatttactgaaatggtatattttctatttcttgttatcatatatctttctgtagaattttcctacatcctatcaaattcaaatttctcaggagtagtcgggcatattgggatattattgcataagcttttttaggcatttgattgttagcactgctaaacctctgcaggaagatgatggcaagaggcaaatggattttgtagtcgatgaggataactggttcatctgagaattatgcatgtatagttgtattgtacactaagaacattgacattagggatgttaacaggccatgtttttttttctttttttaagggaagccacgtttattactattgtacagtacttcatcctgcagtttcacccgaaatatcactttgataaagacagctaagtgaaatgtaaatatgccaaattctctctccaataatgaaaatgctcctatatcgtgtttacccaactgttatgatatcgtgttaacaaagatacatcagatcttctctttatctggtaaggagcaaggacagaaatgctcctatgtcgt

SEQ ID NO: 10537 - DNA, 14236 bp, Oryza sativa
  unsure (1)..(14236): unsure at all n locations
ggatatatagaattaatgtatccctgttgccaatacttatgcaaaatctatatataaattataatacaaaatactcatagaaattatatatgttagttttagtactgtataaaagttaaattttgaaagtgttttaaaataaagagataaataactagcctaatattgtccaaataatctacctcaattataggtaaaaggaagaatctatataagaaggtttctaaggtaaaaggcacaaataatctatctcaattatatttctaatgtatgcagactcatccaaaactgctttcgatgagtgacatttcacagctaagaatactgcgaaaaatataatttttggcggaaaagagagacatatgtacacatgtatctccagtttatctaaacaaaggaagtcgtgaagaaaaaaggaagtactactccgctgatgttagccagctcgtgaaatcacagtgttgagaagataagcattaagcattgacgagcctcctagctctctatagaaggagtcagtctagctgaagagaacacaccagagaagcaagagtagtagtttctcctgcctctctaggcagttttacccaaaaagaacacttctctatagatacaaggaccaccggatgcctatacaagatgcaagctaagaataagaactaccaaagaggtttctcaacaaacaaacaatgatatataagaaagttacttcatattaaacaagtaagcttacatacggttttctctttcgggaccccaaagaaaggtacagacaagttttctcaccttagaccgtttatataacatttgttgctcccaatatactagaaaggtaaattattaacattactacaggactaagaggctgaaggttcttaaagactaagctagaggatcttgcttctctggtctgtgctctttagctggaccaactccgtttatagaggctagagaaggaggctttgtcggtgcttcgtgcttatcttctcaacactgtaatttcacgagctggctaacatcacagagtagcacttccttttttttttcttcacggcttccttcatttagctaaagtggagacaactttgtacatatgtctcactttttcggccgaaagttatattcttcacaatattcttagcagggaaatgtcactcaccgaaagaattttgtgatgaatctgcaaacgttatcactctttgcttggagtgttcttctgaactattctttcctttacccttgaaatataggtgaggtagtttacttgtagactattaggcttgccacccctgaatgattgataaatccttatcaattgaacctttcttatatattgaactttgaaatctatctactacctatatagtgttagggggcaattgcgtttctgatcctattttaaggtctaactatcaatttaaccctattttcctaagtttgctcttttgactctcttttttaaaaacgaacgttcggtctggccctattccgttaaggcaacgtaacagtgttaattcagaaaaaaatagcctttatgcccccactcattttcatttgactctactttttcaaagtgcttgcctaattttgtgtatttttatctaaaaatgtgacaatttttttactaacataagtgacaaatttaacttaggtttgagtgatttgacaattttgaaatagatctaacttcttttggacgaaattcacttagatttgatatatttttgagaaacttaacatacatttgacagatttttgataaatttcacaaaaaaaaattacataatccctccagcaccagcagcatgccgtcctcctgaccaggagagcaccgggcaagaacaaagagaggcgagagagagatggagagcagcagcaacagcaaaaacaaagcagcaaaattctagcggccagcgacggcgagctcccgcgccgcgcgcctccctacgcgccctcccgcgccgcgcgcctccttccgcggccggcggcggcgagctcccgggccgctcgcctcccttcgcgccccgcgccgtgcgcttcctcccgcgcgtgcgtctccttccgtgcttggcggcggcggcgggctcccgcgccacgcgcctccttcgcttcgcacaccgcggcggcgaggtcccgcgactccctccttccgcgcggagcacgccgagagagatggggttgagagtgactggataggattgggagtgagatgatagtgttgagttcaggggtattttggtcagtttgaataataatttgatcttttttttttctaaatgaaaccctaacggtgtaactttttaaaaagcagaatcaaataagcaaactacgaaaagtagggttagattggtagttagactctaaaatagggtcaaatgagcaattgtcccatagtgttattacactatatagctgtactgtaataacattttaatctctataaaacttactgtataatccgtacaagatatatagatttttcgtttgtttctagtacttatgtaaaatttatatataaattataatacaatatagttatataaattacgttaattttagtgtggcgtaatatagttaatttttgatagttttttaaaagaaaccgtcgcaagatttttcttgatagtcctacttgtgtggcgatagctcacatgtggaagtatgatcgggtctggccccattaacagatttgtggagccatcgtttctcttattcatggaataagcgaaacgacgtatttataaacgaaaagtaatttgtgaataaaacttttatatacgtgttcttagcgatctaaaagcaaaggctgaaaaataaacttcgatgaaaaaaccttaaaataagtttcaaatttaaggttgaaaattttaattttggctgataagtataagcataagcgaaaaaatgaggtccttgagctgtctttcatttttatttttttcctggaaaaagtttgtttttcatccctcaatcatatgacaagtttaattaattcacatctcttaaccgtagaaccaggtataaagactcgcttaacgattgaaaaccggataaatttacctccctacggtggcttccctctcacctcggctggccgtggctcctaccctccttcccggggttggaaatttcggatgaaattacttcaattttttcatgaattttggtaatacttgttcaaattcaactaaattttatttaacatttcggaaattttgaatcgaattttttaaaatttcagtatttcggtgaggcccgatcagatcggcataaccaataggatcaaccctgctccttctgcggctcgctcaactggcaggggcaacgacactggcgcggaggtcagcgacagcgagaatgaagggatgcacgtacgtgtcaaggtgtgagccgaggccgcgcgctcggttcccgctgctgctcgctttcctacggagaggagccaccgacgccgaggcccttccttcccgccaatagccactgccgaggagaagcagtcgtcgtcgcgccgggatggggatcgaggtgggtgcggccgtcgtgctcactacttgctgtcgatgcccctgcgcactcaaccccacgaaggtgacagatgaacacgagcaggaggccgatggcagcggcctcggagacgctgacatagagcaagaggagccatcaccaccggcgcgcggagctactagctgctggcctcgagcgcgacgaggaagttgtacgggaatgccgtggaggacacgaggatcacgccgtcgagaacttcggccgccacagtgcgcctacgcgtcttaggtcgtcacgggtggcggcggcgggaaccttcaattcccgccagcagcgccgtgttggctgtcgctcattatcgtagcaaaagtcgctccgcgaggtcgagctcttcacggcaaagacagtgagcatgcacacgcttgcttgcttgcttggtgccaaccagtatgtcagtggggatcgaactgaagatgggttgttgttgccttgttggtctgattgttgaacagctccatttggggtttttatttgtatcttcttcttttcgattgtaatgcaatgtaagcgtcacctacctgccatgttggacgaatacctggtcgatcaatctgccacgtaagtaccatattagataaaatcatctcgcaaaccatcgagggagatgaattgatccggtttctaaagttgagagaatttttatatcctgtattgtgatcgaggcacaacaattggactggacatataattaccatcgaggagatgaatcgatccggtttctaaagttgagagaatttttatatcctgtatcgtgatcgaggcacaacaattggactggacataattaagggacgcagaatcgacttaattcttttttttccctctgtcacagggctgactcagcatttcaagcccaaacacagttgctttgcccctaaaaagaagctatataataacacacctaataaactaagtgacgtatacgtaaccttgggtaatgtacactgttggagaaaggggctttactcccggttcgtaacccccctatagttccggttttcaaccgggactaccaatccgggactaaagatcactatctttagtcccgggtaaaaaaaaccgggagtaaaaaatgtatctttagtcccggttagtgttaccacccgggactaaagatagagctagcctagctagatcggttactttattattattttcttttcttcattgtgtttttaatatattgatttcactccatccccatcccaaaatcccaaataaattatccccaaatccccaaatcggccatattcaaatagatcacaaaatcttaaaacaaaatttcatcataacttctacaaaattcatcacaaatacatcacatatttacggacatcacacacaaatcaaatacacagattcgaatcacaaattcttaaaaaaaagaaaaataacacaggctgctggccactgccgcgccggccgccgcgaggccccccggtccgccgcagcgccgtccgccgccgcgaggccgcacaggcctccgcccgttggcgccccgcccgccgcgggaaggccgccgcccgggcttgtgccccgccacgccgcaaggccgccggccgcccgatctatcagtgggatgatgggtagggaaggagaggagttagaggagagaagttagagaggaggaagaggaagggatgatgggggagggaagttgaggagttagaggagaggaggaggaagaggaagagatgggatgaagagataaggttaggagaggaagaggtgaagagataaggctgcccatctcctcctcctcctcgatctcgcagatggcagatgcctcatactctccgccacgatcttttgttccggttggttttaccaaccgggactaaaaatagatctttagtcctggttggtaacaccaaccgggactaaagatagtatgcatcttttttcccggttggtgttaccaaccgggactagaaatagatctttagtcccggttggtacattaaaaagcagctctaaacttttgaatcgggactaaaaataatttttaatctcggtttttattacaaccaggactattgtagattttggccgaccgagtaaagatggtttctccataagtggtaaccagggtcaatagtctgaacttggccggggagaggacgttaagatgaatcaaacaatatcagtttcaatcaatttgtgaccagacaatggagcttatcatacaacagacgcagcacacgtacatgttgtgtggtttgcaggcctagttctagtgcacaactgctgaccaaaaaagttcatgaacaaccctctccggcaccggtaggcctccccacacacatgcacacgagcggctttattttattggagccgccgtttgcagggcggacatacgtatacttacgggtgcccagaaattcagtttagaaaattttgagctatagtttatctattttcatcatatatatattatgttagtttaaacttagacatctgtatcaagtaaagcaagcgagtggacagtaaaccatatcaacttgtctatgatggcctatctatgacagactgaagtagctatcacagatgacatcatgtctgacgggttaaactaaaacttattgtagataaggctcaaggggatgactcgtcacaggtaagaactcatctatgacagtatgacgggcctatatcagaacacagcacatgacatctctaatgggcttacatataggcccgtcacaggtgaccttcaacctgtggtgggtgttaagtttgcaacctatcaaagatgagatatctcatctcaaacgagttaacatcttatattcgtcagaaataacttaaaaccctcccacccctcatccccgcacctaccccaccccctgtgccccttctcctcccgtcctcatcttcatgtctcatcttcctctcatcactctctccttcacatctccagccgacgcctcccgaccgctggccaccggtgcctcccccgtctcctgaccaccggctgccggatctgctcggatctgcctacggggcacggatccgtccatcgcggcctctcccccaaaggttagccaccttctcctcagccaccccaccgtcggccgcaggatttggactcaacgagtttgggggacacggatctgatggcagccgccttcctactggccactggatctcgtggacttatgggacgcatatccggccaccgcggcctctccccccgaccactagccgccttctcctccgccacctgactgtcaggcgccagatcgggcctccgccacctccattccatagccggcgtccgcggcctcccctcctcccccgattcttcctctgccaccctaccggcagcagctggatcccccaaccgaccgccagcatcctccaccgtctcctttacccaagagcgctgccgccgtttctgactcttgtaggttatgcttgatttttcttatcttgcaaattttcattgccaaatttcagattgggttatattctcggttgcttgtatggatttgtagtttgttaagatggggattattactggtgtgatgtatattgtcactcaagttgtgtaatctgtgatgtacttgtgtggatgtgcttcatgtgtagctatatctctgatgttaacagatatgtcaataaagcgcaaagttacggtgtcttgcatcttgagatgttgcttcatgtcgtgagctatgggtggtgaattaaacctgtcagagatgtctatcacctcagatggcaggaaagagccacccatcacaagtgactctcatctgtgacgggttatttttatgtggcccgttagaggtgttaatcatcattgacaggcttccacccgttagagatgagatgcagtcatcactgccactgatcattgatgcgagagccgaacccgtcagaggtgatgatatgggcctgtcagtaatgtgcggacccagtgtagtgggaactcccctcgttttattatagctcccccgctgatgcttggatcgatccggcccgtcccaccccttggacgtacacagtgaggcgattttgctagatatttgtcatcaaatttctccccctaatatttatcagatgtaattacagtacaatcgtagtgtaattacactgtaacttacatgtaattacaatgtaactataatgtaacttatatgtaactttcaagaatctctcagtaacatgttatttcagtaaaatagaggtcctgggaataaattctttcacatatgtgtgtgctgtgatttttttattcctcaccagaacaaatcttgtaatagatctaactattcaaaattacgtgaaacttacatacaagttacactgtagttatatgtaagttacagtgtaattacatacaagttacagtgtaattacactatgattgtactataattacatctgtcaaatttttagtagaaaatttatcgacaaatgtataggtggtccccagtgaggtactgacgcacaaaacaagtactagtactatttgactcagatgacacacagtgtgtacgaattaaagttgagcgtatatgtaaattataaaactacatcggtgcagtaacttggaatgtaaaacatgcattcacaaggtatacatctgataaacaaaatgcaatgttgtttgtacacaacatattaacagagcgaaatggagcgtgcttgtgcgtagcatatatcgagcaaaaacccaatgtaaattaacgatatgtgcatcgcctgcatcgcatgcatgcctgctcatcaatacgagagcaggctcacggcgaccaccgcggtcacgacccctgcaaacgccgccgcccatcccgccggcgccatcctgccggcggccgccgtcgccgtggcgtccacctccttcgacggcgcttcgtcaggcgccgccgccaccgacgacgacgacgcggtctgcggcttcccgtgcttccccgccgccgcgggcgcgtcggcggcgccgtagtccttcttggcgccggggccgaacatgtcgggcgggaggaggacggcgtcgagcgagtacacggcgagcgggtggccgtcgcggagcggcctcccgagctcggcctccaccaccccggacgagacgcgcaccctgtcctcgccggcggtggtgacgttgacggtgcagacgccgcgctggccggaggcctgggtgcgcaccgggttggtggtggtctcgaacgtgacgaagccgtagtacctggggaggacgtggtacagcaccagctccgcctgcgcctgcgcgtccatctggttgagcgtccccggccggagccgcccgaacgcggcgtccgtcggcgccagcaccgtcagcccgtcgccgttccggtcgttgttcagcaggctgctcacctgcgacgtcacctccgtgtccttgagcagccggacgaaggtgttgtagtgcccggccttcgtcaggatctccgtcaggttgaggggccccgtcggtgccgggcttggcgcttcgccggcgccggagacgacgacgacggagacggtggctagggttagggacagtacaagaaatactgtgcttggggaggaagccattttggatgcttaattaatttgctttctgtatagctactactgtactgtgcggtgttagggctggggtttaagtagggagtgagagttggagaaggagggctttcaataatttcttgcagttaaataacggccaaactgttggttcgaccatcctttttctagttggagcgggagacgtctccagttttgttgtggttatgttggtggtgcatgcttatccatgaaacatatacggagaggggaccaatagtgaggtttgctttgccttttcatcttctgatcagaataagctaacgatcaataatactatactaatgatagggcgccatatattgcatgatggatttattgcgatatattgtatttttctatatgcctctatgtgctagtagctctttgatgttgtaacttccaagtgtcaagctgggctactatagctaccgtactatatcgtgtgatttatgaattagataggaacattcgtgcatgcatgtttatattctgcattttgtagtgggcatgatcaatgacagtaacggatgtttgcgccatattttctcgaaaggacagctgacctagacagtcacattaaccacattgtttgttaagactaacggcatatgtaccggtacatccgtactttttacttgctgttatatttggacatcgccacttcaatacacttaaggctgaaaaacagacagcgacagcagcagcagcaataataataataataatacaaaattatccgtctgaacttacgcacttgttcaatttagccctctaaattaattatagaaccacatttttaaccctcaatacttgtaaacaagagtaaagtaacgaggtgaacagtgggattttacgatgaacatgtttttttttttggctatttgagtcgatcagaccgcgcagtgtgcgctggtcagatcagggttgtgcggatggtcagatcaggtaactcaacggtctaacaggttagctcatgtatggagttagcttccagctgtttagttggatactcatgattacttcatgttatgacttctatatgattactatgcatatgtaatactattgtcagctaatattaggttaagttgagaaagcacttgtgcttggctagtttagattataaatcggataaatagtttagaagaaaaaaaacttttaaagtgcggaagatggaaatatgagaagttagctaactgagctgcacaaggctcttatccttttttaaagagcaattttactgtttttgaggaggtaccatgaggtatcactttttctattgtaaatttggtacctcttggtacctaggtactatgaggtaccatgaggtaccaaattttacactaaatttttggtacctcatgttacctcctcaagaaccgtagatttgctcttttttaaattgtcgcacaaagagactgagggggcagtggctatgcatgtaggtattcatgtatgagagagcatgcgtgtaatgtgtagtagtggacacccgatttttcctcttaagatcaggcgctcgagttgcattcgccaagttttgatttttggtctaccattcatcactcctctagtaggatttctccttgtgtttcgatcctaagcttctcgcgcgcttgccacccctccctccaatggcggtgccggcctctcccagccgcagcgatcggcaatggtttagttgctgccctgctgcccctctccacgacatactggtccccacagtacgtccctctccgcgcagctctgaaccaatccctctttcttggcaggaggacacagggaaggcaggggacgggatccggcggcagcaccatcttcttcggtgatggtggaggtgtcgtgcacacacttcaggtcatggatgagtcaactcgtcacaggaggactggtggatcgagtaaatcgaacttattgcaaaacatcaagcggtaattcggacttcttccaataaaaatccccaaaattaactctaaaattagttttgaaaattcaaaattgatatgtggctgataaccaaccagcagaccatgtgagagcctcacatcattgatttatgacctgttactccatccgtcccaataatatataaacattgctaaatagtctaaaggaagtgcatttatttggattcggcttctagctttaataggagaaattaagggtgaagaagaaaattatgataacacttattaaatgaagaggtgttcaggagtaggagtgtagtggtaaaatagggtgaaaatcaattggatcatgattaagatgaaaattaaattgcctgtactagtgaacattgaaatcccaaaattatattttgggacatagggagttatttttttatttaaaatcttcagttaaattactaagatactcaatagagagtccaaggtactgaagaaaatgaaatatcatataattattgtccttgacttttagaattattaaagcttaagaaaaactaaaattgagactacaggcggagtacaacttggtctagtccacgttagttacaacttactaactattaattaactttttttcttttttgagaaagagaggattcctccccgtgttattaacaaactcatcaagcgactactaactattaacttataaatttaatttaataactattaaatcaataaatattaccaaagcgtcactaggatgagtatacatattattaaatttgaaattttagatatttaaagaaataaaaaattagtttatgatagcactccaaaattaagagtatgcacaattaactttatatttattgtatatgtttaaaataattaagttatggtattacaaaaatcattagagtgaattttcaatacaactttgcaggtatttttgaagtagtaattaaattaaattgttttgttcttaagccttaaagttttcatgtatacaaaatatgcaatgcaaatacactactacataaatgtttttgctagacgagaccctggttaggttgcagacgaaccataactgcccgcgtttgtaaaattcggtcttcattttcgcatacggcatcttaagatgcccgcatgcaaaaatcgattttcgtaaatagacaacttaaggagctgcatgcgaaaataagaccatttttgcatgcggacctcttgagggaccgcatgcaaaaatatctcatttttcttttttcccatccacttcaatttttttacccatctcctgtcaagatatttcaatcctctcttcactcctcgcttcctcttctcttctcaatctctctctccctccaagtgggcggcgacaggcgggcggcggcgccaccgccatcccctttctcattgacgatgacaacgacgacgacgaggaggcgaccagctccatccacaccccccccctgacgctgccaccgctgacgacaaggaggcgacaacagtggtcgacgtcgggcggcaggcctcctcctacccatatctggcaacggtggtgagagcggtcggcggctcagcggtaggagcagcggcggtgggagcggacggtggcggctttcacgatggtgatttgcctcctcccgcccggatccagaagtggcgggcctcctgctgcctggatccgacagcaggaacggcagtggtgggagcggacggcagcggcggctcgcctcctcccgcccagatccgacggtggcaggcctcctcccgcctagattcggcagcgggagcggacggcaatgggagcagagggcacgacgccggcactcggctgacgtgattttttttttggatttttatttttgcatgcggcccacgtaagcaactacatgcgaaaatagcaatttagcatgcgggtgcaacgccctcatgcgaaaatcactatttttgcagaccttctcgtgcagacggcctggccatccgcttgcaaaaaccaaatctggctgtctgaaaaatctttttttaagtattgatagtctatacaaatgcaacgtgtgttgtccgccgactagtctaactgtaatagttttacattgggaagtccatcgagttttttaagtattgatagtctatacaaatgcaacgtgtgttgtccgacgactagtctaactgtaatagttttacattgggaagtccatcgaaccagatcgagaccaaactcgcgttatttttttaggcttgttagctagtgtcaagacaagataagttggttgtgtatgattaattaaatattagttattataaacttgaaaaatatgttttatttaattttttaaaaagctctatatagaaaaactattgtagtaggtcaggaagtgtgtttatagaaaaggagtggtagctgttaaatatgtgatccgaattttgggcccataatatattcggattagtttcctagtaggagtcctattaggtgtctttctattatcccctatatatactcttgtaagccgtacgggaaggggtgacgttcctattatgattcccctacgtttgtaatcatctcctctatagtgatcattgctggtcggcgcccgtggtttttcccgcaagggttttccacgtaaaattcgtgtctccgttgtgcatatatttttataacaagtggtataatagcattggagattcgatcaacaactatcccatcgtcgttctgcaattcggcgagattatccaccagcgcacgttcatcatcggcgacggcaggcgcgtgtcgtcgctcgtctcgtcgattcgtctcgtcttcgtcgtgctgcctacgcacgcgagaaaaaacaggaggagcagcagccggtctccacaccacacgtcgggggaggagaaaaagcagcagaaaccaatctaattgcgcacggatcccaaagtgaagaaaaagtagggcaagtcagtcagagccatcatcgccctgttctgtgaattcaatttcacgttgagaattgctatggccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10538 - DNA, 11440 bp, Oryza sativa
tgaggccctcttttttctttgatatttttctttcggaacatttttcgctcttgttttactttttttctctttcgggatatatacacaatagttaaatcagttgtattcgttgacaagggtgttactacattgctctacccacacatggttaaaggtggagtggagtggagatggctggtgtggaggtggtaaatacggtgttgagtggtgataagtaataccctccctgagtaccttagggcatatgtagtgtttatttatagacaacgtactatgtgtagatctcataacaaaaatatatgctttgtgaaaacttctgtaatgtatataaccacagggtgccatggagagtgagacccactgtgattaacacaaggaagatgtggtattgatatattcatttcacagagcaatggcatatggcatgtgagttcaagaatacaatggccggtggttggccctaagctaggagtggctgaaaataatcttatagtgtatagagtcggttctatcatcttctctcttttatagaaccctctctaaatgcaagattgtacatgcttttatatcatccttgaaggggatccaagtcttttgacatttggtagcccgatgatccattccgtgtcgagctggaccgggctgccttgatggtccggtccaacaggaagttgggggaggggggaggggggatgatgctcacatgggtttggactacaaaagggaagaaaagatggggaatgaggattgggcccaaagagcgaatatatttagagttaccattttatttgagtttgtgtgtggatgatttgaacttggatttagttttcatatttcctgaaagggtggcttattccattgacctatattgggagataattactttccaaattttaggaatttcctttacgtagtttcatggatttaataaaataaattgattccttatttagagttacttcattttctattggacccacgattggtatagatatttgggctttttatcgtgtatgtgttagcttattagttgtaaccaaaatttaaattgtgaaacttaactttagaattgatttgttttcattgccaacaatgaattttaaaccacaaataatatatgtacaaaagtcttactaataaattattttgtatcgtatattttcctatgacttatcaaccacagctcaaatgattagagtttactatcagatgccattactatagacaacagaagcatctaataaatccaaataccctcttttatgactatcaaccttcaaaactcaggctaatggtgagccttagatcgagatcaaaagtcatcaagcctagactttggctcatgcttattttttttacttgagctataagaataacaagttaaatcttgcccacatatgacataaaataatatcgacacaacatccaaactcaaaaagataacatgccaaatctcaccaacatatataatccaaaacataatagtactacataataccataaaatcaagaaatggttatgcccaaagttctataataacatatataataattgaaagacaggacgagcaaccaccgagagaccgtagtgtgtggatattacatgtgtgagatgcttaaggttaatgggagttacacaacaaacccggacaatataaatacaaagatttgttctttgaaaaatactatcccatagtaatgcagtttattaatgcggacatcaaaatttctaacttttattttcatatttcttttatatattcttgaaattcctcccgtagcataacaattcgacaaggaaacactactttatgaatgtctgcaccgatatgtgccactttatccaacgcgagtgttgcaatgcacttggtttgttgtttgacgattagagcacgccatcgtaagaaaacaaatacaaaacccttcaagagtagaaaaaggaacatatgtaatgaaactttattgttatgcgatccgagaatgatcatttgtgatgaagttaacaaaacaatgtttatatatgtcttcatttgaacatatttaatatttatatattgataagtacacacttctagagcatatagtactagctactataaaactaagttttcaactggaaaaatattttgatttataataggcggggaaatagctatctcaagcaaaatcacgagaatattcatggatatatcaaatggttttctcaagatgatcatgatgatgttatcacatatctcctatactacatactttgttataattacaattttgttttttcccattgtaacatgctagtattgtactaatatgacttaattaaacattatcgacacaacatccaaactctttttttttaaaaaagataataagccaaatctcaccgacatgtatcacccaaaatatagcactagtacatattaacaaaatctaaagaaatggttatgtccaaagttcccaacacagcaatgacttttatacaacacatgccaatccattttcccagaggagccctcgcgtcggcaaaaccgacgtgacgtggacaccctcccgctgcgtccttcctcctctttcctctcctcccgtcgagattgcaaaaggaaaagaaaagaaaaaataatcctccatcacccaccgcatctccgctcctcgaccgcgagagaggagaggagagagagagagagagagagagagagagagaggcgttgcgagattcatcaggcaggcgcaggagaggagaggagaggagaggagattcattatgggggtggactactacaagctgctgcaggtggagcggggcgccaccgaggaggagctgaagaaggcgtaccggaagctggccatgaagtggcacccggacaagaaccccaacagcaagaaggaggccgaggccaagttcaagcagatctccgaggcctacgaggtcacaacaccttcttctgtatctatatgcgcattccccatcgttcgcgaatttgcgcctctgatctgtatatatgcgcccggtgtgctccctagttgatgttggtccgccaagaatgggggctggtatagagggtgcacctaaacgagagggatcaatcttacccccatttcctctccgctcgccgattgaagtagtttttttgttcgccattacctaaacgaggttgttcttgcgatgcgatgttgttggtaggaagatctgggtgctgcaaagcaatgctgtttgatctgaaaatgctgcattttttcccggtgcttgtgggatccaaacagagcaatgtagtgcctttgttactcaagagacgattcatttcatgcaacaatatggaacatttgaccttaggttgggaacaatggccttttgtatttctggattctgatgttattgtgccaccttctttgttattttggaatttgcccactgttctttttgatctttacgtatgttttgtaacttcagggaatggcatgttatattcaatttttagaacaaaaattgctgcaggaggtattaatgagctaattatgatgcagctcatactggaaatttggaaccctattatgcactttattattgactggatggttatggtataattcatattctttgcatgatttcaggtgctaagtgattcccagaaacgagcagtctatgaccagtacggagaagaggggctcaaagggcaggtgccacctcctggagcaggtgggcctggtgggtcttcatactatgggggtgatgggtcgacgttccggttcaaccctcgaagcgcggatgatatatttgctgagttcttcggattttccagcccattctcaagcatgggtggcatgggtggtatgggtggaggtgttgacaggggcatgcggggatcaaagtttgggatgtatgacaatgatatatttgggtccttctctcagttccctggtgaggcatcaatgcatgctccccaacggccccagaaggctgcaccaattgagaaccgactgccttgcaatctagctgacttgtacaaaggcaccaccaagaagatgaaaatttcacgggaaatattagattctagcgggtaattagctctattatcatgtcattttaaagttattccttgttcagtactggattggtttctgaatatgtatgtggcatacgtttagtatgtataaaaaagtacgaagcattttagcatttcaagtggggtctatgaattatgtgaattaccatggcgtgtacaaaagtaaagttctgcacactagttgataatatggcaaattgcacatgattatggttgcctgttatcaattgaatagatgtcacaatctaggtctaatgtatatcatcattaccttgaaagcgctgttttttttaagaatcagattaaggagatatcaacatccttttactcccttgtcaaattggttgcctagggatgaatgagaatgtagtgactaatggtgatagtatagagttcgttaggacttctgttcaacaggttatatttccttctaggactataaacttgacatatttcctttgatatcgcaatgctttagtcttgatattgaaatagtagttttgtgctcattcaggtgggtggtttcacacgtctattgtttttgaaatagcctataacaagtcatcccatgttagtgctccgctagccttctatgtacatttggtcatcagcatgttgatggatcttgtctatgatgttgaaattgttgctgaatggacacatttatgcataggtgttcttatatcatacttttgacaacatcatcttttatatttctttcaatattgtgtaaattaaaaatatgctgagaaacagagtcaaatgtgtacatgtcaatgttaaaccaatatcattttcaaaaatataagatatgtttataatctcccatattattggacacaattgatttttcatctaccattatattaatgcagtattgctacagatttttcacttttgagtactcattgtgttaatataccaaaatgttgttttcagtttcagttgttgatgagctatactacaaataaaagaaaaactgcattaacgtgaaaccgtgccctcattgtttaggattacgctgttatggacagcactatgtggccatatccgtaaggtggtttttggattttggatatgcatcttgacacattaatgtcttccattttgaccaaatggacttgtttttggaagttaaaaacctattggacaaagatttgttgcgtaattgttctggttgcatttaagcgcaacaactggtttggaagccatttaaagttcaggcattgcctaattggcccaaatgtcatcatcccatttcactcattctgattttttcgtacataggaaacacttggtttttatatataattgtttcaccactcaagtggaacactttatttaatacagtggatactcatgacatgaggttggcttatcaatttagcgaggcttgttattgtttctgcaacttttatagaaattcttattattagatttacaaatatcagcagtttcttattgtcaccacatcaaagatatattttgctttggtttctactcaattaatatttcgcaaactggccaaacataattttgtgttgtggttctgtttctcttggttgagtatgagtcatattattccgttaggatcaagataacaaaaagtagatagcagagttgtagcggattgtgggggatattgtcggcgttacattcctaaagcggactataaaaaatactcataaatcataagtttaacttaaccatgaacatacgatggcatttatcataataagacatgtattagaagtacactgcatacaaggacatcaatcataagtagaactggaagatgatctggtatgtatgcatagctacattcatgataaacaattatatcttagttgcacaggaacagcagaaaactcatgcatgtgcaagctagcaccatcaactttgtatttctgcatgtttaacctgtctaggacctgtaattattgaaattgactgggcttgaaattactatgaaagcctgctactgcaatagtggccgctatttagtactatgcttcggattattttgagtgttactgttgccttccactaatttccatttttttgtcatatgggacatgctcttatccagtctgtttcattctgtgtttatcttgtgttgtcttcaatatttgatatgccatttttatatactttgcaatagacttccatttggtgccttactagcgtatttctgcattggcaggagaaccatggttgttgaggagatcctaacaatcgacataaaacctggatggaagaaagggacaaaaattacttttcctgaaaagggtaacgagtctccgcatgtgattcctgcggatattgtattcgtgattgatgagaaaccacatgatctgtttacacgagaggggaatgatctcgtcatgacacagaagatttccttggctgaggccttgacaggatgtacagttcaggtaacagcactagatggtcggaacctaacagtaccaatcaataatgtcgtctaccctggctacgaggaggttgttctccgagagggcatgccaattccgaaggatccatcaaagaagggaaatcttaggatcaagttcaacatcaaattcccctcaaggctgacgtctgagcagaaatcagaaattaagaggctactagcttcttgaggaacacaatataccgttaggttgtctggttttttgggtgcactggggagaccaatcagatgttaagctgggaaatgtgaataccatccaaagactcattttttgtgggttctggttattccacctttgtaacttaaaattgtcaattttggcagaataattcatcaaaatagataattctgtgtcaacatgccgtgcttatgtgtgccatctcctactgagcagaggctatcaaaatgaagccgcagttccaaactctgtttttttttcttttttgtactggactgcagagggtacccctggttatattttgagtatttctcgtcctagctgggccaatcttaaaccatgttgacaatgggctaatctcaaggcatgttgacgacggaacagttggtggaggagctagaatattgtttgaaatacatacgatatgtatgtatttcccctattatatgaaaccaaaggctttctgtcatcagtctacacctgtacggctgtacatgcacattttcggttgttgcggtgttgctgcctgaacgtctgcacgaagagcctgtcattttcaccgcgccctgcttacccggttaccgcaaataccagtccacagtttgcgcctggcatcttatcacatctgtatgcactagatatatttaccctgcatacggggccaacatttacgccggcactaaacagcagtggtaataacacatacggcaaatcgggcagtgatcaggcgatagttgatagccagccaaacactacatttgtcaaattagcacagatgtacaagcctagcaatcttcacacaattacaaactagcaaacgcaatcctaatcgcaaaccaaccatcgatcaatttacaccaagatacaatcgaatcagcaggaccaccaaatgccctaaacaatcaggcatctctcttgttaaatataacctacttggtagcatgctactctatgtactaataaacagtaaatgcacattgcaaactgaaacgcttccaccacatacttcacacagctcagcaagcataaggtcaagcatttctgcagataccgggggtaatttacttgcccaacacaagcttcttatagagcgcaagtatatccttcttgttaggattctttaactctagcaactgcgctccaaatccatgcttggtaagctcctctttcagctttgcaatcgtgagctttttatacccatctggattgccatctttagtgtctgtgctgactgtgacactgtcttcacccatatgaacagaaccgccatcttcagattggaaatgctttagagggctagtattgcttttagatctctttctgctcctctccggacgatcaatatccatatcttggaccgactccatgcctacttcattttctctcaacctcttgccatgagtggtggtacggagcttgctgtccagtgcagtctcaacaaggcgaactgatgtcagctcctggtggagtacatcaagtttgctttgggtagactgtagctgtaaagacaaggcttctgcacgcttgttcgcttcagctctagctgcacgctctgttgacaaaagagactcaaggacgtgcacggtactggacctctgttcattgctctgtatcattaattcctcgatttctttctccctctcggcaaccctactctcaagcaaggcaaccttggacaaggcatctgtttccgatttatgcatcttctgcacttcatccagtagatttactttctcctgctccagtctgtcaacttgtctttggattctttcaatcactgctaatttttccattgacaagcgctgtgcctcgtccttctctttttgggctgtaacggcctcggttcgagctacatcagacaactcggtagctctttttgcttccctttctgcagctttgtatctttcttctgcttcatcatatttcttgcattcagataagaacttctcttgaagatggttcttttcctgttcaagcattcttgcttgcttttcaaatgataccgccctgtctcttagaaattctaattttcctgttagttctcttatttcatccttcaaggctgcagtttccttgttatggctttgtgcctttgattccgctacctgaaaaaacatgtcagcattagaaaactagcactcatacaataaatgcatcaactaaatgaagtggttgaaaggtagtgatgaaggttaagtgacctgcaagcgctcagccaacacactttcttcactctctgcatgtctgatctttgcaactaatctcttcatttcttcttcctgtcaatattaagatgctatcagcatatataccgtcttactcaagcatatgaaacatgttgtgggtacggcctaccttttcctccagatgtgaagcaaactcagcccttataccactctctctttcatgggcaattttgttaatttgctcttgcacagatgctaatctctccaatgcagctttagcttgtgcagcagctgtttcatatttatccctccactctgtggcctcatcctgagcagccgctgcctgttcacgggctgctcccaactttccctctgcagagctatatctggactcaagagttgctagttgagaaatgaatccatcttgctcagccttttgctgagtaacatattgctcatacttcactctccaatcagtgcattcatggcgtacaagatcaagttctttagacaagctcaagcagcgctcatctagtgtgctacacttggtcctcaggtttgcaagatgagcactgtgatcttcagaaactcgttgtttttcacttatagcagcttcatatcgttttagatattccgatttatgggcctcatttgcttcaagttgcctttttagaagctcaagctgatcttcatttgaacgatatttcaatgcgaaggaagtcctctctgattcagcttcatttactaacttaaggcagagatccaatatgggtccttccaaactgcaagaaaaagatgtagtaacttttagatatgcttgctaagcaactagttgaccagttgaccaaaggatccatattcaaatgatggttaattaacaggcttgataacacacaatgaaaatccagaattacccatttaactttaacttgacaatagatttacaaaaagagaaggaatgaaaataattgatgtcatggattcctgaacaaattactacagctgtattgcactagatggacggtagtattaccacaattaattgactggaacacaattatattctacagtttgggtatggagcatctaatattgcaccactcaacacatgatctaacatgcaattgccattcgagatttcaaattcaacaacataacataactaccatgaaagttatcagttgttgggacagttgagacagcaggcaaatttctacaaacaacttgatcaagtcagcagaaactaaggtggctaaatatagaaaaataatattttgtatagtctcacttgaccaaaagataggtggcgtattgtagattctcatccagttcatctccagacaaaagcaaattcaaaatatctgtaagtgcaagcattaaaacaattaggtaggggcaggaacaaaccactgtcttaaaaaggctgcaagcattctccatttgcttgggccagaacaagaagtttcatattcagtgagcaaactttccaggacctgcaaaatgtaacgtggtctctgcttgagtgcatatacagagtgaaataacaccagagcagcttccatgaaagaatgtcacggtaggaaacaaaagcttccatcaaagctactgtttttactgacatcagtgtatttactgttttttatgaacataaaattattaaagcaatggtcaacggtgtgtattggacactgttaatgccataaaaacaccaggtgaaaaataacataaggagtatcgagaataaaataatagtagcaaattagcttaattggatcattgacagtcatacttaaaagtaagtatggccacaagcaaacatccatgtcattagctaaatgcctgtgcttttgcattggaatttaaacaagagaacccccactgtatgctctaaagccccaaaagtcataataaaaatattcccattgtactcaatactaattatttcacataatttttacatgcatgtctgtgtacatagctgcttttaaatgtgtttgtacatctgtctatagaggagtccacctactcactatttaggggtatcacatggcagttgtgctgggtgatggcagatgtcattcaccatcaccattggagtcttttaaaggagcatagatgtcggtacatacctgaatcacattagaaactttgactccaggagcagaacacgctgctcggagtttcctctccataatttgtatcatgtttgagcactgcttatcggcttctaaaaaggcattccttttgtattcctaaacaaatgtaagtccatgaaaccaaatgagccacaggaataagaaccaaaggcatcagtaagccacaatgcaatatttgggaacatacgaagaatgacacccagaagaatctcaattaattttacaggcatatatcatatccttagctatttggtataaaatgaaggtaatctttcctttttttttggggggtggggggtgggggtggggccagcatgatgcatccattataacataccctattatttgatattttatcaacaacccaatgtttaatcaagaattcaagat

SEQ ID NO: 10539 - DNA, 1095 bp, Oryza sativa
ctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataagaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggg

SEQ ID NO: 10540 - DNA, 554 bp, Oryza sativa
atgtttaattgctatgatgaatctctgttggttgcaggtacaagcaattgtatctttggactggtaccagcagcgaggttttgtgggattcggttcatgtggattttctgcgtcgtaccctctctggtgtcactattatgtgatgccaaggcagggtgtgacattcttccaagagttgttgctccaattgccattgatgcggccattgcaatcatcctccttcctcatcggcaactcggccgatgacacctccacgttgctgcttcgtacgatggcgctcatggtggtagcgtcgtcaacacgccattactgtgctctcctgcccgtgggcctcctcggacctccggggaggctggcgtcgagaagcgttgagcggttgacgacggcggactcgatttggaatcccggatctcctccatgacacgcttgtgggaagagaggaaagagagattgagaggggtgaggaggaagatgaaatgaagagaaagtcgttgacacatgggtcccaccaattgactcggcgagtcatagtcaatctgccatgtcagcggaag

SEQ ID NO: 10541 - DNA, 630 bp, Oryza sativa
gcgtagacgaagaatcctgaaaaatcttccaagatcagggaccccaacgtcctcctattcttttcgggtctgcaaactgttttccaattggaccaagcagctgccagataaagtgtgatctgggtctttcacctttccaaaaaaaagaaccttcgaaagcggtcgatcctcttgaaaacccatttgggcatgtgcagagatgaaaggtggtgaattggcatggagctaaggaccgtttttaccaacgtctcgcgccccgaagaagtgaagaatcgacctttccaagtgggaagcctttcccctattttttcaatgagggggagaaaatcaattttctttaattttcgataatgaagtggaaggccaagatatttgcaggggaaagatttaacgatgccggggaaagcttgcagcaaagaagcaaggtctacctcttcacacctaatagggaaaatctctgtcttggcaccgtttgtatgcagaccggacactggcgaaaacaattaacagctaggtaaaaatgttaagctcagaaatgttcggctttgcaaacactgcaacgtcatcggcatataacgagcatcgaaatctgacccgatttctatcaatcggggaaagtatggaggtatt

SEQ ID NO: 10542 - DNA, 7013 bp, Oryza sativa
aaaactagagcagaaaaagattaaattggataatgttgggtctgcaaattctagtttaagtgagaatacaagtgatggaaggctatcatccaaggtgcatcccctcgtatcttcctccttcgatgattcagttgaccagtcattggcaggaagctcaaagtgtaatggaaagcgcatatttccgcttgatctaaatacagtggatgcaggaaacgttgtaaatatatcggatgacgaggagatgcctgagcgtgatgcgccagattttgagctagaacttacggacaacaattctcccagaaagaccatgttttcatttctttcccctaaggttgaagaaaatcggagtaaggaacattcattgcctaccgattcaccaggttccctctccctctctcttgcctttccggcatctagggaacatgctggtaagttgcaatcagagataccgaagcagttgcctgagatgagcagccagaataagatatcttcgatttgggaccgacaatgatggctgcccgctcttgcgttcctgatgttttgcgggacagatcgatgtttgcgtcctctggagaaactatcttgaatactatgtatctgcaatgatgccactcaggtgtgctgacaagtagttacatccagggggcagaactattgaactgcaaagaacagagttctggacgtaagtgttattttgcaggaaacagtgatatgcttttcaagacatagggttatgacatgaaagttcatactctgcactgtaaatttctgcacaactcatgtaaagttttggccttaagctggaagtcatctcaaatttgagagatgtctgccgtggggggaaagatggtggttattatctgagattagtatataaatgtttctcttttcttgaaatgttctcgtggtacccgttagtttgtcatatctgataaaatgactttccgacactatcatttttttttcctaaaatgacatccctgagctgatccaatctgctggtttaaatataatcatgctgtattcggattctacgcatatactctttggaattgtgtaattaattagagcaatgaatgtactagttaatccacacgaaaacatgtctcaaacatgtcctaaattaccctacaggtcccttcactttgcttttttggaggtacaagtaagaacacaaatcaatgcaactccacacttgcaccatcgcatgcacacacacgtgcgtgtcttacacacataggagtactttttggtacagattatatgccacggacctcgaaacacggaaaacgtgcgttcagcgcacacttttgggtagagattagatgccacggacctcaaagcacggaaagtgggcgactcccgctaagagccggtacaatagcaggctataaaccagctacaaatatattttaagaagataaataaaaagagagaagagcagtgggctacagatttgtagccagctgtagcacggactccaaaacgcagtgtgtgcatgacaggtgagaccatacattaatagtgtagtatgtaactattgtatagatgagctattagattaactatagataaattggagctagtagttggccatactattaaacttgctctaaacgcgcacacgtgtgtatcccattctatgggaattaatctcacgattgatccccaaggagcgaggaaaaaatcctcctaggccacactcggaatattggatttcgtaaccaatcaagcgtgaggggcatatcatgacggtatgttgtcaccaaaattccttgtgacggcatttagactttttgtgatagtaaggggtagtcactaatagtccattttctagtagtgtacctttgtcctagagtttttttttaagataatggaagctttattagtattagtcaattactaacactcttttttatagctaagatgcacataaccaaaatacacttaaaaaaagtgatcacaggaaaagtattaaggactatcaattatgagactagatatctagatcaccgcctatgttcccggctaaaacacatccttgaccaccttgtccaatcgtggacaagccacactcaccaggtccagcaaaccaagcttttgaagaataactcatgtacaaaactagtaagaaaataacatgtagaggagataaaatagctttaacaatgctatttgcacatcataattgcaaaactaatctgtacccaaaaataccgtggcaattctctcctcttgggctgaagtagaatttttattttggatgcgaaactaagaaaatatgttgaacgagtatcgcacaagattgaagaaagttgccgaaaatctgttgaaaatacaatgcaatgtacacatacgttttgctaaaacacacgttagtattttgtaataactgaaatatggattagatacattgctaaaacacaatgtatatattatatgttgcttaccatactacaaaccctactacaaatacactaaaagcaggggcggagctactatatattaccggggtctaatgatctggatgaaagtttctaacaccatgttaattactgttcatcacccttaagcagaggagagcaaccatatagtgtaatttgagtgaccccagtaatattttcctatagctccggcccttgctaaaagacatacttcctccatcccattttaagtgcatttgtggatttccgtatccaatgtttgaccgtccattttatttgaaaaatttataaaaaaataagccacacataaagtattattcatgttttatcatctaataacaaataaaatactaatcataaaaaaatttcaaataaaatagacggtcaaacattggacacgaaaatttacatctgcacctagagtaccatattaatgttagttgatgccttgatggtaatcatggtatcttgtgatggtacctgtccaacaacttatattagtttgataatatgatcatatgatttctgcacgtggagggtcctaaagaatgtaacaattcgatcgcatggttgcaacttcaaaacattcatatatacagacgggcaagttttgaagaagagttttcaaacagcagtgaaccaaatcaatttgccctggctcaatttacaaatatacatacattcatatataaacacgctaacacgcagacataattcctaaccaactgccaaccaccattagccaactaactaatcatcgtctacgtaggctgtctccatcaccatggaagtcgtcgtcgctcgccggggcgtcgtcgtcctgcggctgcgccacggcgagccgccgcccagcgccgccgcgcggtctggcgggcgctgctcgaggctgctcctcctgtggacgttcgccgtcggcttcgccgccgggctgttcatgttcgccagccacgtcttggccgccgtcgccgccgccgtgctcttcgccgccatgtgcctgtacacgtgcctgtgcctgaacaacgcggcgccggaggaggaagaggagcagcagcagcagccgcctgttctgctgcttcccggtcaggcgctgcgcgtcgccgtgatgccgccatcggtggggcggctgcagcagcaggaggtcaacggcggcggcggcggcggaggcctcaggcaggaggacgtcgaggccgccatcccggcgttcgagtacagtaagggttcgggcggcgcggcggaggcggagcagtgcgccgtgtgcatcggagtcgtgcggcgggggaagacggtgcggcggctgccggcgtgcgggcacgcgttccacgcggcgtgcatcgacgggtggctccgcgcgcacgccacgtgccccgtgtgccgcgccgacgtcaaggtcgccgccggcggcggcggcggagcgccggtgtagtcgtcgtcgcacacgatgtcacgaacgatgtacaagctgttccgtgacggcaagttgattaatttcttcgtagtttttccccatttttgtatacttaattagtggttgatatttttgcatcgtgccacgatgtacttctgatttggaacagaagttaaatgtaacttttttggacataaattaaccagcatagcaaatttccaacaaaattatagttgttcaatagctcggatcggaattaataaattgagataatcctgaaaatgacgttggagccatttaattaattacgcttgaaaacgaagtaataagaaggctcgctcgtgtgtggtcgttgttgctgaccaaagttgtttaatgcatgcggcatcttgtttaagactgagaggaggattatctactctctagcttcagtacgaaaagaagagaaatgtcccgtgataggaactctatcttgtggcggagtacagcacgtcaatcatagtttggttagccaagttgtaattaagccgaaccttcttcgtatttgctgctcatatataaagatatccaagttgtcatgttgtccgctacaaattgcatccagcgcacggcctatcaatgatctttagtgtgcagactatgcactaatgccaataaaagccagtaactcttttaattctaactaggaagatagcccgcgcattcgcgtgggcatgtatgattatatttgtttgaagaatttataaggccggaatatcaatcgaatgacaactgccacactttaaaagtaatatatcttttcacaaattttcttcatcggcattgcttggatatatatttttttctatctaactattagctttaagctacaacatttaattcaaagaaaatttggcactttatccaatcatattgtttgtattgattaaatctacctcttaaaaggtctagtacttaagtagcaagaaccacacgaaaaaaaaagctcgagcagtaatccttcgtacatgcatgtgttaatacatgagtgatatttctcttctattagttatgaatatttgtgggataatatatgatgaaataatctatgttgttaaatttattttttttactaattgtaagactatttggatgagaatgacatagaagaatgtaaattttggtttcatgtggtatctgtttaatcaaaatatagttaatgtatctataaattgtaaagaaaatatgagtgttgaagattcaaaaaaatcagacaatttggatgagaaagatagagctaaatatattttcatgtaatatttttaaattaatatatagttaatattatatgtaatcctatataatttacatatatttagcaggaggctggcggatattttcttgtacgtagaaacataataacgtttttattcaagatgtggtcatagcacggtggcagtggttattggcattcatgatgcacccatcaacccggtttcgagtctcttcaagtatgcttagcagaaaccattgacaccaatttcttgcttggtgtctatttctttttatttgagaattaggaagcactactataaaaaagcacataaaggttggtatattggtgccgaaatagataaacccactcatgcgatcgaatatataatcggcacctttgaacaattatatgtgtcggttttagagaaaaacaaacaccaatattatacgtacctattatttattataggtgccgattaattaaaaaaccaacaactataatataactataatatattataggcactttctttttaaaaaaggcattctacaaactgagccaagccgcacggggagggagagagtcacatctttctggagatcttatctatttgctctctctttttccctcgctcatccttatctccttctccttctgtttttttatgggagtagctatatttatggcgtcatattttacactaaaaaatagtcggcatgtatttacattgtaagtccctaaattaaatatgtaattttagtgtattgacaatgtaaataccaaaattacatatgtaagtcctaaaattacatatgtaaatcccaaaattacatcctaatacatatgtaagtggtgtgtaactgctgtgtaaatttgtaaatatataaataactacctgcagcagacacatacatataagtgtgaacgcagcaaagcagtggctagcgatggtatgagcacaatggatttaacttgacaagaatctcacagtgtatccaatggccacaaaactgactgctatggagccagaaatctggtgatagaaatatagtaaaaccgtttttttatttggtggaaggttaggtgggatgcaatcttttaatagatttaatctaatggcttagaataatgggtcccccgctttaattgaaaatattttttttagaatttctaatgttttttctaatttattagagtgctatgtggcagcgtaggaacgtttataggagtgccatgtgatggtgactataatctaataattaaaaaatgggcgcatcattttaaatgaaaattatcagcccttttttgttattttttcaagaaggcagtctacaaaccgagccaagccgccgcacgggggagggagagagtcgcatcgttctggaggtcttatttatttgctctctttttccctcgctcttccttatttccttctccttctgttttttatgggatagctatatttatagcgtcatattttactctaaaaaaatagtcggtatgtatttatattgtaagtccctaaattacatatgtaattttaatgtattgacaatataaataccagaattacgtaggtaagtcctaacattacgtatataaatcccaacattacatcctaatacatatgtaagtggtgcgtaactactgtgtaaatttgcaaatatataaataactacccgtagcagacacagacatataagtgtgaacgcagcaaagcagcggccagcgatctaaaatgccacgtgtcgatctaggagcagcatttgtaggagcgcccacatggcggcgtaggagcgtttataggaagattaatgtacttttagtatataatagataagacgtattttaattttataatatcttcagaattaagtaaactttataattaactaggaagggtgcccgc

SEQ ID NO: 10543 - DNA, 1129 bp, Oryza sativa
cacacacccaaaacatgcataaacaataaagatggagttcaacatttatcaggtacaactttgaccctttttctctatacacataaaattatttttttgtactataattaatttattttatagacgtaaatagtaacaatcagagggggggaatcaaaatgtctagaaagaataaaaagattatctagccaaatttatatttgcacaatcatgttagatgttttttcttgttactttttttttattttttatgtggatgattttttgttagcaaacttcactgcaaacatggggaataggaggcttgagggacaacactgtgatgaaaacgagtaccaagatgactttgcagaattcttatatgaagaggaaccatcagataacatcgatatggttgaacaacgtgcggtaataacctctgattttttttacttgtctttttttttcaaacatcaacccttttttgggtatgctccttattggacaatttcatccttgcagcaaccacaaataaacaatgagcaaagtagccctcaaacaccactgcacataaacattgcttctgcaaggacacctgctacaaaacaagtaatgcaaattgtaagtactttcctctctattttttgcttaatttttttcaatcagcatgacataaaactatgtcttatactcttaaacattattacaataaattctgtttttcccatttttcacttgttttattttttaatgcaaagttcacaatcatcacctgatataggtatgaattctccaagaatagcacaaatgagggaaccaaatcaacatgatcaaccagaagaaagacaatattcaatgacaagaatcatcgactcactaaatgcttctggcaactgttctggtaccagactcaatctttatcgccctaaaagaattgtacatccaagtaaatacaagagctccccatatgacaattacacacggcaccaaacaatcttggcagctgaactcaatcactacaacaacatactcagcattggtgagacgcaacaatataaatagtaagtgtcacaaaacgacattataatggttgcatttttacatttgctttttttagattgtgtgatcatttcaagcttgtagttttaca

SEQ ID NO: 10544 - DNA, 2131 bp, Oryza sativa
tgcaagtagttcatcacaattctgctgaggtgtaatatatatccactagttagttactttatggatgttggtgttcttcacccttggcaattcaggacgatagaattaagatgcaagatcactttgtgttgttgtgaagatatgagatattctacacgctgagatcaaaaatagagagaattacatcagtatttatcctgcatgttgcgtgcacaaaagtagttgaggtgttgcaggcaatctaatgatatttgcggccacaagcactgctccagcctccatatgaactgtttatttgtgaggtgaccatcaatataaatgtatcctgacgagcgggtcagatggttattccaaaaattattagaagacatgtgaaaaattaaccttttttaactctcctcagatggacggcaggaaaccatggatgtgtagaactcattcagctgtacgaaaccgagcatatatttgctacaatcagagttgggaagaactcgtagttgtagtggcgtatattttgtaccgaggctgctgagcagtttttcctcattcagaggctgccttattttagcttgctgacacccgcacatacttaattgctaccgtactgctttcagaaaaccacaggatccatccggaaccacatagaaaaacagaaaaacggttcatcccggacgtccgatcctgtgattcacgtcggacgctcaggacacatagaatgccatttgcagctgctagggcccaccacgtctttaccacacacgcccttgtgctgcacgtgtccccactacatattccgttgtacaaatcacccacatattttgaaaaccctctattaagggaattcattctatttttctccattaaaaatatttcacctaatgtactcacaatgtttcactatgtatagatataatgttgcaatgaattgaaatattcttttgcaacacatcacccacatattatggacaccctctattaaaggaactcggtttatatttttgttcaccaaaaatatttcacctagtgtacttataatgtttcactttgtatggatcaaaagttgcaatgacttgaaacattcttttgctatttgctgaaacattatttttatataaggtgaaatagcaccgatttaaacgattaaaacattttcgatctacctagtgaaacaattccgatatacttggtggaacagcgtgcaatatttaaaaattattcaataataagctaaaaaaattttcatcggaatagatccatgtgtggtgttgttttaaagatttaattgcaacaaatttaatggtgtaatcggatcatgatttggatacataatttaggagaaaaaatagtttaaaattgttttgcatgcatgtattcttgatgacgttcggatggttgacggcgtgcgcgtggatcggatggcccattgatgtgtctgatttttcgtctcgcgccgcacgtccgaggcgtagtgctctccagaaaaacaagcatgcttatcttgttgctaaatgtactgaaggagctagagggatgccttattgttgtgatggctacaagttataacttgacactgatgatatgatctcagctctacaccattttttcttactaactttctcgccaatccgtagctgaagataccaagttagcagtgtgaatcatgatcaaaccatgacaaggtctgtgtgctatagcctgtagaattgtgttcatcaggccttcaatcaacttttgggttgcaccaacaagaagatctctcttaatatgtgtactgtttctcccttcttccgtatcgtttgagcactctggcttccccttcataactgatttttaattcagaaccacatgaggatttcctactcagtcttataaatatttagactctacaccactacagattttcttatctgtaaccgcttttcccataccgggggcttgcggaccgtcgcaacatcgtcatctctaacgggctaaaaaaaacaccgacaaagatatactcgtgagtgaagtatgagcccgtcacggatgatctccatcggtgacgggctttattttgcccatagtttgactcatctggcccgacacgtggcttagccatctttagtccccggttgttgtcgatttttagtcc

SEQ ID NO: 10545 - DNA, 6203 bp, Oryza sativa
tttgctatatcggacgaaactccgcactatcttatgcgggttgtttcaagaaaaataaaatgaaaaagaacaaagaacttcattgcattcttgttttcgttctcatatggttggttggttgcatgttcccggccaatatctctccctctggcagcactggcactgggcagtgatggttagctttcatcatatacattactcgtagtcattctattgtgattaaagcttctgagacacaacgtgctagcaaagaggtaggttatatgaatgtgaattcaacacatctcccagacgttctgctacatgaatggttaatataaaggctagctacaaaggtgttgtgctaattacaactttggaatgaagggccaaagtacagaacaataatgtaagccttaggattgtgaggcattgggaactgaactactgaagctacagaacatccccgctcaggatggttaggcaagagttggcgtactaccaagctaagttgtgcctgtatggtgctttgtaggtaacgtgtgctcaaaacttgttcaatacgtgggatagttgatcaaacagattgatgaatcgtgcaatccatcgtgaccgtgtgagactaatttgttttgcagccctaggtttcaccaaagctttgtgtataagcaccctgaacacaacatgtcacgcccggaaattcactagtaatttacaaacttatttgtgcataaaatcctcgtccaggaatcagccgaggtacacaaactgacaatttaatatacagattcatcaaattaactaaaacgataagtacttacttaagaggcacttagtcctcaccatgaagaaaactgcagcggaaaaataaaatctagcgaagctccggctccactcccacaggcagctcaactggggtataagccaaccgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcaattagcaaaacatttaagagaagtaaaacaatggagtaattaatcagaaattttaatcaacactgaacagcacacccatgctgcacaggcccaaccatcctgaacaaccatacccggctgtacagatctaatctccaaaccaggagctaaacaaattattaccaggtataacatctataattattatgagaggtgtgagactaatcacgaaaaacattgctcaactcgcccataaccgtgggcacggctattcgaatagttttactctggccagaggtgtaccactgtacccacaagacacagctccacatcatgtcaccatgtgcctcagtaccaccacggtacctcggaaaggagctgtgacattaccccttgcataacacaacccaccgcagcgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattggccatcgtgaactatcattaagccattattaaataataatgagtcataaattatcccaatagtgtgctaatgtttctaagcatggctaagcaattatatctaatatctagttgaaccaatatatataaagctcaactagtccaattataataacccaaggtatcaaggaatagaataatcaatgcaaattggccataacaaaagaataagttcacaccacccggtgacattcgaaaataaatgcacagttgaaataaatagagaatttaaatataggaacaacatgctcaaaggattgtgtttaggatctgtgtgacttgccttgcaataatcggtcttcaattaatcttcttgaatacttccggcgcactcgcgaaccttcacaacgacggaaacgacaagctaacaagcaaaacaaagaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttagtatgtagatctttattttacacaacttttgcaacttgaaccacattaaactgagttcaaatgaattagttatgaatttttaaagattaaatcggattaaaacctttaaattgattttaattaaattatgacgcaataatgaattatttttgaaaaggaaaagaaggattattgcgtcagcggctagggtttgcggtggaccgggtgcacggcagcggttcacggaaacaaacggccgagatcaaccctatccaaaacggacggccgagatcgatcggtccacgaccggctcacgggagagggcgacgatgacgtcagcgacgacgtcacctccggcggcggcggctcggcggctcggacggcgcacgctcgccggcgaacggcggcgcttcggcacgaacggaaggcaccaacagatagaggacgacgcagcgaactcaccggtgaccaaaaccacggcggaagagcaacggacggtgccggcgacgaggaagaagcgacggcggagattgggtcgacggcggcaacggcgctccggcggtcttcggcggcggcgaaacggtggacggggacagcagcgacttggcgatcccgacggtggccttcccgagtgacgacgacgaccgtagcgacggcggcgcacggctggacgaacggcggcgacggcggtgcaaaagctcacgaggctagggcgctacacacgacggcgggcgaaggcgagagaggcggcgggtagaggagagctcgggggtccttataaaggggcaaggaggcggcggcgaaggcccacagcggccggcgacgagaaggaaagatcgggctcggagagagaaaagccgatccgattcgacctcgaatcaaacactttccaagccgatttagccgatgtttccaaaggagaaaaggaagaggagatcaagaggattatttcccctcaaaagattcggccggagaaggaaagatgaggccgaatttggaaggagacggcggcggcttgcgctagggtttcgggcggcagcggcggcgcgaggaagacaacgacctgacaggtgggtcccgcctgtcagcggccgagagagagaaggaagggcggcacggcggactgggccgactgggccggggagagagagagagcggttttgggccgactttcggcccaaagccaaaagaagacttttaaaaacctttttcaatttaaattatttcttaaatgcaattctatttattaaaaatacttccttagctcaaataaatcccagaaaaatctaggaattatagaattaagcaaagtatttaacaaaattttatctagcccaattttatattgagatttaacaaattaaaattagatcttctcttttaagcttttaaaatcatttctaataattccttttaaacaacaatttataatttaaggatttttttttaaacaagaaaagcacttaacaaaaataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctattattaatttattaaataatttataaaccctgaaacaaaaatcaggatgtgacacaacacagatgatcactggtgatagcaaccctgacaaggaggttgaatcgatagcacacagacttggatgtgtactgatattggcagtatcttctggagtggaggaacacacaacacaaggtgttctgatttccccgttggcggtggggacccactccaacaggtctgggcccgggaccgggtctaaatgtccacctatggggcagtcggggcatgacctgcatcttgagcagggcttggggtgggtttgcagtttcacctgtgggtgacccaagaggtcccgaaaatacagaattaatgaaaaaagttaatagcctattacaaattttgctcaccaagacaaattcactggagcacatatacatcaagtaaccttagatatctttgactcagtcccacatcgttcgccacccgcatgcgccgtcacacgctactcgtgattcctgagtcccaatgctgccctctgatattgcccctgacacttccaacaccgccgctcgcacattgcgccgctggtgagaattactgcttctcgcttggcctcttcttgccacaggaagcacctcccagtttgccaccggtgagccctgcccttggattttgtccgtcaactcctctcaacagtctgcctagtcccttatgttccaacttgcctcctagccagcggctgatttcgatctcatctccctcaatcctaacaatggctcagtgttcctccgacatggcagcttttggtggattgccttatcttctcagttcttgtgttgtcttcaccgacagttccaaccccggttgggggtggggactcacagtggccagggctagagcaacattgagcccgagttggagatggggccggggacaggtgaggaagtcgagtgtcagggaagagggcattctggcccaacccatccctcaccagccctgttactacccctactcaacaccgacaactctataagactgctaccagcgtcagggatattcagaggaagatgtgcatcatcagatgagggacttaagaggagtagaacttgaggaagtgttctctcctagttatcaaattcatgccgatctgcatttacttgtcatccggcgttcctttttttttcccattcgtttcgaggcttgtagtctaacagctcttatagtttcagttgtgtatacctacggatatatatccatagaccgaatttaatagaaaacaaatataccttacaaactcccttaaaattacgctgtcaagatcacaatagctgagattaattttagatgagaaagctgtaaaaattcgaatcttgctttaaaacgatgaagtgagtggacatagtgcgcacttgttgacaaaaaccctcgggtggtgcagagtcagggagatcgatgtatagtgccgtgtcgtgatgtcatcgccagcggagttgaacgcggcagcggagatcgatacgacgacacgggcacgatctatcgaagcccggctagatacgttgttgggcgttaaaaatccactgatataatatttaatctacagtcataatttatgatctacctaatcaacggttagataattctgattaacgtgagagcttctaaaatgtgtccaattaatataggtatggatagattagggccttcatgcacttccattgaccgatattactgtatcattgcattgttgttggtacttataaagtagcaactataacctaatttcagtagaattagtgcatttgtactaccttacattgatctggaagctttgtttctttgtcctttctattttgcctggtctgaagaaacatgcgacctactgtgctaatactggaagttcagaaatgagaattcagagcaagaacacaagaagcatagcgtgtatactgaatgcaggtagaaagaaagtaatagtgtacttttgctgtgttgcagttataaacacagcttacgctatgaggccaataaaattgtactagcagtaaatctttggttgtatattagagtttgtgtcgaatatgtgtatgtagtcggttatagtttagtatttacaaaatatcgaccctcggtgtgattaatatcgtgtatggctcttttatggtgttttttcagcatttgatttacgatggt

SEQ ID NO: 10546 - DNA, 3008 bp, Oryza sativa
cacaagtcacaactatgctacttttgttttgaggagtacgacgataggctcagactatctataaaacatgcaactgtgacactactgtatatgctaaataccggaatttcaaacttcaaatttcagaccaagaacacaagaaaaccaagaaaaacaacaccaagaactgcagctcaatccttccactccaccaatacattgcagcctctacctccttatcatttccgctcactacctcgtccgtttggggctcgccatgggccgccgctgccacccgcgactggggatttaattgcatcaagaagccttaacccttaggcaatgggcacaggagagaggatgaagatttcttacgagtgagaaggtggccaccgaaggtgatagccgcctcgcaggggagagcattgtgtcgccgtcacctccagcaccatgccatgctacacagccactgctgcatcgcctcctgttttcccgagagctcatttccatcacagggttttttttccacacgtcatgagtaaatgatattttttcctggtccggatgaggggaaattacgtcatgagtaaatgatatttttttgctgacctttcccagcctaaccgaacagggccttagggataaaattggggattttactattacaatcgacttacctcaaagagtatatagatctgcacaagatgagggaaaaactccacaatgcaataccttaatacttataactatcccaacctctcaccaggcgaaatcaagggacctttgtaccgtcaaagttctctttgtataaatcacctagactaagaggtaagatgtacagcagggatagtccgtttcttctgttttgaaatatatccaggtttaacaaactctggaattaggaattgagaactaaatatccacgttggcattagcattcttgtactcataacaaatgaaccgtttattctcgcccatatacaagagagcgcctaattaagcttcagatcatcaacatgagtcatgtccatcattactgagcatatcaccttatccatcatcagctcaactacgtctaatccttggttctcatgattatatatactacagagaattcccgtgcatgtttattctactgaagatatgcaagagtggcatgctggtcttctgtacccctcaatgctccgtaggtaacttgatccaccatctcagagtccacatatagaaggaaagctcccggcgcctcctaagcctgctaccattattcaacgtgaagttgtgaactaacgctcatctcttctcttctcagctcagagctctcttgctgcctcttttataagctaaatgaggcctttatgtgcatatatatatagggaccagcgactgaataatgaggactttttgtgcgtatgggagtcagaaagtgaatgatgatgcctttgtgcgcatgcactgctacgtcgatcagactggaacgaaatttggcatgtattagaaatcttgtacccaaaacatactggatcgaccgaaaaccacaatagtcctgttccaaaaataaccggggactaaaaatcatctttagccccggttaagaagcccacaaccattttatgatatttagtctcggttggtaacaccaattaggactaaaaatcatctttagcctctattgggaagcccataaccattttatgatctttagtctcagttggtttttagtcccgttaagaaagtgtccaccccctactctttttattcccggttggtaatgccaaccaggactaaaaatcggcgcatagtatatagtccctagtacttatcctctagcaaccacctcttcgcttatccttctctctttttttatcctctccctttcatctctctattctatctacgtctatcctctcaggcggcagaggcgagcgagccttctatctctcacgcagcaaagggcgagcgagcggacgcagagaggcgcggcggcgctcggaggggcgcggcggctgacgcggaggggcggcggcgctcggggaggcgcggtggcctgcacggaggggcgcggcggccgatgttttcttttttccctttttttccctctttaactggtggatgattttttgtggactatatatattgtttggacgatttgagattgtggatgatgattttgttgttgtgaatgatttgggatagtggataatgttttttttgtatgatttgggattgtagatgatttaggatgttaggagatgaatcgtggatgagttcggctaaaaacaagtgcaaacagctaaaaacaatgatctagaagcaaataaaaaaaatatatctctactccaggttgataacaccaatcgggactaaagatagcactatctttagttctggttggtgttaccaaccagaaatagagatatttctttattcccgggtatttaaatcgggactacaaatgacgatctttagtctcagattactcctctcggtttgttacccgggattaaatggggttgcaaatcgggagagaagaggtattctccagtaatgattttatactcgtgcagtaccaagagagagccgaagcttcagttcatcaatacgagtcatgtccatattactccatcatcagctcaatgatgcactatcgttggacctcgtgattatacatcacctcactttatccaatggagaattcccgtacatgtttatcttattgaagatatgtaagagtatgatgctggtattctgttcccctcaatgctctagtgcaaacttgatctgctgtctcagcgtccatgtatatcaggaaagctcggtggcctagctaccatgggcaagcgacaactgacaagcctgatctgaacctgttttgtatgaatcacctaagagtaagacgtaaaatatacaacagggatcgatagtccgtttcttcagttttgaaatacatccaggttcaacaaactctggaattagcaattgaaaactagatatccacgttggcattagcattcttgtgctcacaacaaatg

SEQ ID NO: 10547 - DNA, 10551 bp, Oryza sativa
  unsure (1)..(10551): unsure at all n locations
atcctccccccctaacacgctcctctcccccttcctcctccccttcttctttttctactacaccataaatttaaaaaaaataaataaattaagttagaaaaatttatgtatataaatactatatataaaaatatatttgaattcaaattcaaatttgagtcgggtatataagcttttgacttataaactttaggtctataaattttagatgtatagaaaatactatatataaaaaatatttcaattcaaattcaaatttgaatcggatatataaactcttgacttataaactttgtgtctctaaactttaggtgtatagaaatactatatataaaaaatatttgaattcaaattcaaattagaatcgagtatataaacttttgacttataaacattgggtctataaactttagatgtatagaaataactatatataaaaaatatttgaattcaaattcaaatttgaatcggatatataaacttttgacttataaactttgggtctctaaactttaggtgtataaactttagatgtgtaaacttgaggtgtacaaattttaggtacataaatttatttaaaaaaataaaagtaatgtggtgaaaaaaaaaccacgtggagaaggaggggtcatcgctgggggcgatcgatcgcccgttagacttttcgtccaccttgtccatcatcagctcaatgatgcactatcgttggacctcgtgattatacatcacctccactttatccaatggagaattcccgttcatgtttatcctattgaagatatgtaagagtatgatgctgggtattctgttctcctcaatgctctagtgcaaacttgatctgagcgtccatgtatatcaggaaagctcatggtgcttcctagggtcccaggcctagctaccatgggcaagcgacaactgacaagtctagctggagctactaacacttccatgtgatgttgtgaactaactcgtcatggatgactctctcttacagctcaaagctactcctcttttataacccaaatgacgtttgcatgtggagagctaggtagcatgtgcgtgtacactgatcagttaaccaacatatttcaacaggttgacagaatctcacgcaacagtcttctaattggctacactattggtgcacgatacattgcgtaatggtgctacacatatagaaatggtagccaaagatattatattctagtttagatgatgtagtacgttcataatttcgttgatctattaattagcgggagttaatgggtttgtcccatcatcttattcgtttattcttattttttacttctaaaactttttggttgtgtcattgtgtgcccattggtagaggctaaaacataaaccatttccactatctaaaaagccacaaccaaatataaaagttgactttgatttttttttccagagtatagtttattttttatcaacagcctgtaagtagttaaaaatatatttttttacaacaatattttttatcgctcatatatataattagatattgagaaaagggaaatcatattagttggtgaactatcaaggaaacatatgcagttgtcggagaacacagatggaagcaagatcggagacacaagtccacaatggagctagttggcggtactgccaatcacataatgcaacaggtgcatggagattgccggacactcgccctagaccggtatctagttcgtgagatgcagcaagagtgagctcccagatagacgatgtctgcagctccagccggatttggcacgcgcggtagctaatcgtgatgcctcgctaggttccctgcgcttatattgagtactgaccgaaatttgtaatgctttactagaaaatagatctagtgacaagagaactcttgatgtttcccaaccctacatagccacataaccatgtaaacgcattttcggtctggcggtatatatccaaattattctcaactcgtcgcggtatatgagcctgtctttcagcctctcacgtctttgatgtgccaaaagagattgtatatatgatatatatcactactaaaaaaccctcgtaggaaccttataggtgccggtttatttaaaaccgacacctattaaccttttcccacctcccatggtttaaaaaataaagaaccagcaactttaaacaactatagatgtcggttctaagaaaaaaacaaaaccaatactattagtaccggttttttaaaaagaaccgacacctataatatatatatattataggtaccggttttctttaaaaaccgacactgttgacggtacttaaatcataatatttgaccatcaatacatgtatataatgaaataaaatatagtatccaagttagtggtagggtttattactaatcattccactagtgttggtgaaatatgtgtttacgggtattttgaggagaaaacacatccatcatgcgataaaatgcacctccgcgcattcaagacgtgtttacacggattggagggcccatatgtcaaccaaaactacttagaattgggccaaaacgttgtgcaaaatgttgggggcccattaagcaacctaccggccaaaggagaggccaggaggacggtttttggattcggccgaaccaatcctggctcttcccgctatctggcttcatgtggacggcttggatttctcccctatggcgattgcagggtgttttggtcatttcccatgcccctaaacgtcatttggagcctatataaggaagagtccactctcatttcaacacacaactttgagctgaattaccagaggctctattgtatctcttgtacattagaaataggtagagagtgaggagaagctctggaggagtgcccggaagtttggcactctctccgacttcttactcgacgagtgtagcttactaggaggagctttggaggagtaccggagctgtcggtacactctgctccgggttcggagaacttcttctataaagtaagcattcatgatcttttcttatgttatttaattactttgtctaagtaagatagatttccacctttgcgggttcattgtttagtattcatattaagtgctccagtataaggactccggataaagaaggaagttcgcgctcaagtattagagtagtaattaataacttaggcgtggtgtctaggttagagattacctttgtttgttgtgtatcccacggatttgtcagaggtagggggcaggtggtgacagccttgaatcccgtcctagtaatcctccacattcggatacatcatagagctatagccggaaccacgctagcagaccagcaggggtcagtgcccgaagcaacagataggaaattgcatttacttagattagataattaaaacacatagaaagtcctctctagcctacctagcctacatatagttgttgtccttggatcgtcttagccttaggtagattacacacgttccctgagttcgatatccttttggggtcacccgaaggtgaagtgctaaagcggtattccgtgcgcttgtggatttatctgtggtcgtaagaaataccaacagacacctaataatcgagccgagctagcaacaaaacgaaccggtggatctggcggggcccacgcgaggacataagaccacgcgagaagataaggatcgatctctatccagccaggcgcctcctctctccctgtctagtcgccgccccctccccctctcccagcctccgcttccctcccccggtcctccgtgcccctctcccagtcgaccggccatttccctccccctccgccccatctcccagccggccggccgtttccctctagcgagcagcaacgcaggcgaccggcggcctccccacgggtgacggggaggcacagatccagcgcccctcttcctctccctctccgtcggcctcaccggaggcggacaaatctggggagggggtagtttgggtggtgggttgtcggcggcaacggtggccaagggaggcggcgggcgatctccccacgggcgacctctttctctccctctccgtcgggctcccaccggtgccttgcagatccggtcggggtgggttggcggcggtggccaagagaggggacggcggccgatcggcggttggctaagggaccatggcggcagtagcggtagtggaagagacgacatgtgcgttaactacgtacgtgattgcaatccatccatcccctttctattttttcaccttgttctgactctgcaagtgatcaaccgttggtttttacttaagaacaacaaaaaatgtgtgtgtgatgcagtatgatatgatggatgaatgtgtgtgaactatgaatgcagtatgaactatgaatgtgtgtgatctgatggattgcatcaatgcagaaagtggttgccaaaaaatctattagatcaatgcaatgacggacctcaataacttcccaataaggtagccgccaaaatataacggacctcaataacttcccaataaggtagccgccaaaatatagatctttttcttccacatacccttcttgtactcattgctacgatttcttttcttcacaaactcattagtaatgtccttcaccatattgtgtacctgatatccagacaaattctcaggagcagacccaagttctctcttaccattgaaaattttcttctttcttctaaaggtgtggcatagagggagccatctcctatgacacatgtaaactagctttcttgattccttcagccacctactgcgtgtatgttccatagagtcagagcaagcattttttcctttcatggtttatccagaaagattacccagtgcaggataatcattaatggtgcagaacaaaagaacttgtagcttgaagttctcctgaccatatacatcccaagtttccacaccttctttctagagaatctcaagatcatcgataacaggctccaagaacacatcgatatcattgtcgggttgtttctgaccttggattaacaagcacaacataatatatttccttttgaagcataatcatggcgggaggttatagttcgcaataagaactagccaagtgatgtgagaactgctcatgtctccgaaaggattcatgctatccgtacacaaacatatcctcatgtttcttgggtcggcagcaaagtctttgtgcttccgatcgatattcatccattgaatcgaatccgcaggatgtcttagcaaaccgccattccttctctctgtggcataccaacgtactaactttgctttcttggggttggcaaatattctcttgaaataatcaatgattggtagataccacacaaccttcgccggaccacccccgcagtaaaatcaaagtatgtttgattcttattctgtaatgaacaattggcatatgagattattggttttgatatgtagagattatttgacaggaatcgtcatagacatgcctcggccgaggatctgtcctagtgagtagagccgatccggcgacgaccagctgcttcctccttggtggacgccgctgccgtcggagcccttgcataatggaggcgagctcggcgtcgacatcgtcctccccctaggccgccacaccgtcgtccttctccactccgccatccttccgccgccaccgctgctggaaccacggcctctggcggcgggaggcgagctccgtgtcaacgtcgtcctccctccaagtcgctgcactgtcgttcttgtacgctccgtcatccttccgccgccgccgccgcctctaccagcgccgccaccgctggaaccacggcctctggcggtgggaggcgatctcggcgttgacgttgtcctccccctaagccgccgcaccgtcgtcattctccgctctggcatcagctaggctacgcacggtagcccgtccttccgcttccgccgccgccgcctccactcaaggacggaactagaacgaaatggaggagggtgcctcttgcttaatttactctactttagatcaagtttaagtttatacgtgtggctatgtttgtattgagggaggtgcacatatggtgaaaatcggcaagttataactaaaaaattttgttgaccgggttcctgggcagtcccctcccatactctacctccgcccctgcctccactggaggcggcgctggaaccaaggcctctggcggtggcgttgaagcacgggggcgcggcggtggagcatgggggcgtggtgccggcgacgagcgacgacgaggaggtgctgcccgggctgctctatttcatgctcctggcctccatgcggcggcggtctctacaggcggcgtcgacgacctccgcttctttcttccgcaagctaatgagctggtggtcgccaccgtcgcccgctggtggtcgttgccgccgctcctttttgcaatgctctctctccaaaaccgtgctccaacaacgacgggcaatgtttggatacaaattaatcgtcaaagctatcgcattcacaggaattcagttgcttcctcgaaattttgcaagtctattgtgatattttaattcaacttgtgtctgtttgccagctagtttggatagacacatatagaatattcatagtcataccatcagtcaaatgcgtgtgaaggtgtgcactccaccgggagagcacctgcccaaatgaagataattatcccttaattatggagtacttcttaacaagctagatgcaacaatacgtttagcaaccttggtcaactggctgcctgctcctctaaatgttttttttaaaaggatgaactagcatggtgatccgcgcagattacacggctagcatcattatattttctttcatataatagtataaatgttttctcattgtattattaaaatatattaaaatgataacgtaattttaaattttgtactaactttacgaaactactaatgtgtaatattcatattatattttatatgcattttatatgcatgttagttattaattattttaatatcaaattttagttatatctaaattatattcctatatggactatagactcgcctttcaatatttcttttttttattccgaattttcgttatgtgtacattgtatttctatatagactctaggctcttctttcaatattatctatttttaattctaaatttttattatttctaattatatttctatctggactctaaactcatctttcaatattctttaatttttaatttcgaatctcagttacttctaaattctattcctatattaactttagactcttctttctatgtttttttttaatttcgaattttagttatttgtaaattgtaatataaactctaagctctacttttaattttattatgtttattccgaattttaattagttttaaattcctatataaactctgtactctacttctaatattctttatttttaattccgaatttctattatttcttaattgtattatatatggactctatactctacttctattgtactaactttacgaaactactaatgtgtaatatttatattgtattttatatacgtgttagttattaattattttaatatcaaattttagttatttctaaattatattcctatatggacctagactcgtctttcaatactttttttttaattccaaatttttagtattttttattccgaattttcgttatgtgtacattgtatatctatataaactctaggctcttcttctaattttatttatttttaattttgaatttttattatttctaattatatttctatgtggactctaaactcatctttcaatattctttaatttttaatttcgaatttcagttagttctaaattctatttctatattaactttagattcttctttctatgttttttttaatttcgaattttaattatttgtaaattgtattatttttatatgaactctaagctctacttttaatttttttatgtttattccaaattttaaatagttttaaattcctatatagacactgtactctacttctaatgttccttattttttttccgagtttctattatttattaattgtatttctatttggactctatactctacttctaatattcgttatttttaactctgaatttctattatttcttagttgtatttctatatggactgtagtctcctcttccaatattccttattttttaattccgaatttcaactatttccaatttgtatttctatatatatggactctgtttttcttcttctccgattaatatgagaatttctagaccgtgagagcgagcgtggaggctcttttttctattcttttaataagttaatagatgattgaatagctgaattttttgtgataagtattcaatggtacaaagaatgaattcaaaattcaatgcaacaatatgcttcaaacaaccttggtcaactggctgcccgctcctacatccacatgcatgcttcacactgccacctagattaattacttcctcacgaagcaccaagtcttagtcgatcaccaaatcatttgcacgaatatgccttctcccattccttttctagtaaattcacatcaattttaataatcaataatcatccaaacattagtgaaagtagtactatatatatatatgtgtacaaacattacttctgcccaaccacggttagccacatagtagtaattaatcagctagtcagcttacacttgtctacacgcggcgagcggccatggacgcacctcgccggcggagcaacggcgcgtgggagatcaacctggtgcggcggagcccggccacggcgcggaccgaccgctgctcgaggctgctgctgctgtggagcgggttcgtcggcgtcgtcgtcgtgctctacctgttcgtcggccacgtctgggcgtccgtcgccacggcggtgctcctcgccgccgcgggctggttcacctggtactacttcggcgcggcgccggcgccgccggtgctccccgatcatcatcagccggcggcgccggtggaggcccgcgggctcagccaggaggacatcgaggccatcccggcgttcgagtacaggaggggatcatcgggcagcggggtggcgcagtgcgcggtgtgcatcgccgccgtgaaggacggggacacggtgcggcggctgccggcgtgcggccacgcgttccacgcgccgtgcgtggacgggtggctgcgcgaccacgcgacgtgccccatgtgccgcgccgacgtcgtcaaggtcgccggagagacgacgccggcgacggaggaggagccgcccgtgtagccgagcccgcgcaagttgaggcatacgacaagtcaacaaaacatgcgccggaatggaaacgtgtgcttccatccctgcttgtttcttttttttccacttcgtttgactttctgttttaagtgtcagcttggtatagtatggatctgatatagtgtttactagcaaggtgtatatgcgatacaattaacaaaaaagttgtgaaaagtgagtgtcaatggcaaaattacttgagtgtgatatctacttcattttgccaacttctgttatctctttttgaatcgaactattaaagtgtactccgtttctaaatattcgacaccattaattttttagcacatgtttgaccattcgtcttattaaaaacttttgtgaaatatgtaaaactatatgtatacatataagtatatttaacaatgaataattaataattacttaaattttttaaataagatgaacggtcaaacatatttaaaaaaaatcaacggtgtcaatatttagaaacggagggagtacttttttacaacatatttatatagaaaagttgttttaaaaattatattaatcatttttttcaatttgttagtcactacctaattaatcatacgctaatttatcgtgtaaggatttggaaccctaaggttcgaatgaagaagacaagccaatcaaccttagggaaataatttatgcacgtcaggagaattagaaaatgctggtcacgaagtcaggctttcatgtactgtaactatcattgttgaatgggaaatgtatagaaatcttggatacgtatggcctgtttggtagagctctaacttctaaatttagctccaggagttgggactggagtagacttgtggagctgcctaagagcatccctagcagatacgctagccgggactccatccgaaatttggtgcatacgagcgtgaaactagcttccaacagatacgccatcgctcctccaaaaatagcgcatacgccaaaacggcaaagagagaaagggcaaatatagcgtgtctctctcctcacgccataccacatcggatcgagctcccgtcctaatccagagttccgcgacctccccccatcatcgtcgtcgctggagggtggagagagagggtatagcccaggatggagaggaagagccataccggatctggaaggagaacgccgctagcggcagccgcctacgcccgccgccgtccccctgcgcgcgtccgccacctgcgtcctccgcccctcgcccaactgccgccgcctccgcccatccgcggcacctcccctgcctcctccccacccatncacgccc

SEQ ID NO: 10548 - DNA, 8131 bp, Oryza sativa
cccccccccccccccccgtcgccgtcgccgtcgccctgcgggccaccgccgcctgcctccaccgcccctcgcccgcccgttgcagccaccgcccatccgcgccccccgcctgcctcctccctgcccatccgcaccccccgcccgccgccgtccctcgcccgccccgaacgctcaccgctgccgccccttgctcgcccaccggccaccgccgcgcatccgcgtctgttggccgccccatctgccttgcaaacaaaagagtagaagagtagggagagtaaagaagagtagataagcgtagagagaaaagaggtgagaaaataaggaaaactggcagttgaacacatcaaaatgagaaaaaaaatactcactcaatacaaatatatcaattaaaaattaccaactaaaattatatccattaaaatttacttattttgaaagattatcacgatgaataacatcatagtcatccataatatagtccttaaaaatacaaatataaggttagttggagaatataggagggtatgatatagatgatgtagtatgaatgatctgttggagtgagaagagatatgaaggaggaatcttttttagatggccatccatatgggtatatagaagatcaaatttggatgagatgttggggatgctctaaacccaactccacctctctagttcattttgtgagatagctgggttcgctctcattttaggtagagctaaaactttttggctgagctccagctccaagagaggtggacctgcagctgcgctaaaaaggcccatattttttcgcaaagagcaagagatgagaggaccataatggtaggaagtgggtgcctcgaggaggtaggcgggatatatctttatcttaattgcttaaaaaatttgtatctttccaatcatcagacgcgattttggtatgtgttccgattcgcacgcgattggacgaagcagctgccatccgaacgcccggctacatccgttcctcttcttcttcctcgattcagtctgagtaggaagagcgggcgaacggcttcggcgtccgataacataatgtcgatgacagaggcacctcgatgcgctcccgaactcggcatgatggacgaaggcggcagccggagtggggagcgagggaagaattgggaactctggcggcaagaactcagtccggtaggagagagaaaactccagggtgtcttgatgtaagtgggagataagggggaaacggggaaaaaaaatggactcaccggagttgggagatacgctctaggggaggagatcatcgctccagcgaggcggcagcggaggtggcgtgcacacatgccacgcgcgtgtagaacggaggtagttgctggatctcagcttggttgggccgggccatggcatggctgcgccgtgtgagccggaagggcccagaaagtgcagtcagctcagcagggagaaagttggtggaggggatatatataggaggattggagggatttcggcccaaaagaaatagaagatttttctaaatttttagagggatgattttaatctctatttttatctatactaggaaaacaaaattttttgaaatgatccccttattcccgtgtcttccgaataaatggcgagctttagaccaagtgctatcccttaatatccgtgcgcttgcatcggtcaggttaaaacaattttaattgtgcatatgctttgacagataaatagtcaaaccatgacgattccttgaccacaacagtggagccaaatgagaaattaagaaaaaaatatgtatacgctccggctgataaatagtcaaacttgacaattcctcagccacaacggtggaggaagccaaaggagaaattaagaaatcgtgagaccaaattgattgagatttctgggccattttggtttgatgccaaaatgtgctctatcaaattgttggtattttgaatatagtagtttagctagtgtttggtttgctactaaaatgtgctaataaaacatataagttgtcaaaacatttggcactaccaaaatttgcctacgatttgacattgccaatattttagcgtggtagtaaaccaaacaagccctccgacaccaaatcgacgcttcaacagctacataagacagacgctcggatgtgatctatttgcttcttttgttgcaacaaatttccttatatatagatcctaaaaggaaaaaaaagtttctagtgtattaagtcaacaggctcagaacaaataacagaaaaatgccattgtttaaatctttgtatccactctgaacactggtggagaagtggcttttactaccagttcataaccagtggcggaggacggaaaaaaaatgaggtatggctcatggacacatacctaatcgcactatactgtacggcacaacattgtatcaatatttagcatggcaataatctttggaatcaggcaataatatgcataaaatctgaaaaaaaaaggagagcaaggattgattagggatgattgaatcgggaggaaggccacttgcttcagcttaccttgctgctgctgcttgccttccgcctgccacatcgctcctgctgcctgctggctcgccgcctgtcacgcgcgtgtccctgccgcgtagccgcgccgccgcataccagcattggcgcccagtcgccacttgttgatctcactagatggcactccgcgctttgctgcggaaactgcatcggctacatcaagagatattagtttagcatttattaacgtatttcaataaaaatcatcataaaaataggaaataacatgtgtcctaagaaacattttgttttttatatactccctccggtacgttttggacaatgacataatcgtcataatatatcttttttataatatatataattaataaatgtatttttatttttattaagtactttgtaagataaatatatatatgttattctaatgcctctaaactaaatacttttaaagttattgatagttggagttataaagaattgactttaaccatgttcaaaatatcaagaattatagacgatagttttatgatagactactcaaatacttcctctatttcagaatgtatgacgtcattgacttttcgcataacgtttgaccattagtcttattattatttttatatatgttatttattttgttgtgacatgttttatcatcaaataaaatataatacattcttaacttataattttacatatttatagtaaacttttgaatagaacgaatggtcaaatattatgtaaaaagttaacagtgtcatgcattttgaaaatgaggtagcataatgttattctttcaataaaaaaataatgctaattggtttttgcaacgttgagaaaatcgtagttcaaataaaaatgcttaggaataagcaggatcaaattttggtaaaagtaaaaaaaagaatcatattacaactatgaccatggtaaaataaaaccattaaaaatattatgatgatatgatcccagatgaaaaaaaaaattgtgccaatgtgggtcttaatttgttcgctctattataaaaaaaatacataactcataagaaaaaatatatagatatatagtttaagaaagatatacaacgctttcaaaaatggtaataaaaaagagaaagatttgtgtagctaatatgacactgcaatttgggctggccgcctgaggctttgtgttgagagttggcttggacaggatggtgggatactacataccgacgaacgtgatgctccaagagtaatccaacggctgtggttgtaaactgttgtttctacagtgatctgagagagaagatgggataacgtggcaggctgttgcacttgatgccgtacttcaccgagaataaagactttataggatgcggggagctggatgcggatgcctcccgcagttccaagcggccgcgccgtcgtcgcctcatcgtccgccgcggcggcggagatggggaatttctgagctagggttaagtctagtgaatcacccacatatgcccacattaacacaaaacgagcccaatgggcctacgattcagtggagagtgccccagcagcgagtgccctgtcttcgcccatcgcctgacgccgcacttcgcctctgcgcctgactgccgtcagcggcctgccggagttggaggtggagggtgttggtacgagcgggcggcgccatacctcgccctaccgagtcctctgcaactgttcataaccctttgtagtcccagtttttcaaccgggactacgaatccgggactaaagatcgttatctttagtcccgggtgaaataaccgggagtaaaaatccatttttagtcccaattggtgttatcaatcgagactaaagatagagcatttttagtcccggttggaaatagagttaggctagctagatacggttgctccattattctgttcttttcttcattgtttttaatatattgatttcactccatccccatcccaaaatcccaaatcaatcatccccaaatcctcaaatcgatcatatccaaatacatcacaaaatcttaaaaaaaattacattacaacttctacaaaattcatcacaaatacatcacatattcacatcacacacaaatcaaatacatctcagatccgaatcacaaattctcaaaaaaaaacaaagaaacgcccgctgccgcccgccttgaggccgcccggccctccgcccgccggagcgcggaccaccgccgcaccgctgcgaggccgaccggccctctgcccgccggccgcccggccctccgcgctgcagatcaagaagtggggaggatggggggagggaatggaggagaggcaccgccgggcctctgctctgcatatcaagaagtggggaggattggggagggaaaagaggagaggaagagataaggtgtaaggagctagttagaggatacgaggagccgggagttaaagggagagaaaggaggagaggaagagataaggtgtaaggagttagatgataggaggaaccgggagtttaaggagagaggagcgggagggaggaggagacctcgatccgatccgcgtgcacacctctccgtgtatgtcgatctcttttcccggttggactaaagattaaaaagtacctctgagattttaaaccgagactaaagatgtttttagtcccggtttttaatataactgggactattgtgaaatcgagccaaccgaccaaagatggtttctccaccagtggaacttataaatatcggttactcgaaataccaacaaaatcagtaaacagtaggtcaaaggtaagtaccactggtcatatcgtaccaatatttgggccaagttaagtttcaaactttttcttcaaacttctaacttttctatcacataaaactttcctacacacataaactttcaatttttttttcaaacttccagttttggcatggaactaaaacagccttagattcaaaatcttgattgaaaaactaatttatagaaaactggcttacaaaccataggcaacttattctaatctaattaaaatgttttgattatgcatgtgattacttgtagtatgaaaatttctcaacagttaattcggtcggcaggcaccctgggataattgaatgaccttatgaccaaatcaggtagaagcaaagtgcctctagccggacgtggcttgcttgctccctgcaaatacttctgtctgtgctctcttcgacatggcataaactcatttgtttgcagtacatgcccacaagttcttttttttagataatacatgcccacaagttctgttgtcaacaaagtaaaatattggacgagagctttggttaatagatcaccacctcacacacacacgatcatgttcctaaacatcacggcacgaattaactgttgtgaaagtacatgtagcctagtggttgcagcgaactgagtagcaccttaagatccgagttcaaatctccatagtagcgaatttcagattggttatttgagtactaagttcctaatttaaaaaaggttgcatatattcggttggacatagaatttcagattgggttatctgagggaaaatacccttctaaaaaaacatcacggcgccagagtataccgtccatgtccctctcactagggttccccttaccgtttttggcgcggttaccgcacccccgcggtaaagctttcactgcgaaaaccgcgtggtaaccacaagacataccgtagtttcaaaaattgaaaaaaaggttaccgcgcagttttgtaagccctagctctcattacgtgtgacaagaccttcgccggtgattttttttctctgcccttctcgatcaggtaataacatcaagcggctccaatatcagccgaacagcccagcccaccaggcccacattgccaaaaccctaaccgcacggacgcgccaacgcggcaacactgcaccccatccccaccccacacgggctcggcagaaccgcactcgatcggttgccgtttctcttcccgcagcactgcgccaaaccgacagccgccgcctcctcttcgcaccatatgccactgtcgcgccaacagcacagcagtctcctcctcctcatcctcatgccgcgccgccatcactgccgatggtccttgcgccgagccatcgactgcaccctctccacctcgccgttgtgccaccgtgctggtcaaagcttggcggtgtacgatgagggggtgagccgtgggcgctgggccacgcccgagccaccaatggtcgccctcctcctctccgttgtcccaccgtgccggctattgcccaatggcatgagatgcgggcgtagactatgagcagtataccaccaccgccaatgtttaccgtgcccacagtctcctgatctccttattccttctgccgattgcaatttgtgttcgatttatgtgagttttttcttctttttttttttgatttgtgcgatcttcttttctctctttttcgtttggtttctatctctcttttctgtgttgattccttactagatagcgtccctgttttttatcgagaatgctaatctgcgaccagtcgcgtcacgcgcggagaggggggcggtggacggcgcgtgatttttttgggggaacgttttttttttctttctatttttctttctgtacgagtttgttttctttccgtagtttacggtttccttttttttcgtttttctttctgtatcttacgatttccttttttttgcttttctgtttttttcttttcgtattatttttaggttttttttctaatatgtatatgcaaactttatatatgtacaaatacaaattttgtatacacgaatacaaactttgcatacacgtatgcaaagtttgtatacatgtatgcaaagtttgtatacgtatatgcaaattttatatatgtacaaatataaactttgtatacacgaatacaaactttatatacaaagggaacacccaattgaaagggagctaggggttgatgtggatcagcatctagcccgacagagtctcacaagggttgaggagatggggaaaactgagatgggtaagacaaaggtggcactcagatcttgaaggagggatctgaatgtactttacaggacttgatggaaaaggatatcagacagctagaagctattgcaaggaatggtgagcccaatgctgctgaagatggattcactcagtcagccaagaagagaaggaaaaagaagaaatcgtctgatccagcggttgcaacaagacaaagcatgagaattataagagatggtgtaccggtggctatgaaggcccagaagaggacatctgaaaagaacgacatatcaggtaccaataaatttgcagttttcaactcgttaagtaatgatcatcttgcatctattgctcttgattctggtattgatttaggagataaccaggatactatctttaataatattcaaactttaaaagcaaaggagctagcacagtcgctaatttgtatggcacaggataggttagataagaaggtaggggaggaaagattgcctgaacatattgaaattgaaggttgtgtgtcatcccaagatgctaggggcagagagccgtgtgcacatgggggtgacagcaacaataacacaaatcttgaatgatgaatatccttttctggaatg

SEQ ID NO: 10549 - DNA, 853 bp, Oryza sativa
  unsure (1)..(853): unsure at all n locations
cagatcgtacagtagctcatcatatttaataaaccctttaagaagctcttaaaatgtgcactcatattttctggatatttcacaggatcctgccacgacattatatagaccatatgtcaattttgacaatgaagataaggtatttgaaaaatgaagtcaatgagccaaccttgacaatgtgccgtataagtgcatagactgaatttgtataaaaagggggctgtccaacaaatagttcatacctgaccaaccaaccagaaaagttagcttgaggtgtcaggcaagttggaagtggtggaatattgttttatatataaaaaagagcagagcaatgcatttgccatgatcattttctagcagaaagccaccaaccttgctatgcaaggctaagtaagggtgagaaagggaagcaaatatacccttaagaaacagattaagtagatgagtttttcattgaaaaattgtgcatggacatcttctaacatagtaaactaaagagaagaacaaatctaggcatcatggcttgcaatttatgtacatttaatccacaaggagtgttatgccttgcttacatcatctgggaacaactgggatgtgcanactgtattgcgatgtaaaaatgaaatggattgtgggtctcactcttcaaatcatgcatgcgctagagaatgtctgaatcaaagaataatatggtggttngtctattatctctaacgtgggtgtgctacagctagccatacagtacacaaaggaacaagaagttgcactcatgtcaaaagtcatgacagagatactattagtacagagcatcgtcaaaatagagcacatacagatgacgcaggacacaattgtg

SEQ ID NO: 10550 - DNA, 6420 bp, Oryza sativa
atgtctggaatcaaagatatattatgttggtttgttctatttatctctaacggtggtttgtgcctacagctaagccatacaagtcacacaaaaggaaacaagaaagtatggcactacatgtacaaaagtcaatgacaagagatacttatttagtaacagagcatcgatacaaaataagagcccacatacaagatgacgccaagggaccacaaatctgctgtgtggttgtaaggttgttccctcacaagttctggagccatgtatagaggtgttcctgggtggaagaagaatgtttagtagaacaggtagccagaaaaaaggaaatcagttcacatgagtatacctgagtcactataatctatgaaaggaccagaaaggggaatgtcaatcaaaagcaggcatcatagcatttaaagtattggtttgttatgaaagaactgtttatgattattgtaaagtaactaccatatctactttcaaaaacaaacctgttggaagacagctatgacatgtattttacagtttatttatccttaatgattattattatttcaatatttgggaaaaacagcatgttaagtttcataccgaattgccagtagctaatatatggatagaggaatggatttacaagactagaaggcatatagtgctaaataaaaactgaaacatgctaaaagacacatacagagaagtaccttccatagaacgtaaaacaacagtactaccatggaaagaagctcaactatcatgcaaagatgaaaaggtaccttttatagaacgtaacacaacagtattagctgacatggcacgagcaaacccaaaatcacagagctgggaattagaaaaaggaaatgcaatttaaaacaaatatatatagtaaataagaataaataaagcaaaacagtacgcagttgtgtcatatactcatatatagtagcgatcaactcccggtgcataaataggactatgaggtaaggattgtggttattgagacaagacttcttttacaaacatgaatagacaattagaaacaactatgagcatcatactgtgaagctagacaaaatcagagaacttaaaaacataggatagtgttgctgcaagatatagaattaggtgcaatgtataacattttcgatgaagcaaatagtctgcagaacagatgatatactaaaaggcattacttttatctaacaaaaagtgtttagctaatagaacaagcagccattggcaacattgatgtggcaaaatatataccttgacaacagatcctttcccaataaggatgttctgaggtttcatatcccgatggataatacgattggagtgcaagtaatgcagtgccttaacctgaaataaggagatttgctgaaatgaagacaaccagagaagtccagtagtgtgtaagaaacaagaaactttttagtgcataccagctgcttagcaattgcttgaacctgttcttctggaaggcacttatcatcctcaagcacctcaaacagctctccctgagacaaccattatatatgaagtttaaccaactaaattccactgcaaaaccaattgttggtgaaaactacactgaaaaatcaacctgtacctgagcaaactctgttaccacacaaaattcctgaggggtttcaaatgaatcgatcatttcgattatattctcatgtttgagtttcctcagaatctaaaaaaatgatggcagcaaacagtaagatggaggaagcgccatatttaagatatgtaaacaaaataatttctactagtttgaagttctagctacatgagaaatgtcttatggcgaactaaatcaaagcaacatttgtgatttccaaggtgctgtatatattaattttgcattgttcagtaaaccatgagaaatgtcctgtggcgaactaaacaaagcaacatctgtgattttcaaggtgctctatgcattaattttgcaatgttcagtaaaccatggggggagctcagccgtatcccacaataaattcatcctcaaaatcaaattccatccccattgccaccttaaaagaatccaaaacaggcatttgaagatttccgcgcagattctagcccccaagggtcaagggttaattcaattagcactaaatatcaaattgcacaaacaaggcatgagacccttgacgtcatgagtcctcagagaagcagcgcatctcccgggagcacttgcaagtagagatgaaattgaaacattttattccctaagcagaatctcaagtagataaattaatagctacgattacctcaatctcctgccttagattatgtatatctttgtcagtcttcccatgcttaaggataaacttcatagctaccgtctgaaacaaatttaaacagaagcaatcaaacttccgagcaaaactagcagaaaaaaaaaagaaaaaagaattaaccattccatttcaccgtacgagcggaatccagagcacgaacctggcgagtgtacttgcgccttcccatgtacaccttcccgaaggagccctccccaacgagcacgatgacatggtaatcttctatccccatcaccacccacccactaggctcacacaaaccctggtagcaatccacaccgcaacgattaatcgcgcgaaaatcaaagcccaaaaatacagtgaaggtgggggaaaaaaatagtcaccggtgatcgactaccgcctccggagcagcagcccgggtgggcggaaccctaccttcccaacgacgagacaatcgaggaggttccagtcgagagggggacctgattcgtgcggtgcgcggcgccgcgcggccgatgggggaagcacggagcggaggcgggggatctcgcgagagcagaagacttgggggcggatctcgtcgggggctcgccggagatcgccggatccggccgccggaggggagggggaagggaggagctcgtggggggataaggctatgggctttctctctctacagggttgtgggtgggatattcccctcaaattctagggtttcaattattttcccgctcgctgcgcgaatttggaactgacgaactaggcgtcgcggatagagaggacaaagctggctaacggcccacttcttattgggcctagtaacggctagtttcagtctcacctgcatatttcacttggaacaaagtcaattaagtaacagaattttttttatttataattttttttattaaaagttttacaaaaataattttccattttgaaaattgacggaagtagtcgcctactgccctctgggaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctgggggagggcgattttataatgtgctctatatttttgtataaatatcaatagttatcaaatctttttatattgaaaactatacaagattaaaatctccaagactggtaaaatacaattttattattttttagggcatatttggattgttaccgtacaaatattttattagtgccaaaatataagcaagttttggcactaccaaatatttggtaaggcaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggtgtgagacgaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacatgcagttaaaacatggtgacatattcgtgcaaaagctgaaacaaaaatgaactaatatgtgggctgaactgtaccgtgcgaaaccggtgctgtaggtcgcactgctccgaagctaggggcgctcgaaggcaaacgaggtcctgcgagaatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaacgtaccagcgaaggtagtcacggtagttctcctccgtgtgtgggaagagctcgttgatcacctcctctgtagctaacacccagtcgtcaacgtactgctgtacacgtggagcccaaagtgcgactgctagctgtccccgtcgagtcaacctgtgaagagaggtaaattatatggctcgatgaagtaattatcataaaaatttagaaatgaacaattcgaactcacgagtggtcggcagggaggacggtcggctgcacgtttcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccctatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcctgtgggtgctagtgaacatcacccacccgaacaaccacaataggtacgcctcaagggagcgtcggaccgagtaatcatcagcgtc

SEQ ID NO: 10551 - DNA, 1509 bp, Oryza sativa
  unsure (1)..(1509): unsure at all n locations
ccaagccttgctaggcccgactgtagagtacggaggaagggtgttggccggttctagtgtggaaggcgcatcacctgctcgaagcgggtagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctacatcccaccgcttcgctgggtcacggtcgtctgccgctgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggcattgcgcgcctgcttgttgttccttcaccaggtggtcgcctaccatcacttgcctggccagatggactagcatctgcgccgcttggaacttctgcattcttcgggcatttcttgtaagtatggccgcgcagatcacacttgctgcagtgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10552 - DNA, 426 bp, Oryza sativa
cttttgatcgatcctgaaaactaacagaggcaaaacaagtataaagttattgatagctgtctgtggtagtagaaaatgatattttggaaaaaaaaggaagaaacatatataccagatcttttaatgtgctgacgagatctttttttgtgatgtatttgtcagaatcgctggtttcttcctcttctgaaatagagttggcataatcggaatctgccaccttgttgtccgacttgctatttgatgaactgtcgtcatctgatgatgtcatgtcacttgccatgctggaaaaaaaagaactagagaagtaagtacattaaaaggaaaagagagggatcttgtcaaatgtcttgatattttcatgtgtaaccaatcaaaacaaaaaaaaaaactctcaatgtcctgataggctgctaagccacatgttaa

SEQ ID NO: 10553 - DNA, 16674 bp, Oryza sativa
  unsure (1)..(16674): unsure at all n locations
cacaaaatggatctgacaatgctgagggacaaaaggtaagagcatttgtagggatttaatgaaaatattggttagttgttgagctcaaattgctaccaaatccctaaacccctctctaaaatgccacggcacagaggtcatcactggcctacaggataaaaacgactaaatctagagcaaaaccatgtgtgtgcctaacaaatgaagttagggagaaaaataattagggagaaaaaactaggcagaggcacagcccacctcccaccgactatatcataaacgatgtgcggtaaaaaccctaaaaaaaatttccccaactacaccaaacaaaacatcaaagcacacacatcatgtgggtttcagatctagggatgctttgctcgacattggtccccccatcccgccccctgctactcgtgccctgcaccaactacgccgcacacgggttgatctgttgggtcggatcgtgggttttgttggcgacaaaaaaaggcccacggtctccatgtcttttttaatttgaacaagtatatatattggttatatggaatattttgatttcacatgatgacttaattgttcaaaaatctgagtagtaaaaatatgtgtaaaattatcaagatgctgcaattgcatacaaatctatcgatttcttcatttgcaattatcaaaaagatattggaaaattgttgacctaacttgttctgaattgtgctcccaggtaatcatgaaacatgcagctgttgtctaacaaaaaaaatcataataacttcaaatttcaggagacgtgcaggagtctaaagttgccagatggctggagaatggcatggtaaataatccttaacatatgtttgacctccttaacatatgtttcatgaagaaaaaaaaattcagtaaaatgatttaagctaatatctatttgacctcctctagacatagcttggtgttaacgttactactcagatatatagtcttggttaggttcacaactagtttcaggaaactgggtgttcaggtattaaatgacaaaaaatataatctgttgtgctgaattaatttttcctctagtctcaggagaggcactggcgtgtgggtttggcaaaaaagaaagctgaaaggagttgatattactcgaggtatttgagaaaaaaaactaaacaaaattatacttacatttgactgatatgaggcatttaatcttgcccctgcatattatctagattaacataaataatatgaattggcacacaaatatattgacctctgaatcttgtacctctgctatgtcaggttttaacaaagtacacatatctgaatatgagaactgtaccttgcagctacaaaacaaactgctacaaaattgcagctagagttcagacaaaattaactattgacaactatctctgtctccaatgacagaactgcttataactatttctaaaaaaaatgacaaaacctatttctctatacattatgtttcaagttgggagcaaaaaactgaagtaagcatgttattcctctaattccagctcggatggtctgtctgatgagtactccataatgagaatgacccaatggtaagcatgtttattcgcaaatttatgggctatatatatccagttattcttcataaatggggaaatgatttacatcaaaagaaaataattagtgagaaaatgaagttagggagaaaataattagtggcaaggtttagaaccaggcagaggtgcagcccacctcctgccgactatatcatacgcgatgtgcagtaaaaaccctaaaaaaattttccctaactacaccgaacaaaacttcaaagcacacacatcatgtggtttcagatccaggatgctttactcgacattgggcaaaatcaactcaaaaacatatacccagtaaactccaaagcatcaaggaatgaaaaaaaactccgcgggattccccccccccctcccttgaaatggtagccaatccagccctaaacaactcacaaaatccacatgatagaaaatctgaagctgaggggatcaggccgtcgcggtgtgagatttgaacaaaaaagagagaagaaaaaacctgaagtgcctcaactcaagcgcgctcgccttcgaaggcacactcgcggtgccttccccggcgccgtccgcggccgctcgcggtgcacagcccacctccctgtgccccccctccccccccccgccttccctttcacctcctgccttggaagaatctccggcaccttccgctcgcaggactccgcctccccctgctcgagaaaaacacaaatgctatctactcgagaagcagaagcgctttctagatgagtcacgggtgcgggcggatttttccagagctatttgtgggctgtgggctgtaggctgtgggctgtgggctgcggactttgggcttattagcaagggaaagatgatggcgcgcacaaaatcaagacacataatcgacggtcgatgcgatcgactgatggattaaaatttgaatttggatctctaaactgggtctctaatcgggctctccaacttgaagtacgtccatcagcaaactaatcagacgaacatgccacgcgagaaggcattcaacctgatcaagccccgcgtgcatgtacttacggaacgtgaacgcttggacattatcgcgcgcggctgatcgttgttatttcctcgtaaaaaactttgaaagtgagacaaccttgaatgcgataatttcatgttcaactaatgccaatatttgtaggcaatacgattaatttctttgcttgtcaataatacatgtacatacatacacacacaagcgtacaacaaacaaaaggtgttacaatgcagctctgaaccctcatcgttcatgtccgtgcaacgaagtattgcactcatgctagccctagctttgtctctcctaccaactaccggcgatgtcgcaggctggcactgtcggcctccttgaaccaccggtgccggagtgcttgcgccaccgtcatcctcttctccgggttgcacgtcagaagtccactcaacacctcgaacccagcctccgacaatggcggccggcggagcatcctggcgtcggccggagatgggaagaagccacgaagaaagctgtccggcccgcatcctcccagcagccgctgccccttgtagcctcgccaccgcttgatgtcgttcacgccgaggacgtcgacgatctcgccgagctgctccctgtccgagctcccgcggaacagcggcttccgggcgaggagctccgccatgatgcagccgagcgaccacgcgtcgacgcgctcgtcgtagtccgtcgacccgaggaggatctccggcgcgcagtaccaccgcgtgccgatcgggttggagtagggcggcggtgaggcggtgctctgcgacaggccgaggtcgcagatcttgaggttgccgcgcgcgtcgacgaggacgttgtccggcttgaggtcccggtgcatgaggccggcgtcgtgcatcctcttggcgccggagagcagctgccgcatggcgacgcggacctcgagctccgaccgccgcgtcctcccgccccgctcgcgcctcaagacttgacgcagcgtcggccccacgaactccatgacgaggacggcctcgccatcgtcgcatcggccgtgcgcgcgaggctgcacgatgtaggggtggcccctgcacacctccatggcggcgacctcgcggtcgaagtcggagcggtcgacgagctccccgcagtcgtctcggtacgagcggatgcacttcatggcgacgatctcgccggagcggcagtcgcgcgcgcggtagacgacgccgcatcctcccgaggcgagctcgtcgagcttgacgaagcggcttgtggagattatggatatcccatatctacacggcgatggtatttgggctgaatacaggataccaaatatagatagaatatcttatttgtgtctcgggtttgtttctcaacttgtacatcaaggaaataccttgagacttagtcggctacgactgtattttatctgtatctgcctattccgttagggatatagattatcttttgtaacacggactccttcccatatataggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggtttcgtctccggcatcgacgacctcgtcttcccatccgggcagacgtttcggttcggcagcctcgacttcgtcaccaacaacttcggcaagatctctctccttgactcggagtcaaaccagccgggagagaaccggatttcagtcccgtttggactcccaaacacggctgaaagttacttcaagaccatctcaaccgagtcggcttcaaaccactcgggcgagatcgcatcttctccaacgtcaccagatcaagatgatggggcttacccaccgatcctgatgaggctccccgacgatttggcggccatctccatcacgacagcgtctctatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgccccaccgacaccgtggagtatgacgagtttagctctcgctacaacgacccggatctcgacgacttcgacggaagcctagatgacaactacacccctctctacttcggcgtcttcatggccgaaaacgagacggaggagcaacgccaagcccgggagaccgaagcacgtcgcgaaactgagcgtcgccgactggaggaggagcatcaagcacaaggacaagaacgactacggcgtgagcagcaggagcgtgagcggacagtgaaggaggctgaggatcgacggcagcgagctttggaagcagggcgccgagcgcgtgatctcatcggccaacaagatgttgaagggacaccggttttccgcacccctcagcagaacacggttgccgcgatcactctcctcgacaccgtcctcaaggaaaacgagctcaatcaatctaatcacgtcgtcaacatcttgaaccagacgaagaccatgattgcggcttcagtcccagttaactctgaaagcatccacacgccgactggcagccgggtcccacacttccgatctcatgattaccgtcatccaagcctcagcatcaccggcgcaggatccaatcgcaggagcaggggtcacgacgagcggtccgttcactcacctcccgaccatcatagggagcgccgagtggaacggcctcactcaccacctcatcgccgccccgtcgatcttcgcgacacaatcatacagcgccgagcagctcgaggccatcatcattcgccagaccgccacgacgacgaccttgacggagtaccagccttcactgacgacctgcgtcgagtggattggccagccggcttcaagccgactggaatagagaagtatgacggtaccactaacccagaatcgtggcttaccgtctacggtctcgcaatccgcgcagcaggaggagacagcaaagccatggcgaactatttaccagtggctttagcggattccgcccgatcttggctccatggattgacccgtggtacaattggatcttgggctgaattacgcgaccacttcatcgccaactttcaaggcaccttcgagcgtcccggcacacaatacgacctctacaacgttattcagaaatccggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaagacagtcaagcttatgttcgaaaaagccaacgagtatgccaaggccgaagacgccgtcaccgcatcaaagcagtcaggtcccagttggaagccaaacaagggtacgccggctaagggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactccgacgaagaacaaagtacgtcgaggaagaaggatgacggcgacaccccggcaggatttcaagaccaccgtaaggagctcaaccatatctttggcggtcccctggcttatgagtctaaaaggaagcaaaagttgactgaacgggagatcaacgctgttcagcccgacacgccccattatcttcgatggtcagaaattacattcaagtttgaccgctcggatcatcctgaccgagtggtccacccggggcggtaccccctggtactagacccagtggtccgtaacgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagtttatggtacatcggaggaagacaagagtactcgggaagagcaggctcaggattctgaacataaaaccagttcgcatgccaccctttgtttgaagtcttgaaaggcattgagaagtacttctggctcagagtccccctcagctggaatccggccccgccgactacacatggcttactcttgtttggttggggtttgagaaagaagattcggcgaaacagagcaaagtggggtttaattcccaagaaggcttcacaaacatggatgaaattggcgatgtggactatggaatttggatttaggtgatgcaagctgattccatagaagcttaatatcccgcggaaaattttgaggtcggaagagcgaagccgccatagaagaaatgggaaaagactacaacctcgtgtgtatcgggggacggaaaagcctcaccgcacgctggccggcacccgatgatctccttggcaggaagaacgccgtgcgccaccatctccttcaggttctcctccgtcacgttggatggtgcccattggccttcaaagctttctttctcttccgccatcgattttacccgaatgcactgatttgattcgagggatggctagggagaggtgagggattgaggcggtggatcacgggaaggattttgatgaactttttgaaggtggattcgagtggaatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagcccaatacttttgacagcgtggcccattgtgttccttagggacttaggcattttttttgctttggcaatttatgcgcacaatagtgttgcccaatgctgataaaatcctttttatgcggtcatataattctttggaattattgcaatgcaaattaaaaggtgcccgacagaaaggtgttatactgttttttgtcagctttattaggctacaaaagctgtttgggttaacttggaatgacttgtttttaccatagtcatttccttggtatgttatatgcctgctttctttatggtgaatagtcatagcctaggctattagacttattcattaccataatttttataatatttggtgggtatctttagagtttttattcggatgcctgtcaagtgtgttcattcgtgaaccttttagagtgtaaccactcggattccttttattatggctaaaaagcagtcggctaaaatgcctctttaggcgccgcgtatgcttttgtcatatgacgcacgattgtgctattattttgttctcgactatatgtttagtttgttaactaatcacatagttgggggctacacctaattaggtgcatctattcgatgcaccatattctttgtcttttcgccctttacagtctttgtcttcgccactcggcaggccttggcatgagaagtttgaagcactcggatcattatctttgagaaggctatgatggttgactgcaaaggtcgtgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcctattccgttagggatatagattatcttttgtaacacggactccttcccatatataaggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacacggctgatcacgacggaggaggccgtcgccatcgccatggccgccgagataggtagcctagctagggttttcttttccgtcctctttctttcgtggcactcgagtcgatatgacgcaaatgcaaacgggttcaggaggagagaggtagcaatctatttatggctggctgggctacgcacgtgcgtagcaacatgagtccgatgcggtctcgacgaagtagtcttggcgcgaagccgcgaacgcagtgatgctcgcatgcacacgtattcggactccgagttgaaatcaggggattgatatatttggtgacagagatatatatgttccatttcatgtgtaacgcagctaaacaaggtttttacacgtgtatgcatgcatccgtattccgtgcgtcggtgcgtgcaatttcgccgtggcctgtagataactagcgtgcgcgcgcgtgccaattcatttcacttcgggtttccgaatatgcggggacgcggccgctcgaccagctgtgcaaagggatgaaaacggtcggaatcggtagcatatctttgaaaacgatacttgatcggccggtaattgaccatatttatcatttaaactattgatcagtgtcgacattaatacgatgcagaaaaaaatagaaaaaaacaaaatttaaaaatagcaaaaaagggtacgtataggcggaaacggtaccccttacacggaaacaacgctcggtcgattgggaatttccatgactgtgtgagtcagcctgtgcatatgtagagagcggcgatcgcgccggcgccacttcctggcctccgcatttcgctctcaaccacggcaccaccacccgctcacgttccgccccgcctctcctaggccgggcccacttacatctggtagcttttataggtcatagactgccctcacagaccaacacaagtctttctgcaaactttgtcctcactcgtgcgcacccgggaagattttcccggtcggtcacccatccctaaattgctctaggcttgtcctcactcgtgcgcactcgggaagaatttcctggtcggtcacccatccctaaattgctccaggccaagtacgcttaacctcagagttctttagagatcggcttccagaaaagaagttgcaacttgttgatatgagtattctattaatcctattaagccctgggttaggatgtcacacctccgcttctatctggtagctatgtctcgtgctgccatggcgccatcatccccttgctccccagcccgtcccctccacgtctatctagcacctgcgccgcgcgacgccagggcgccactacgcccactcgcgctccacccgttcacgcccgccacctctgacctctgtgtcacacctccactgtgcgcgtcaccaccgtgccactaccgcctttgtgcagtcgagcgctatatacctgcacctgcgcgacctccatcccattcctgtgccgcaccacgccctgtcttgtccttcggtggctagcctctgctactctatcctccccttctccccatcgtctccatatctgaattgtaaagctttgccaaaagttcatgttaatttgttgagtaaactatatataccactggtccttcaagatgaggccaagtgtcacttaagtccacaattttataattcggcatttagatccatgatcttgtctaagtgaataatcgtgggtccaaagcccatttgacaagattgatttgcctacgtggctccattgtgaccgtatctttgcatttaacctcctctgcacccgatcgaccaacttctcaccaaatatcccctcttctttgttgtttaaatttagggtttcagcggcggcaataggggcggtagtggtgatgtgactaggacagcaacgacgagggaggtaggtagggcggcgccgacaagggtggtggttaggcggattcctgaagcatgccaataggggaagccaatcagccatggctactttaagcaacgggtcttttcaagtgcatagaggaaaaggatcaatctcccgttgattatgtgcccttgttgccttgcaaaacacatctccaaacactgcggaagcgcggacagcccacaatcatcatcgcagcccttggaatcattgcaatcatgcgggggtggatggttgagtgttcgacagagcgtgggagcagtggccacaggtagaggggatatttggaggagaagtgggtgactaggcatgaaagggactaagtaaaatttgtggtcacactagacagccacgtaagccggtgaacccgatcagacgggctttggacttatgatggttcactaaaacatgatcatggacatagaggttgaatttacaagattattaacctaagtaacatcatgccctaactttatgaatcggcggtgtattttactctaattttttagagggggatactaccaagccttgtctcgtagtgtaactttataactacaaataaaacagagttttacatagcaaatacaaaagaaaactaataagcaattacaaatgttgtaatcaatcagcaacttcctacacatacataggagaacatcattccgaaaagcaaaccaccagctatcaaaaatggagtaatattttcaaaactcttcccattttttcttccaaatgtgccaataggctatgaagaaaacataaaagaacccttttcgcttgaaccgaagtattgctaaatccactattttaaaaaaaaattgaaacggatattccaagggatacccaacttctttcagcaccttttactgaaaggacggcttgtttggctgcaaggtacaacactgccatacaactgaaccacaacctattgatcatttgtttgctgcatggtgtaatacccggctggctgtatggcaacactgcactaggcagccgaacaaagccaaaggaaatacagatgcaagagagtttccctttattgtgtagagcaaagaacacaggttaagttagcgtgaagagaggtacaattctttctatcgaacatgtcccttatgttaagacggtctcgaaacaggagctagatgaaggttttgattttcatcccacactcagttttctataaccacaagtttctcttaattcactatcttatatcttacatttgtttgcaaatttctgcaagtcacattaattcacgtttgtgtggaagtttctgttgatatttctcgcccttctgtttgtctctttttttttttttttgctgccatcgcatctgaaactagaccgggtcaacccaccataggagcaccatatatgagttagactatgagtagggttagactaatgtgtgggtcgggttgactgatagcttgcagttttctgcccgattcaactgcacccctaaatataatgacagagccagaaagatttttaaaaccgagtaaaacttaactgtatctagtatttcttacagagattctatggttatttcagttgctaaaaattcgttggaacgtatgatggtcaacctgggcaagtagctgcctgtggtagccggacagtggtcagtggctctgcctcaggtttggctaagctcatattttgtcggcccactactcaatgcatacgaaccatggcatctgggcctaaggcctggagggacatccttaccattttccgatttacgtacattttgctgtgcaaaagacttactccgtaactaccaccattgcagccatgagccgtggcagctaaaccaaagcatgcagtgacgctgaactaggttggaacatggagaccgagtcttatccataattaatatcctgtagcatcttgttcatcctacacaagctaattttcttgagggtaattaagtctgattagccctctaaacttttgcagacgtttgaattacctcatctattcctataccagatattaacatccaaactattgaaacaagacgaaatatatctctctaacacaatcaacgtacagtagtttttgagcctagaaaagtcaacaaatcagtaaaaaaaaatttaaaaaatcttaatctctctctctttcttactctatcgggcagcaggcccatcgatatctagaaagacgaaatgagatttttttttacggtgtttgatctaatggtccacaataaaaggtatcacttaaaagatatttaagtattgatataggtacttaggtagtaagggtaaaatgataatttttctaagaaatagagaagggcataattatcttcgtattagttctaagtacataagtgccgcatcggtaccttatctccagtatgcctgatgattctccatacattatttacatgttgtcttttcagatttacattcttttcctaagaacatgatcaccggtaatcctccattccgatatttacgtgtttttttaatttaccttttctccctaagaacatgatcatgatatttttaaggttgatgtcatgttcctaataataccatcagataaaatatgactgaatgtttgcgtgattattttaagatttatattttatcacaagaaacatacaacctcggtaaatcaccggttgtaggttcaaatgtaattcatcgtcaatatgctatatttacatggtttgttcaactttgcatattctctccgaatgaacatgaacatagatactataaattcaaagtacaatcttaaaacaaaaaaaaatcaaagtacaacatatgatagtaagtgaagaaggaaatggatcagatatgttttttttttatcatgcagccatgttgtttggggcgaaaaaatgtgtctttttttattattgggttgatcagagtgcaatcgctacaattgaggaaattcttttaaaaagtatttttctctttaattgtacggtaatcaacaacgttaattactgagatcctgatcctgttctcgcatgctagaaattaggggctaatttggttattattgtttccaacttaatcatcatgcatgcatgtatgcatgctaaaatttaggagctaatttgactgctatgtacgctactttatatagaaacacgcatgtccacttaattttaaatttgtgatgcatgaaaccacacaaaaatacatattcaaatattataaaataataaaatttatttcgaagacaaaatgtatgggaagatttatattttctccactgaacgatacaaaatgtattggagacaaaatgcctcggaagattgacatatttttctactaaacaataccgatcaattcaatttcagccaggtatttgagtaacccaaaatgccaatattttactagataattacttcactgccatcggttacgataacttttattccgtaacttacccttctcttgatcaacggttcatattgatctacctctcaatacctctagatacctcgcaaacactgtaaaagctctcaaagagtaataacagggacagcatacggcagccatgagaaggaggaggacccatcggccacccgcctgctacaacttccttcgctctacggcagtacgccgtacgcatatcggcgcgtcggctctcctccgccttcgcggcggtgttcgtgagagtggaggtgtgcaggcgacgatgcctccgatgcgacggccgaaaattcacggtggcgtacgtcgagttgtgacagcggacggcaatgagggcaggcgcgtggtcctagcagggaaatgtcaccggcggcccgacaccatgaggaaaagagagtgatgtggcctccgtgctccgtgcttcatgccaaattggatctgaccggatgggagctaagctccatgcactcccgtggtggccggggtgcaggcgcggcagtgtttgggcagccaggatgagttatgactctgcatcggtctctcagccatcgtctccgctgatgatgattgttcaattcctcttcgattcccctctcccagcgaaggcgccagcgctttctcccccgaccctctcccaagcacaccactgccagactcgagacacccaccattgagacgtaagtaggtcaaaccacaaattagtgagtaacacacaaattgatcgatctgtggttatctactaatttgatctataagtgtgttcacggattgacccacttacacttctagatacagcaagccaagccacgatatatgaacccgttggttttacccacttatatattttacttataagtgccttcacgggtcagtccacttacacaaccagggttgtgggatccaatagcaaaaataatctggcctacactaaaatggatgtattttggatagatatttcggacgaattttaatcaaatatgaacaaaatttgaatcaaatggagatgaatttaggggataatattgtctcggacctcaccgagatgggcaaatttcaccaaaattcggatctttcggtccgaatcccagaaccctgatccctatttccccattgggctctagcctcaagcccttaccgtcgtcaacactgaagagagcagggaagtggggtgaagaatgacgagagagaaagacatatgcagctagctattttttttaaaaaaaaattgatggctcattctagcacatgggaccaaaaccaccttataaacagcccggcgtagattaagggtgaaagatcgatctgtgaggtcgtcacactatcttacgccgccgttgatcgcttgccaatgaagaagaatanccgatttggtgctgcgggcggacatggcaactctgctgctcgtgggttccatcctgctacggacggtcatggcaactctgctcgtgggttccatcctagttttggcggcgggagtcagcaaggtggtaggcaccgaggttgagaaagggtagggttcgtcggttgaggtcgccatgatcatcctcaaggtcctcaaggtggaaaatggtttgcaagtgggcatggttggaacaatgggttcgggatgaatgcaggtccgaacgtcggcaatttcagtggtggtggtcagattggtttcaatcctaacttagggtttcagccacagtttggtgcttccggtagccatggtggtaatccagttggcccttttctgccatcaggtgagcctgtgaccaggggttcatctgtagttggtggcgcattccctgtgggtggcggtgctgctttggctggtgtgtctgtccctgtgccggctggtgctggttgtggtgtacatgcgcaagctggtgctgcatatcctgtgggtggcggcggaggttctggtgctgttcttggtggagatgcggtgcctggtggagctgctttttcagttgctgttgcttccttgccgaaggtcgggggagttcagcctagtggctcagctaatgccgcatcaggtggtgcaatcgctcaggtaactggtggttctggtggtatgtaggggcaaggtgttgccggatcagctaaaggcaagattggtatggatgcttcggtaggtgggtgtattgctcaagtttcagatagtactgtcaagggtgtagctactttgggtgatggtaagggctctactgctgttgcttttggtgcagaaggtagtgtactctcccagatgccaggtgatttgtataacagaggaaaagctaaggttgataacaaagggttaggtaaaccatattgtttcaggtgttacactaaagggcatacaatgcaagaatgttcttccaagttatactgtgaaatttgtgaatga

SEQ ID NO: 10554 - DNA, 571 bp, Oryza sativa
agctcaaagtgaactgggcaaagttgtttatgaatggcttatgacatacatagcaagttcaaaaagagagtaatcaaaggacaaacatcaaaacccttgccggctgcggacactaacttgctgtatgcatctcttttttattattaaaaaccctcttaagtcattttttatacccataatatttctaaacattgacttattctttttcttttgtgttgttcccttagattaattatcttgattccaaagattttggaattagaagtattccaattggtcccccaccaagaatctctgtttggaaaggcggaatgataaaagagtattcaaaaatggatgaatgcaaaacaggagattttggaaagcgactagtaagtaaaatcaacagaaaaattttattgtgtcaatttgtttcttttttttcttagatcatactttgtttattttctcagatcaaagcaatggagaaattaagttatgacgcaatatgttcaggggcccgctgcattaagcaacagggcaacaatagcaacatgtcatgcagcgatgctctccagcaataccatagcaa

SEQ ID NO: 10555 - DNA, 644 bp, Oryza sativa
gaactgaagcttcggctctgtcttggtacatgatcgagtataaatgtgaacctagcatctcgctcttactgatgctcatttgttttgggttacaagatctgtaattaatatacatgcgtattttcgttccggtctgatcagcgtagccctgcatgcacacaaaggcctcatcattcactttccgattcccatacgcacaaaaagccctcattattcacacgctagctggtccctatgtatatgcacataaaggcctcatttagcttatacaagaggcagcaagagagctctgagctgagaagagaagagatgagtgttagttcacaacttcacgttgaagtgatactagctccagtgccttactcttgtcagctgtcgcttgcccatggtagcagacttaaggaggcgcccgggggagctttccttctatatgtggactctgagatagtggatcaagttacctacagagcatagagggctacagaagaccagcatgccactcttgcatatcttcagtaaaataaacatgcacgggaatgctctatagtataatcataagaaccaaggattagacgtagttgagctgacgatggataaggtgatatgctcagtaatgatggacatgactatgttgatgatctgaa

SEQ ID NO: 10556 - DNA, 1027 bp, Oryza sativa
caaggagttcacagttactagaactcttatgtgagtgtctaatagcttcaggttcagatatagtatctgggtccactaacatggtaccagcagcttgtgaggcatgcaaggccatttggtatctagctcatgctgttgacattatgtcccttggcacacataatttttcatttccattagctaactcatggagacaagttcatgcaaaactggatggtaaaatgcaagatcaaggatcattgccagcctcacaaaaaaaagattcattatcagatatagactctacccatctgataaatatatttgtcaaatcattcctggcttcaaaaccgatgcacgttgctgtttatcactgctgcataatggtttggagtctgctattcatgcttctcttcaggtaattctatcatgcttttaatatacagaccaatacattatattgaaatgtctctcttcaatgctatgggtctaacaaaatcttaaaaatatgggattaaaaattgccttaattctatcaatctcaattgcgatgttggtgctattatccactccctcctttccatattatatataagtaattttgagtctgtcctaagtcaaacctcttcaagtttgaccaggtttatagaaaaaatgtaccaacatctacagcaccaaatctgttgtgttgaaaatattcaccattttaatctctttttatagcatattcttttgtgttgaaaatattgctgtatcattatataaacttggtcaaacttgaagaagattgagttaggaaaaactcaaaatgacttataatatggaatggagggagtataatccaatcaattagtacattcttcagtgctatttctgttctcatcaacttttggacaatatcatccattgcctttttctctgattctaccatgtttcatcatcaaactactttaactatttattctccctaattctgattttatcatacgagattgatgagtaagaataaaatcaaaatggcttgatttcatttttttttaaaaaaaaa

SEQ ID NO: 10557 - DNA, 1024 bp, Oryza sativa
taatagtgtgttgttaatgtgtttaacctcataatctgatttatccttaccatttcaggtaggaaatgctgcttatcacaacgacatgctatatgaagaacttagacggtccattcctcaactcaccaagctacttcttgcacctgaggaggataaaaccaagggcaatgctgcaggagcgttgagtaacctagtgaggaactctaacatactctgtgaagatattgtctcccagggcgcaattcaggtttgccaactgttgcttactgctcatgctcatgcatcttattctcaatacaggtccacaatttttatcgttgttaagttgtacagcaagggaaacgacttgcagttatcgtgggtgaatgaatgaagctactaaatgaaatcagccgcaaatgcaaaattactgtgctgagtcagtggtagtattatcttaatgatgcattttagagaaactaaacatgatgcaggaacatgcatcaaatgaatggcattttatacaattggatggcttgacaaaaaacataacctacacccatttttctgctatcatcaaccttggcctatctgaacatactctttcatcccctgacctgttgctatgcaggccctgctgaagatggtcagtagctactccaccgtggctctgagccccagcaggaaagacgtgctaacagaatctccgctgaagatcgtgctcttcgcgctgcgcaagatgtgcgaccacgccgcctgccggctcttcctccgatcgtcggagctgctcccggtcatcgtgcacctgaggcaatcgccggatccagccatctctgagtatgcttctgccatcgcgaccaaggcttgccagccttgagcctttgacatccctggttcctcccggccgtggcgggggcatgatcatgccgccgcaatgcgaatctgaaatctttgtaatgtcctggaattgtaatgtagtacagtatatcacggatcaactatttgtatatatatgacttgatccatataattacccgacatatga

SEQ ID NO: 10558 - DNA, 9232 bp, Oryza sativa
  unsure (1)..(9232): unsure at all n locations
tccccccacgtcgccaccaccgctgccggcggaggaacgcagcgagccgcctcgggtgggctcgccggaggaagtcagcggcacaactattattgcaaggactaaacaagcatgaaactagcttaaagatgggcctcatgctaatagggccagttaatcccttcatcctaaaatataagtcacaactatttttttatatattttataatacaagacgtgctcccactctcctttattttttttctttaaatcctcaatctcaaaatctctaattccattgagtgtatgtattgtatttactaggtgatactccgcgctttgctgtgggattcatggacgagtatatgctaaatattgtcaaaatgatgaaagttgaaatgttaagaaaataatatgaggaagatgatttgacacatacttgtcgatttctataacattatattgtagatgattatgctagaatagtaattgctagtgagtgaagatgtggcatgcttgcatgggattttaaataggctaaaatagtaattgctagtgtgtgatgatgtggcatacttgcatgttgagctttagcttataataattattattgggtactactatatagaaagtatagatttcttggttttgtgctaatagtagttgtgccttatatttttgtatggagagaggtattaaacaaatgatgcttgtcctcgttcctcatgcatagaaaattgtagcaagagatttgagtgggttttctttcttcccatggttttcagtggtgaaggaagcattccttcaatcttcctatgatcattttgagtggtccgaatggtaggaaaggaaacacttcattcaccctaatttctgggtgcacgaaatcaaggagagatggtgacacagttgtttatactggttcaagccctcaatgcgaggtaataccctagtccagttgtttgtggattgaatctgtgtcggctgtgaatggtagaatgcataacccctgcgtgtatgctgggttctggagatgatacccgatctcgggacccctaccccctcttatataggataagggggagggttacgaggaaagtatccagttgactacaactagatctccctattctatctatataagatatgcatgatccccgagatttatattttatcccgagaatatctcttacttaatttataacatatccttgtgggcctagggctcttggcccactccatgtcatacggcccaaaggcctctccttgggtacccgagtgccgtgtacaccacactctgctctggccggcgtttcccgtcatgccgcgctagctcttctgtccctaaccccctatctccttccataggttgcacccgcctctgtctgccgctccctgctcgcaagccatagccgggacctcgcctctgccgcgacccgtgtctatgctgccaaaaccccactgccacccttgccgttcgcgccaccagtgagctcccagctccctcctacgcctccaccgcttccttctactgcttccccgcgccgccgcttgtcgctggtgccaccgccagtggctcatggcccgtgcactgcctccttatatattttctattagggatatataaactaatatcattaatatgtcacaataattactactccctccgttttatcttattataagtcggttttaactttttttcaagtttgaccaagtttatataaaaattattaacatctacaacactaaattagtttcattaaaattaacatttaacattttttacaatatgtttgtttcgggttaaaaaataattatttatttggttaaaaacattagtttaaataatatataataaaaaaaaggaaaactcaattagaaatggtagaaaaagatataaatatctcatatttcgaggtgaagtatccctgcataattgtgccaaagaaggaagagaaatcatcatgatgggtgtctcgaggatatttccccgtccactctgtgttgactccgactctttgtgtggtgtagatcatctagagttgttgctaaaaaccacctagtatggttgcaaaaatttctagcatctctttgtttctactagctgtgattaatttatcctaattaactctcttaacaaatattgatgtagtgagaaaatatttttcttttcaccaatgagataagcaacacaaatatgtatatccccatgagttcagtttatcctcattctacatattgaaagaaattttatctctcagaacgctacttgaaattgatctaataaaaaaaagagaagaaaacatatatgttttctagatgagaaaattacattgccggtacatgaacttgtcaggggagtgcaatcctatgcatgaacttgtaaaatacttgttttggtgcatgaacttgtctgatgcgtgcggatgaaggtgaaaagaactctacatgactaatcttattgatttaggggctgattaggatatatatccttcatcatatatatatatatatatatatatatatatatatatatatatatatatatagaatgggatataatgatagtagaaaaaagataaagagaaagctgagaaacgatataagggttagcaatatatatgatgaaggataaagtagagaccaaatttatacatattgtcttatgcatactcagtacacatatgcatgtcgcatcctaatcaacatccgcttcgtaaagtgtacattgccaagttaatttggtccttaatcgcacgaactagacaagttcgtgtactgaaataagcactttacaagtttatatattaaattgcacccaccgaacaagtttgtgtactaccaatgcaatttaccgtttctagattgtattgtgcctgcattttattttgggaaaagagtgtgttatttttttaagtgttggctggagagtaatcgctataatgaaagagttcatcccctttaatttgacactaataaaattaattaggtgtgattgaggtgtcttaattgatcttatcggtagaaacataagaatggctacgagtttgccaaatctttctataggttgtcaaatgggctgggactttccttgtctgacctagcacgcatgtgcaggtcacagcccaggaacaacacggtttgtttggctataggttgtgctggcacgacccatctagccaacacgacatggcccaggaatagcacacagcttggcccgttgttgacagaaaacacaaggcctgggagatctgcttaactccagtgcaggtccaaagctcgccttcggatatatgagcatgccagttgatttgatcctgcaatcaacaagaaatagaacaaaggaaccgcaattaatcctataaatgatagccgatcggctaggtgccgatgacatatcatttatttcaagccgatgtcatgcgtgcatcgatcggcaaatatcaataagcaaatcagaactaaatctactcgatcggctgtaaatattaatgatatataatccttatatcgatatatacttaaatcaagtgattgggatagatcggtcgccttaccgagacagtataaatcacttaaatcgaaatatatattaatagtgggattatacgcatttatagcatagccgatcaaatggatctagcgtgtattggctaatactccgatactactctatattaagatgttaaagcaagtaaaatataccaaacagaagtctaatatacttagatgcgacaagatcttaacataaagggcaaatttaacatatagattaagcatatgaaataaaagtagttaaatcagataagatcggctaaaactccaatactaccctaatcggcaactagaaagcaggctagagattgcaattctaagcacgacttaatagatcaaactcaactgatgtagcattaagtatgaaaagaagaacaatatctggacaatcaagccgctggaagtttcatagagtggtagatatatcacaaaatctaagttaacgtcattgtctaacctaatcggctgccttccattaacagatgttagtcgattacatgttagataaagatattatcgaagattatgtaagatatatgataactcgacgaattatatagataagattagagtatcataaagatggaagcactaatcctgagaacataagtcgtcatgacaagttttacctcttgttgaagatcggaaccgatgcagctcaacccgagagcatgaactcatcgaaagtaaagcaaaaagggtggcgatgcgccgagattgtattagatgtctttttttttgttttttacatagggctcgggtctatttatacccgagaattacaagatacatccataacagacacgactattatctctaacaaactctaagataccataagtctttacggcagacttctgcccaaacatatctctaaggaaattacacagaatatcctaattaatagatacaattgcctccccaggactctatccatgcgtggcaatcatcttgaagcacatcaacttgaacccgatgacgtacaccgagtcatattatcggaatcggctgtatcggctagccccgtccgactcgaactctgccgacctgaccttagccgatttggactgcagccgattcttactctgtttccgcaacgatcttcatcttggattccacttcgatctgatcttcacctccgatgccaatattgatagaatttaccaaaggagaatggaagaatcgagaaagccaggggctgagggcagaggaagcgatggtggacactcatcgacgtaggactagacggtagcattgtggtgtggccaaccccattctcgagcacgataactaagcatgtcggtcattgggggctcaccggctcggggagaagtgaataggaagtgaagggtcacgatggtgcttgaagaggaggaagataaatgtgctattagtgagcggaggaccttgctagagtttcgccgaagtttgtgcgactagatgacacggactttgttcgcattttttcttggtatatatatgaaatttgggctaaccgatctccacacaacccacgtaacctatcgtgccatgccaatacgacatgacccaacatctcattaggctccgtgcttgggatgaaaacggagcggatacagacggataatactcataccatttttatttccatattctttgtcagatacgaaaacgaatacaaatagctcatatacggacgcaaatacgaattatatcgaatacaaataagaatcgaatatgaccggacacgaatactgagacattttttctgtcggaacacgaaaaccacctcatcttcatatataattagttcattttatataaaatatagtatacgtttcaaaaatatttaaaaatttaaataatattaataatatggactagtgttaagagatggcatgctattaaaatctagaagggtagatcgaaggttgtagcgttataaagaaatgaaatatgtctcatgatatcagtggatatccgaatagagaccatgtgcgtattattatctgtatccgtcgaaaaccctaataccatgtgcgtattcgtatccgggagaaaatatcctattcatatccgtatgcaaactatgcgagaattatccgctccgaaaagtatccgtattttttctcttgagtggacggaaattatccgctcgttttcatggccgacaaagtacggctcgttccgtgagccctgccgaattgggcagtgctcaaacgtaactattatttatctactatattaaaaaagttaaataaaaattcaccatctcagagggcaggtccggctccattcgaaaaatgggattaggaccgatggacatacataatttctatttttctgatttccaacgatgtgatgtgcaagcaatccgtggtaggcgaaattactaaattaccctcgcgaagcctcctcgtcagtttgcctttgccgaccgcctccgcctccgcctccgcctccgccgatccccatccatcccgcgagcgagcgagcgagcgagcagggcgccgtcgatcgtcctgctgcttccgccgcatccatcctggtgagcacatcctccgccaccgccgcctgcactgatccccatccatcgcgcgagcgaagcgagcaggggtcgccgtcgctcgtcctgctgcttccgccgcatccgttgcgcacgtcctctttcccatctctctctctatacccacgcgctttttctcgaatttgtgttaaccctagcttctgttctagaaattttggcttaaccttaatactaataacagtttgatggttcccaaaaaggtttggggccatgccccatgttagatccaacacatgtcacaccagttctaataattaggggatccgttgatgaattttaggctattaactatatagcaaacttgctgagtttttcttctttccgagatatatgcattgtagtccattaggtacagtattgttctacacaggtttacatcaaatttatatgtattttcctgtaccacacatgccaactttcaggcttcatacttgtttctgaacctagacaatatggtatcttaaaaatgtgatagaaactggaaaaatgaaatattactaatataggtgaatctgcctgagttgcatcatgttcaagtcctcataaaattgccaatttgagaacagaaaattgtgcatctttattgaaaggtgtgcattttatttacctaaaatgtaagattttcgacctcttctattaagctgtgaaattaccagtcctatctgatatttgtataccaccaagtagctgggtaacattcacttgactaataataattatctaacctatattttcatgcactccaactgatctggatccattttaagaatatgtcttgaatttccaatgtacgcgattacctcatcgtgtactcacctatttgtaaaatgtcaagccccccccccttctttttttactctcttcccaagttcatgtgtgtactggttgttgaaaagatggattaagaattagcacttgtttttgatataattttatttattgtaataattttttttttgagaaaagaagaacattccttctaaccttcttgaaacctgaatcagggacattcaatgtatgctgtgcaccctgttcttgtacggactgtaaccgttcttcagtcctgatggagtcagaagcaggcagtgcacctaatggttgtacatctacagtaaaggggtcagaagagaggcacagtttggaacgtcgtcatgatgatggctcatgtatctcagagattaaacttatttctaatatggttgtaaagaaaaagagggggagaagagcacctccatcttctagaagattaagtggtaataaggttattagtggtgaagatgctgttcaaaatcgcaaccatgctaaagaagaagaccaggctggtaaaactcagtctaatttatttacacattaataagaaaagcattattgccttattggtagaactggtggatttaacttaccaaaaacttgtctctcaggtaattcttctgatgtggcgttgtcgccatctagcaggaagacagaaggtcaagatcagtcgacaaaccccaaagatttgtttgagaaagcttgccatcaagctacagagatggttactgaaagcacaactggttgcaagaaatccttttgggaagaaaagggaagtgataataggagaggcaggcaagctacactttgtgtgaaacaggatgggcttgatattgaaacaacaggcaaggatgtctctgcaagtgaagcttatgaaaaatccagcacactggaagatacttctgttgggcatgcagcagcaaagagtgttaatcctgaggataattctctagatcctatggataatgtaagtttcagttttccttttttatctgcaactactagtacatattttatccatcaacagatgtccagtattttctttcttttttgtggttaagtcatgcttctgtcataatctagcaattgatgtttggcaatttggcatgttgatccaaacataatgtgtgtatacagtttgatttatattcctttgaatttgtgttcaaaattaaattccttggacatggtttcaatatccattaggtgtctgatacacatgtgaatgccacatcttctgaggacaaaagttctgaagaagttgaggacgtgagttcaaaacctttatttttgtgcattaaaattatgacaaatctttttgtgtagctaaatattttgtttcacttgacaacaataggtgaaagtgtgtgacatttgtggagatgttggtgaggaggagaggcttgctgtttgcactacatgcaatgatggtgctgagcatatgtaaggcttatttgttccgttgctttttatgtataattactcatctttgattgcttgatgacatgccatgatggttaagattgttgcacttgtagtttgcaaacaagccacaattaggatgcctgccctgtgtctcaggacaggaataaactactactgttattatgcagacaagccagttaggagtattattttcagaatatttttccacattgagaatatgggtattgttaatctacttaaattttgtctcatttctttgctccagttattgtatgcgggtaatcatccaagaggttccagagggtgaatggttgtgtaaaaagtgcgaaaatgaattggaatatgaaaagaagaagcaactagaaaaatctcagctgaaggttggtgcctcaaaaagccagttctttgaaaggaaaaccaatanaattgccaatgcatcaaaaagcaattcttatgaagatgaaccctcaaaagcccttgaagggaaaattagtaaacctgacactgctttgaagaacagaagttcttttgaaaatgaagtggagaatgaaaatggagataagaaagagttgaattcaacaaaccaatgcaataatagcaattcgaagaggaaggaagaaggtgcagggatcatttcctcgattaaacaaagtattactgaacgctgtggtttctccatgggagctgagtccagaaaaaggttgccattgtcatgtgagagctcatttcggttggatgtagagaagggaaagcaagccgctaccaaagtaccaacttcattggcatttgacgctgccaagaatctgggaccaccacttcgtggtaaatttttttccattattactttcaattcagacactttacctatgtaaa

SEQ ID NO: 10559 - DNA, 6404 bp, Oryza sativa
  unsure (1)..(6404): unsure at all n locations
catcatgatctggaagctgaacaaatccggcatttacactccaaggtccctctgtagggctattttgtttggggggggtaatagacacaaacatgcaggatctttggaagatagcgcacccctaaaagcaaaaatttttctttggctaatgcttaaaggtagaattcaagccgctgcccagttaaagaagatgaactggaacggggatcctaactgcaaactctgtggggaaaaagaagatgtggaccatctgatcttcagatgtgcgccagctagatttctatggtgttgtattagagatgtgtttaactaggatgtggtcccttcgtctagggacgatattgttgccctgatgcatggcccaaagaagaaatctttgctcgttttcgttgctgctgcatcatgggcaatttggctaaccagaaacgacttggtgtttaataacaaactgatgaaagatgttctgcagctacctcataaaatgctctattttttaattctaaaattgttaaattctataaattaaaactaaacaatcatacgtatctatagtcattatattgatataggttacatatctctatctattataatataaaaattgaagatgtttttctcgagattttggtacatatgtgtttaagttagtttttagttgcataacgcgggcggttcgtttatatcgctaaatattaattaaccgtttgtatcgaataccaatacggtgtggtgttgtggacgtagctaatttgcttatgccgatgaggtcacatctaagtctaatctaatcaaaactaattaaataataataactttctagtcgtcagcaaaaattgcgtctgtgtcaagcggatccgttaacttatatgaatatgtgattggagtccgtttcaatttgtgaaattcgtggcaagcgcataattagcattctccagcgcatgctcctccgatccgctgcggcgtccttacgggcggcaagccaactccgtgagccacgtctgagagaccacgtcagccatctcgagatcgtncagcccgccctacctcgcctcnttttatttctctctttctgcaggatttcctcgaccacactgcctactagaggtgaggtgtaagtgagtcagccgcgaactcatttataggccaaaataagcggntttgtagtttattttagtctatactaaaaaaatgctcgtgcgttgcaacgggtgaagtctattttaatcttattattggtatatggtttagataagataaaattcactgtgcgagttctcttggatatatatatttttagaaaatcatgagctgcagttaggagttcaatcatctcaagttaacatacgagtttttttaaataaatttcttatatgattccttttgtattaccaaaagtgaacaatcttaaaaaccgactcaaatacggatatgtatttctaaaagcaaacgaacttaaaaaccgactcatacacggatgacataccaaaatactgacaaaaacattttcaatttttataatagtagagatagagaagatatatagattaaaaccaaaatataaaaattaaaaccgactaaaacacgcatgacggaccgcgtaaacatctttaatttttataatagttttagaagatcatgagctgcagttaggagtccggtcatcttaagttagcatgcgagttttttaaatagatttcttatatgattccttttagattaccaaaagtgaacgatcttaaaaaccgactcaaatatggatatgtatttccaaaagcaaacgaacttaaaaaccgactcatacacagatgacgtactaaaataccagcaaaaatatctttaatttttataacagtagagatagagaaatgggtttcgtgggttagccgcttacaccccgaccgcctaccatggcgcgaaggcacaattttcgatgccacgcgacggcacgccaataagctgatggagagctgcagcttcgtcgtcatcgttgcttgttgcttctacgaagaaggcgccatgcatgtggaggctaggaggagtgcagcgcgacgtgacggatcgatgaccggccgcgtgatctccagactccgcatgcaccgacctcgccgtgcactaggccagtgctgcacgcttgctggttgtgtaggagacaggagagatatagcagggaacgcttgacatgtattcctacatgaaggtggagaagccgcacgtatatggcacgtaacgtggttaaattatcggtgccgagaagatccataccactgttccattatcagctctcgcggcgcacgtatatgagacgtaacgtttttgtcctcgtttcatataaaagacccttataagttggccccacttatactcaactagtgaggttgtgctaatattagtcctaacttatttttaatggtacgggtttagaaaagtaggaaaagtggttggatgaaaaaattcatactttacgctagattcacatcttagtcctagcctatatatttttagtgctgaggttagttgcaatgcatggccatactactagtagagcagaaattatgttaagttttctcgtgtaaaacagttacttattgctggagttaattttgctgaaatatgaaatatctagctatattttcaggaaaaagtgatacttttgataagatttttttcgttttatcgatcattgtctaaaaagttgttgttttatcaatttgccacataatatctgttggaggcatgccatgaagcccttcggccgaacctgccgaaaccatagtaccagtaaggattcaagccaaagacgtcaagaccattcaggcgaagccctatggtgaaagccataagcgaagatggcgaaggctggaaagccgcgtcggtactccgaaagtaaaggcatcttgggcgaaggcatctcggacaaactacaaagacttcgctatgacgagttcggcatcaaggaggcccaacaggcctcccccagcctttaaggcccgttagccatagaccaggcccagcctatcagcccattaaaggcccatatgtgcaaatgacactgcatacccatgtaaatgtccctttcataagggcaaccatgtaaaatcccctgtaaccctaaaccctagaaggtgcaagcttgtcctaaggctataaataaacctctagggccatgtaatgggggatccccaaaaaattttacgaatcaatacaattgcttttacattccaactactgttgagagaaccacgcctttcgatgtggatagttgtccattcgacaacagctggcgccgaccatggggaacccagaccgaaagggcgaaatgggaccccttttgccacacccacacccttcgccacagtacctgcgaggtacagcgacaagggctaggggcgaaagtgagttaagtccaagctggggggctacgaagccgcccaagcctctagacacctttcgccacacgccacgcccttcgccatagtaccaatgaggtacagcatcaagggttgcggggaacaggtttcgcccactcacgccctttgccatagtacaaatgaggtacggcgtcaagggttgcgggcgaagaggtttcgtccacccatgcccttcgccatagtgccaatatggcacggcgtcaagggctgcgggcaaagaggtttcgccacacgccatacccttcgccatagtaccaatgaggtacggcgtcaagggttgcggacgaagggatttcgtccacccacgcccttcgccatagtgccaataaggcacggcgtcaagggctgcgggcgaacaggtttcgccaacccacgcccttcgccatagtgccaatatggcacggcgtcaagggctgcgggcgaagaagtttcgccacacgccatacccttcgccatagtaccaatgaggtacggcgtcaagggttacgggcgaacaggtttcgcccacccacgcccttcgccatagtaccaatgaggtacagcgtcaagggttgtgggcgaagaggttttgtccacccacgcccttcgccatagtgccaataaggcacggcgtcaagggctgcgggcgaacaagtttcgccaacgcatgcccttcgccatagtgccaatatggcacggcgtcaagggctacggacgaagaggtttcgccacacgccacacccttcgccatagtaccaataaggtatggcatcaagggctgggggcgaaaataagttgcttccaagctagggggctacgaggccaccctagcctctggagcctttcgccacacccatgcccttcgccacagtacccgcaaggtacggcgacaagagctggggacggaaatgagttgcttccaagctcaggggctatgaggccaccctagcctctggagcctttcgccatacccatacccttcaccacaataccaataaggtatggcgtcaagggctgcgggcgaacagcttttgccacacgccatgcccttcaccatagtgccaataaggtacggcgccaagggctacgggcgaacaggtttcgccacacccacgcctttcgccacagtaccagcgaggtacagcgacaagggctaggggcgaaaatgagttaaggagttgctcccaagagcagccgaaagagatttatcatttttcaagatgctccgaggggccggcaaactcaattggacacatgagtgtcaagccgccttcgatgggctaaggcagtaccttcagcattagtgtaaaaatccgttcagaaaagcattttctgcagattcggtgtgccgaaagagttcattaccggcaataacaagcggtttgactccgagaagtccaaggaaatgtgcgaacggctaaaacttgaaatcgagttcgcatcggttacacacccgcagacaaacggggcagccgaaagggacgaatgacaaaaccctagcagcactaaagaaatgaccgaaagccggtaacagttaaaaaggtcgaaatgctaaaaagaccgaaagccggcaacgtcaaaacgatcaaagtacctaaaaatacctttgccaaaggcaaaaaggggaaagtacgagccgaacagccgtaacacacaccacaacccttttatttgccaaaaagcacaagttacagataaattccattgcccgccaaaaggcattcggactttacatccgattcattaacaaaagcagtcctcaaatggcgaaggactacccacttgagcatcttcttcatcgctagttgttagatcaacacaaaaaatttagcggtgaagaaggaaaaacagggattatgctgcgtcgacgctaggcaatggaaaactgacgctcagtcatataaaattcataggtgtgttcgccttttttgtgtatgatatttcgtggaaaaaccccaaggcaaacgtttgatcgacgaaaacgccaggggggcgatacgaatcggccgaagcacagctcgccgaacgttgaaaccgcgacaactcattttcggaaaacataccgatcgtcgctacactcgacttatgcaaatacttaagcgtttctagacgcacatgccaaaagtcgagagcgaatgatgagggctggaaagtcaatgtgaattcctttcgctaacatgcaagggggccgacacgcctcgcccttccgaacgtacaagttccaaaatgtgatgatagcgaaaagaaacataaaaacacgcacaagctccatcgggcaaaagcacatacgtgttatacaaaggagcaaaaaattacataatccgtttcagaacatttttgcctcgcccctactaagtcccgcgaacacggttcgtcatctatactgtacacgactctaaggggggaaggaagcgaaatacacaccgacgtcaagcgatacaacttgacgattagtcatttcgaagtctaaccaaagtgtggcaatgtcatcgcggcgctggatgtggcaccggtcgtaatcctctaaggttcgaccaggatgtcttcgcctccaattcgccattttgacaacaacatagctacataaaaggcgaacgcttgatcgacgaaaacgctaggggggcgaaacaaatcggccgaagcatcgctcgccgaacgtttaaaccgcgacagcttgtttcggaataaagataccgaacgccgttacattcaacttacgcaaaacacaagcgtttttcccagcgcaaaatgctacgagtcgaaaacggaagtcgaaagctgaaaagtcaacaaatcttttcgccaatccccaaaagggggccgaacgcatgactttcggcgaaatccccgctaaaacaatagggaaaaggggaaagaaaaaaatacaagtcaagaatcgcgcaaagcagacaaacttggcaaaatataatcacctagtgtcataatacatcttcgccattctcaaaaggcgaacgccagtgttcatattttttctgc

SEQ ID NO: 10560 - DNA, 277 bp, Oryza sativa
cgaatccgtgaatttccaaacgaaattaaccgacgattccataagagaaaagatagaggggatcccggggatcatttcccttctattaatttcatcggaaacagaaaggggcgggtggatttggaaggagacgacggcggcgcggtgctagggttcgggcggtcggaggaagacgacggccctgacaggtgggccccacctgtcagcgggtggacgcgcgcgcgagcgggcggctcggctgcgggccggattaggccaggagagagagagagagaag

SEQ ID NO: 10561 - DNA, 3527 bp, Oryza sativa
  unsure (1)..(3527): unsure at all n locations
ggttttggtnnggcttggggcccaaaaccaaaagagactttaaaaaccttttccaatttaaattatccattaaatgcaattccatttattaaaaatacttccttagctcaaataaatcccagaaaaatctaggaattatagagttaagcaaagtatttaatgaaattttatctggccccattttatattggaatttattaattaaaattagatcttctcttctaggcttttaaaataaattataataattccaattaaacaacaatttatatatttaggatttttagggtgtgacagaaaccatgtctcatgtaagacatagtttcattctctttcctcatttattcacttgccacatcatttttcatcctaggtggcagtttatttaatgctatagatatcatcctagtcattgggttgagaatggcctaagaagccgcccaccgccttgaaaattgtttcaatttacccgagcaacatagttaagaagctatctgtaataacacgatgcgcaccttgagggaccggctaaaactaaatatggatttccacatgcggctgcctcttgctcacacccgcggccacgaccgtcatgctccacccagcgctcacgtgcacgagctctcgccggtggcctttgaggcttctgtcctcaatgggatgtgaagaagaagaaaagaaaacaagggggatgaggaaagaaaaggatttgacgaaaaacataacggtagtggcacaaatcaatttttctgcaaatttaaatgacatgaatttaatagacgaatagaagtggtatttatctaaacgagcatatttgtaatggcatatatccaattgtccctaactaataccagccagcaaacaaatctttttgcatgcatgtgactagcaaggctgagcttggccaagacaagagttacaagccagcctaattagtgacagcaaccaaacagatccataattactgtcgggttaattaagtttgtttttcctgatataaaaattgcgagcatcttacgccataatccacacaagcgttgcgagctcaccgccgctgctgagttgcttggcgtgggactccctgctgcatcggtggctaacgtagtggagcatctccacccacaccttgaacagaaattccacactggccccgtcgtatttgttgagctttttgactagaaggagggcaagcggcagagcattgagcgagaccttactggggtcccggtcggtgactcccagctgcttggcaaggctctgtgttttctggacggatgactagatcctaattttgttgatatctcggatggtttcactgtaaatagtgcgtagtgcaaggccaggtaccatgtagggacgttccagaactaggaacatcatgtagttggaaataagattgattgcttcaacatactcggtggtctctgccttgtcggaggtgcggaggtagatgtccgtcgcgatgtgccagataatgatttgctgctggatctcgtcgcgaactaacctcaagaacaagtcgtacatttctgccttgagcaaccccgtcgagtccaatgggatacccggttgccccgttggtgctgcatcttgatcatcttaatttatccttattatcgatctcgcaatccttattgtacgtcgacgtcgattcttattatatctagcaaatagctgaacacctgctccatgacacgatcaggaatgaccgtggtgccggagtaggtgttgtctttcttgcgccacttgacatgtatcttcttggcaaggtcgtaccagacgtccttggagccgtcgcgtgtgcagtactgcaacatgttgtgctgccagatggtgccggaccaccttctgctgtcctccgcattgacaagccagcggatccacgtgagcgcgcggccgacctggcgccatcgtccgctgcagaccgccgcgtggtacagccaaccccgcagcggcatgcggatcaagaaggcgtacgcccaggtcgacccggctgccatgagcagccaccatgtgtctacaaggacggcgccaaccagcaatgtgtaggtgatggccacgtcgactagcatagccccatgcccaagggcgccgtggaggctgagatggaacatcaccaaggcaccggcggtggccagcggcgaaaagacacggatgcagtagccatgccacgtgtggatgacgccagccttggtgtacatgatgtcgtacagcagggagagctccatctggaggacaacccacgtctctgtaaaatcaaaggtgtttttgattattattctgtgatgaacaattgggcattggagattattggttttgttatttggaatttattcacgaagtggttttggagatgattggatttacaggtgaatcgcagggttatcattttatgtggaccggtcagactgggctctggtagccggtcagaccggcgtgtaatgcgcggtcagaccggcgcagcccgcggtctgaccggccgacactgtatcggtttcggtttcgggttgtttatttggatatccaagtttatttcatgattatgacttctagatggatactatacgtatgtaatactattgtttgctgctaatgagtcaagttggagataacttagtctcggaatatagtttctttgtttgttccatgtgtaggtgactcgatgtctcaggagagtatttgcggtgatggaccgggagtcggcttggggataagacgacgtccgtggtggtcagagatcatgcgggatacttaggctatagttgatgcacgtggttgatggagattccatatggcatacaatgaagttattgtgtacgtataggatgcgtagttgaatttggaaggagttcaaatttggtacgattggttatgtaaagtttctttcttgtactagagggtttcctaaggtgtttaggactcctagtataagtttggttcgtggctttaggctgcctacctcatgtataaatagagggggagcgtgaggcttcccggtatcgctttagagagcaattgagttgagttttgagttagggtttcgagtttagtcaaaatttttgtaaggagtgctgttggtgcactttgtaaacacagagagaatcaataaagtcgtcatccactttaagagttattcgatttgtgtttaccgggtttcggcggtctaaccggcgatctaccggcggtcaggccatgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcagatttttcagagctcaattctttaataaataatacaaagagacagttcagtaattatttgattctccatgggtaaatatactctctgaaattttctcggatttttcagagctcaatcttaaataatacaaagaacaggtcag

SEQ ID NO: 10562 - DNA, 14472 bp, Oryza sativa
ctcagttgaagaaaaaggatccagaaggagaagacgtttggattataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctaaaactagtggttgaaactagaagatgctgatgtgggcaacttatggaggttaagtcaagtggatcgatgaataagaaggtgatggtcgatctgaagagccaagtggtcaagatggaatgaagtttggatcctatcttagaacctatgccgccaaagtgtctttgaagaatagttagtagggtagaacgtttgttgtttgcttgtgtgtaggtatggttgcattcccatcattggagtagttcaatgatgagtgtgtaactatactaggttgtttgcttaatcaacttgaacaatataatggtctacacacatcagatcagttttaacctggttaaggtcttgtctttagtgtaacccctctccttctatcttctctaatctgcaacagatggtgaacactcgcgcaagtggaagtggaaacaataacaatgaagataacccaactcttgctcaagttctggctcaacagactcagttaatgaacatgatgatacaacagatgcagaaccagctcaaccaaggaaataacaatgctccaccgccgcagaacaagttagctgattttcttcgtgtgaggccacctaccttttctagcacaaccaacccagtggaagcaggtgattggctgcacgctattgagaagaagttggaactgctccagtgcacggatcaggagaaagttgttttcgcttcacatcagttgcaaggacctgcatcagaatggtgggatcatttccggatgaacagagcagaaggacaaccaatcacttgggtggagttcacggaggcattcaagaagacacacatacctacaggagttgtttctttgaagaagcgtgagttcagggcattgaagcaaaaggatcaaaccgtggcagaatatcttcatgagttcaatcgtctggcacgttatgctccagaagatgtgcgtactgacgaggaaaggcaggagaagttcctggaaggtctgaaggatgaactatcagttacgttaatctcccatgactatgttgattttcagcagttggttgacaaagcaattcgacttgaagacaagaagaacaggatggataaccgtaaaaggaaaatgactgttttccaggaggcacaaggtagtagccagaggcagcgtatcaagccactccaaattggtgaatcctcttccgctggtcaaggacagtcgcagcagttgaacatcggtggtgagatcaaattagagactaatgaaagcaatgaacttaacatcgagcaagctaatcagtcggtgccagttcagcaggatcagtcgaataacagtagtggaagggagcagcaggtatgcttcaactgttacaagccaggccactttgctagagagtgtccgaagccgaagcatccgcagccacaaggtcaagtcaacaacattgtcgtcacaggagccaatgcagtgccagttgcgtcttcaagagttgtgtcttcaagtgttacaactcagccaccagtttcaaagcagcagtagttttctttaaagccttagaataattatcggagtgatggaataagatagactgcagtttgcctattccctttttctttctagccgttccgaatctcgggacgagattctttgtaaggggggtagtttgtcacatcctgattttttgtttcaggatttataaattatttaataaattaataatataatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgattctccatggttaattatactctctgaaattttctcggatttttcagagctcaattcttaaataatacaaagaacagttcagtaattatttgatcattaatgatctaattataattgttaagagcttttctggtttaaaatccttaaattataaattgttgtttaaaaggaataattagaaatgattttaaaagcctaaaggagaagatctaattttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaaggttttaaaaagtcttcttttggctttggccgaaagccggcccaaaacctctcttctctctctcctcggcccagtccggcccagtccgccgagccgccgctctcctctctctctcgctgtcgctgacaggtggggcccgcttgtcggagccgtcttcctccttcggccgccgccgcccgcaaaccctagccgagccgcgccgccgtcgctttccaattccgtcgctcctttccatctccggccgaattgatagaggggaaatgatcctcttgattccctcttccttttctcttttggaatcgtcacctaattcggtttggaaactcgatggaatcgaggtcgaatcggattcttctctcctccgaaccctagctttccttcgccgtcgccggtcgccgtgggcctccatcgccgctcgctagcccctttaaaaggacccccgagctctcctctatccgccgccacctttgccttagcctgccgtcgcgtctagcgccgcctccgcgtagccctagtcgccgccgtcgttgccgtcggttcagccgcgtcgcgccgccgttgcagccgccgtcgtcagtcgccgtcgccgccatcgtggtcgtcaagtcgccgccgtcctcgtccgcttctccgccgccgcttcttcctcgtcgccggcgccgtccgttgcccttccgccgttgttttggtcaccggtgagttcgccgcgtcgccctctacccgttggtgccctccgttcgcgccgacgtgccgtcgttcgccggcgagcatgcgcgcccgagccgcccgagtcgccgccggtgctgacgtcatcgctgccgtcatcgctgacgtcatcgggatcgtccgccgtaagccggtcgtggaccgtttgatctcggccgtccgttttggatagggttgatctcggccgttcgtttccgtgagccgctgccgtgcacccggtccaccgcaaaccctagccgctgacgcaataatccttcttttcctttttaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacattttaaaattgtccataaattgaattaaatttatttaattctttttaaatgggctttaaatagatttaatcttgtaaaattcataataaattcatttgaagtcagaatgaggccgttcaagtctcataaatcatctaaaattatgatctacatgtttgtttactttttatgtactgtttatttggtttttattagtctttttcttcattttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgttaccttgggagattataatttgactagttgagctttatatattggttcagctagatattagaggtaattgctttgccatgcttagaaacattagcacacaattgggataactaatgtttcactatcacttatggttatatttaatggtagctcacgatggtcaattgtgattggttaattaattacttgtgattggttaattaattatttgccaactaaaactggataatggtgggttgtgagcacatggttttgagagtcgtgctcatgacaattaaggaccggttcgcgagctactattgtgaaacattaaccgtgccaaccacaaaccagcgtgggcaacggctttaccttttgtatagcatggttcactgcagagcaccaggttgagaagtggcggagataagcccacgggggtcgctggggagtccataccttgtttataagggggtgactatgatccgggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagttagatttgttcagccgggtatggttgtttagaatggttgggcctgtgcagcatgggcgtgttgttcagtgttgattaaaatttctgattaattactccactgttttacttcttttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaggccagcggcaagcggcggtcagaccgacagcatacaggcgggcagaccggcggcggcgacaggcgcagcaggcgatctcggcggtcagaccggtggcatccactcagtcagaccggcagatcaatctcggtcagaccgactttcttcgatttcgagggtaacttttatttccactaaaagttttcagtttttgggtataccaatcattcaccccccctctggttggcttagttcttgtgattcgatcctacaagtggtatcagagccttgttttcttctttggatttttaccgatctagagtttttgccatggctactcccgctaggttttcaactaagcctcatgttttcgatggaacggatttttctcattgatgtagtaggatgcaatcttatattatggctgaagattatgatatttggagaaaagtttctcatgcttatgtgattcctgaagctattaatactgctgctgaaaaaactgcttttgaacaaaattgcaaagctcgcaacattcttttgagtggtatttcttgttcggattatgatcgtgttgttcatcttcaaactgctcatgagatttggattgctttgagtaattttcatcaaggaacaaataacattaaagagcttcgtcgagatctttttaaaaaggagtacattaaatttgatatgaaacctggaaaagctttggatgactatctttctaggtttaataaaattttgagtgatcttagatctgttgattcttcttatgatgctaattatccacaatctgagatttctcatcactttttgaatggtctcgacatgtctatttgggagatgaaagttgcatctattcaggagtctgttaacatgtatactttgactttggattcactttatactaaattgaaaacacatgagatgaatgttctttctcgaaaagttgattctaaatcgagtgctttggtttcttcttcttcttctttggatattgatgcctcttcatctaagtcgtcttttcttgctgttattaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgcattgtcctaagtttgagagaggcaaaaaagaagacaaagatggtgagaagaccaacaacaacaagtccaacaacaacaagtcgaagggttcttaccaagggaggaagatggagaatcttagaaaggcttttcaacaagtttggtatgggtattctattaatcctattaagccctagcccaggatgtcaaattggggttattaaatgatttcaaatggaaaagtcaccaaaaccaaagttgtagaactcatcgaggtgcaaaatttttatttcggtcatttctccatctaactctatttatacaatttgaaattcaaattttgaaaagttcaaatagaattttagatcagtgaacgattcaactgaaaaagtcatcaacaacaaagttgtataactcatcaacatctacagcttttattttggcatttttctatataacattttttttgaaccgtttgaatttgaatttaaaaatatgacaacttcaaacaacattttcaaatacaaaaatatatcaactgaaaaagttatcaacaccaaagttgaataactcatcaagatctaaaacttttattttggtcatttcttcatacgacaaagtgatagtaacattgttcgcaaaattgacatatctcttatctcgtttataaactataacacatatatgtaaaatttgtgaataatattactaacatttcttcggatgaagaaataacaaaaataaaagttttagaacttgatgagttattcaactttgttgttgatgactttttcaattgaaatcatttagtatttaaaaatgttgtttgaagttgtcatattttcaaatttaaattcaaactgttcaaaagaaatgttatatagaaaaatgaccaaactaaaagttgaaaatcttgataagttatacaactttattgttgacattttttccatttgaaatcatttactacccgtaaaattgttttgactcataaaatgaattattatactgcacttaattattttcctatagtcaacttacaaatataaacatttcatatgaaaaatataaaaatagtcatcggtgacgggctttagttaatgcccgatagagattaagtatatagcccgtcactaatgagtcatctgtgacgggcctgttgttatctcaaacgggcctcaagttatggcccgtcacggatgatggtcatccgtgacgtgccacaacttgaggccgagatatggaatgttatctcaatcgggcctaaactacggcccgtcattgataggtgtcattcatgacgggcttaagttttatgcccatctaacatgtctgtacgaccatatctcaatcgggcacttttcggcccgattgagatgactttcttatgacggcccgctatttctaagcagattagagcccatcacagatagaaggatctgtactagtgttaacaaatcataaattaccatcctactgtggtttgtcttaaaaaaccgacaagcacaacactaaaatccactataatatatatatgttgctttgaaagtatggtttctgttggcattaaattaactaagaatgtttatagtcaatctatgtatttatctaaccatgatcgatcaaacaggtacaaaatagccaaggacattagatcgggtctgctctacctacatcacgagtgcgacccacatatcctgcatagagacatcaaaccaggcaatgtactcttggatgaaaatttcaacgccaagctcgccgaatttggcctatcgaggatggcaaaccaagacaatgcaacgttgctgacaactgccataggctcggaagggtaccttgatccacagtgtctgaaacacggtaaggtcccgttcaagcgtagctcagacgtgtacagcttcggcatcgcccttctcgagatcgcctgcgcaaggaggcacagggagcaaatctgggacctataccgaagaggtggcaatgttgtcgaggcggcggatacaaggttaaccattggtggtggccttgatatgagagagatagagcgtgtcatcgtattggggctctggtgctctgctttggagactcaacaccgcccttctatgcggcaagctatggatgtcctggagcgtgacggaccgttgcctgcccttaacagcttgatcgtcgtcaacactactttggcatcaacgacagaggaagacgcctccagtgcgccggcggcgggcaatcgctatgactgtgatgaggcaccactgctgattgaagggtagcagggtgagccatgcatgaccttaactgctgacaatatctcgtaagcaagcacgcatgcatgcttggttcttacaagagctgctgatcgagtgctgagtgcaaattctcatgttgtcactttattatgtaattgccttctttttttaaaaaagaaaaacttgcacggggaggctctttatggcacgagggagcaacggggaggccggggagtggctgttttggggcggcaacggccggcgacgtgggcgacatcgtgggcgaaatggagctccatcccggcgtgatttttgggggaaacgtgaggagagtgtggaggaggtggaggggttgcggttgctctcggtttggatgcgagcgcgcgagtgagaggttgtgaaaacggcggcgtcgtgggcggcatggcggcatggcgtggttgggcttgggatggctggggattggggatggcaggtggggcccatgggtcccacctgtcggcctgaggagagcagagaccggtttgaggggggggaatagacttgaagggggaagcgagctgggccgacccgagagaagaaggcgcgcggcccgcggaagagagaaggaaggcttgagctgaaaattgcccaagggaggaaggagagatttatttggttttctttatattctaattgattaaatgaactttgtgctattaaaattacttcttgagctgcgaaaattcgcgggaaatttgagagagtatattagggcacaaagaatattacaaaatattcccggctaatgatttttaaaggaaattttaatttcctcaataattctcttgattaaattgatttaatttttatttaaattctagaaaatgcattattaaatgattttttaatcccgaacgaaaattggggcactacagttgccggggatgcaagctcttgcatacctcacagactagcgtggagaatgagaaggaggccaagctagaggaggcccgtgtggaggaggtttgatccgcttgcggttcgggcagcttgggacggcggtggcgatcttgcagctcgccgccccctatgacgatgccattgttgctcgggtcgtcctctgctgtgacgatgtcattgttgaccccaccgctgatatgcccaaagctcaacctccaccacccatctcctcacgattcggtggttgatagccctcccaagccagattcctcaagccctcttttgcaggtttcctcttccccaaccttgcccgttgacccaagaagacaacagttctttcgccattggttgaacttttaacttcctttgagtggctggatttgggttccttcattctcattgtttctttttgtagcagcttccatgcagggtttgtgtcgaaacaagatttcggcaatactaaaagggggtggctatcaagctggaaaagtgcatgggtttggagacaaaggatttatacaggttcaggccttcttattcaagaagtaataccctactcctgtccggggatgaaaccgccgagtgtattattgaatgtaagatctcccagaaaattgatgtcccaggaaggactcggacccctccttatatagaggaaggagtccgtattacaaggtataactcatacccctaacagaatacgagaatacagataaaatacaatcgtaaccgactaaacctcagggtatttccttgacgtacaagttaagaaacaaacccgagatacaaataaagatattctatctatattcggtatcatatatccagtctaaatataaccgccgtgtaaatatggggtatctataatctccacagtagcccccgagacctttgcagtcgacaacatagctctctcaaaaataataatccgagtgctttaatttttccctgctaaggcctgccgagtagcaaagacgaagactgtaaagggcgaaaaataaaaaacatggtgcatcgaatagatgcacctaattaggtgttgcccccgactatatgattagttaacaaactaaacatgtagtcaagaacaaaataatcgcataatcatgcatcatatgacaaaagcatatgcggcgtccaacaaaacattcagccgactgctttccagccatagtaaaaagaatccgagtgaataacactctaaaaggttcacaaatgaacatatttgacaggcatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatctcaaatcaacccagatagcttttgcagcctaaaaaagcttacaaaaatagtataacacttttctgtcgagtacatttcaatttgcattgcaataattccgaagaattatataactgcattaaaaaggattttatcagcattgggccacaccattgcgagcataaattgccaaagcaaaaatgcctaagtccctaaggagcacaacgggccacgctgttaataatattgggctgaagtactgttcaggcctaggcacattagcacccccgaaacccttaacaaaaaatcccgaagtctaagcggcgcttcgtcttccccgccggaactctcaccatttcccccattccttgctatagtacagagctgcgccggcgaaactagggttcaccattccactccaatccacctccaaaaagttcacaaaaatcctccacgcaactcatcgcttcaattccacatctctccccagccatccctcgaatcaaatcaactcattcggatcaaatcgatggcggaagaaaaagaaagctttgaaagccaatgggcgtcgtccgacttgatggaggagaacttgaaggagatggtggcgcacggcgttctcccagcaaaggagatcatcggatggcggccagcatttggtgaagctttcctgacccccgatacacatgaggtcgtggtttttttctcacttcttctatggcggatttgctcttccaacctcgaagtttttccgtgggatattgaacttctatggaatcaatttacatcatttgaatccaaactccatagtccatattgcaaatttcgtccatgtctgcgaagcttttttgggcattaggcctcattttgctctgttccgccgaatcttcttcctcaagccccaaccgaacaaaagcaaaccatgcgtagttggaggggctggatttcaactgagagggaccttgagccaaaagtatttttctatgcccttcaagacctcaaacaaaggatggcatgccaactggttttatgtccaaaatcccgagcccgctcttcccgagtactcctgtcttcccctagtataccaagataattggaactcactgcccatgggagatgaagctgcccaagccttagaactgatggagcgcatgctgaagctcaaggagcaaggcttgcagggagagcaaatcactcggcatttcattaagtgccgattagctccaatcaaagagagatcccgcacagctttcgagtttgatggtaaacatgatccaaaccgtgaagacccagattctctggacttaagatcatgaaggagaggatgtacaagatattctcaaacgccatcgttgtcagttatttgcatctgctgccagtcgtgccatataatgcattcaacccatctccgctggtatgtatcagaactcttcaaaccgcgaccaaaacataattttgtcttcttgttgaattaacagaccgtggaggcatttcattcaggaatttgctttgatgaagtctgaccccccaattgctcaacgccgatctcctcgtcatcagaccgttcaggggagtggaggaccaaaaatcaggtcagactcccaatccaaaactcccaatccgactgggcaatcagattctcgcaagagaaaacttgtgctaagcgacgacgaaggcgacgacaataataaatttggggataagggatcacccaaaaaactaccaaagcacactgctccgaagaagaaaaagttcagaaaatcctccaggtataaaccattcggtaccatctcacttcgacatgcttctctcatgaagataatattgaaaactggaagaaaacttgcaggaaaccgtctgacatagatccatccgggaaggactctgatccagctaacacagagacaggttcatccaaagaagctgggccgacttctgaggaccacccgactggcgttcagacttcaactgattatgtcaacccaagcgaccagcccccgactggaaaccagttggcagaagcggaaactgcaacaagccaagagcccccgactggcaatcaatcggaagtaggtccagatcaagaaattcctgaagttgaagttcaggctacaacttcccaaggactggacgctggtaacgacccaacgcctgggtccccagataaagggcaaggatcgcctcacgctcaaccggaaattgcttcaggtaacccatcttctcaagtaatgccaatctgaataactccgacttgcttgtctaatgtttgggaatacatcaggaccactaggcggtgacggagaagaaatccctcgcataaaggcaactactgattctcgtccccccatcttaatcaaatggtgggacgacaacttgcaacctgcaggcattgtcataaatcgacagaaagaagacgaagaggtgcgccagctaaagaaagcactcggaagaagctacccgcattgtaaatgtaagtcttccaggtggctgcctttggcgaccttgtttccttctcagcaagactaaacagtgaatcattgcatagagaatccatctccgtaatgaggccaaaaccacaactttagaaaagccggttcctcatttaggggcccttgaagtggttagggatcagctacactgtcacgcccggaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactccactccacaggcaacttaaccaagaacaagcctagtcctccagatcatcaccttcactgaagtactcctcttctgatgaatgaatattgcaacaatgagcatataacatactcaacaagccacacagcaaatatgcaagtgcacaggataacaaaggatggcataatatagctcatttgcagaaaacaacatttaataaatatttaagagaatagtaaaacagttgaataattaatcaatattaaataaacaccatacaacacacccgtgttgcatatggcccaaccacatttgaaccaccaaccccaattggacaaattaaacctcca

SEQ ID NO: 10563 - DNA, 10938 bp, Oryza sativa
aagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacctttgttatgaccatattattattgttattggtattattattaccttgttcaccctagattaaacaaaacctcaactagtggacactctactcatggcaccactagtttaattttaggtagatgcttcgcaatttaattaggtaacattaggtggtttttcaactatagactttgggaaatattcatatcacctggacactttggaactgttggattattgtggaattggattcacaccgccccctctattcaaaatccccaaaagaggttttaggctgggctcggggtgcatggttttgatagtagcacctcggccatataaggaccggtcttcgggcctctgttgcaaagcactaccatacttccacatgtctagtgggtaaggcttagtttgttgctcagtctggtcataaacaaaagtgcacggattggagatggatgaagtcgggggtcgatggacattctccagggtaaatgaaggctacacgagctgcggcccggtagtcgagatgtcatagcacagagttggtgccctgctgctaggggctcagtcctgcctgcctatcccggaggttccggccgtaggtgggattgggtcggtactcttgtctatggctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgggtttacaaaatagctttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccactgtttcccgtttgtctttgtgtgtgctgggccttcgctgcccatgtaataagttaactatttacgcttccgcttgttaaactctgaattgtatcaactgttggtgtaccttgcctcctgggacaaggattaatgcacgcacgtcaggaacgcccgttgggttatttccggtcgtgacaaatacccagcaagtccaaggaaactacgaatttctgaaaccgtcttgggttgcttccaacttaatactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttctttcgtcttggagtaaatgagaatgtcatcgataaacaccacgacaaacttatccagatattccataaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccagaacggagatctatcttggaaaaaactgtagcaccttccaattgatcaaacaggtcatcaattctaggtaaagggtatttattcttgatagtaacctcattcaacgctcgataatccacgcacattctttgagtatgatctttcttctccacaaagatgactggtgctccccatggcgaagtactgggtctaatgtatcctttctgaagcaaatcatccacctgtttcttcacctctgctaactcgttagctgccattctatatggtctcttatggatagggttagttccaggtaccaagtctatccgaaactctatgtctctcttaggtggcatacccggcaaatcctcgggaaacacatctgggtagtcttgtactataggaatctcttgtagagcaacttggtttaaaaccacaccatgagatttaggagaggacgcaaagaaagaaacagtttccccattgctattggttaaagtcaccttacggttggcacaatctataactcctctatgacgagataaccaatccatccctaagataacatctaggtctttggattctagcaagataagagaggatgggaaaagaacttcttctatttctatagtaacagaaggacaatactgtgtcgaaaatacttgattgcctggggtattaactagtaaaggtctcccaagactaataacttctatcccatgattgcttgcaaaacttttagacaaaaaggaatgtgtagcaccggaatcaaaaagcacagttgcgggtatagagttaacaggaaacgtacccaaaaccacatctggtgcattctgagcttctgctgctgcaacatgattgacacgggccttcggtgctggagcactggagttgttcggggctggagcgttcttcacacgccgaggcttcggacacttatcagcataatgtcccggatcaccacaattgaagcatatcactggtttgctcccctgctccttcctaacgggctggttctgaactggagttgctgcaggacgagcaaccacactgcggttgtcattgccacgattaccagtattgttgttgtagaactggcgttggggacggacaactgatgaagatcctccttgagggtacgatggaacttgaggtccagtaacgagtcgcggcctctggttactgccttgttgtgacttaaattgagcagccctgcgcttcttctgctccatacggttatacttgtcttcctgacgaatcgccttgtccaccaattgttggaaatcccggaaatccgtagacatcaaagcataagacaactcatcatttagtccctccaaaaacttctcctgacgttcttcatcagtgcgaacatcctctggagcatagcgagctaaacggttgaaatcatggaggtactcggtgaccgaacgagatccctggttgagtgctctaaattctctcttctttagagctacaacacccgttggtatatgcgtcttcttaaaagcagttgtgaattcctgccaagtaataggttctcctcccgctctgccttggcgaaaatgatcccaccattcagcagcgggtccatgcaactgatgcgaagcaaaagaaactttctcctgctcagtacactggatcaagtccaacttcttctccaccgcatgcaaccaatctcctgcttctactggattggtggtgctcgaaaaagtagggggactcacacgcaagaaatctgccaacttgttttggggaggtgggggtggattctggttttgattatttgcctgctgattctgtgcctgctgcactaacagattgatcagttgtgtttgttgagccaaaatctgagctagcgttgggttctcttcattgttattggctccacttccacttccacttccagtgccagtgcgcgtgttcaccatctgacgacaagcagagacaacaaggaaagaacgacagagagacacccttagaacggagttattcaattaatttaaattctatattgctcttaactgtgtatgattacatttaagttgcattaacactacctcaccaactttcttacactctgacaagcaaaagaactagactcatgctgttacatcccacccatgatgtaagcaacaactaaaacccacacactcacaaacaaacttaagcaagcaatctaacacagcgaactacggcaacgatctaactaagcgactaattccgccttgcgtcggaacgaagcgatgaatcttcttcctctggagtagctggctctctttcttcaggatcttcctcttcttcctcatcactaatgatgtcgatgacaggctcaacacgatcgggcacagcttcacccatcacgcgaatcttcgaagctaactggagacgagggggcggacaggttctctttcttgcagtgaggcgaagctaggatgttggcggcggcgtttctcctttaagttcagctaattccttctgtaggcggtacaccttgctcttcaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtggggatgatactggaaagctgatgaatccaattcttcttcaaagtgttgacgcaactctccaatggccaccaaagctgcttcttgacaagcatggcagtacgatcttcctccagcttcgaacttaaaagacggaaggtcttcactatcactagccaacgtcacacgaacacgacatttctcctcgtcggggtcatgggaaatctggcgatactcgggagcaacttcataacctacttcaaaagccatcaacctcagctccctgacgaatcctaacacctcgatcaaatttcttggtgaatggcgaggcatctaaagaaacatagaagagaagaattattgcatatttttctaagttagctgcaccaactagacttaactgattttgaccaaagaggaaggaattaaaagagaagacacatacaaaaaccattttataaatatattttttttagaatttaactttttggacagagacaagtatatttttttttgacaaataactaaaataaaactaaaatacttatgatctattataagcacggtacagtgtcaccataaggaagatgagtagtactagtgctaacatgattaaatcgataccataataaatgtacagtgccgactaatcaatgaaatttggtaaagagaaagaaagaaacattttgagaagagcaaccttttgcttttaaaagaaaagaaattgagtttcaataaattttgtgcataaccttgcatgtgctgccaacttaattaatttgtaagagaatagagaagagcagttctatttttttcaaaaatattttgaaggctacttaaggtttaccatttagcttatcctaaagtcaaggtggctctgataccaacttgtcacgcccagaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactctactccgcaggcaacttaaccaagaacaggcctagtcctccagatcatcaccttcactgaagtactcctcttctgatgaatgaatattgcaagaatgagcatataacatactcaacaagccacacagcaaatatgcaagtgcacaggataacaaaggatggcataatatagctcatttgcagaaaacaacatttaataaatatttaagagaatagtaaaacagttgaataattaatcaatattaaataaacaccatacaacacacccgtgttgcataggcccaaccacatttgaacaaccaaccccaattgaacaaattaaacctccaaaccaggaattagccattccagaccaggaattaaatcaattacaccttttcaccaataatgagtagtgtgagactaatcacgaaaaacattgctcaactcacccataaccgcgggtacggctattcgaatagttttaaactctgatcagaggtgtaccactgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccattaaatgtaaccataattaataataataatgtaacatagtttataattaatcccctttagttagctaatgtttctaagcatagctaagcaaacttacatatagcatttagctgaaccaatccaatatataaggttcaagctaatcaatttattacccaaggtatcaaggaatagggcattcaatgcaaattggctataacaaaggagtaggttcacaccacccggtgacattcgaaaataaatgcacagttgaaataaatagagaatttaaatataggatcaacatgctcaaagggttgtggttaggatctgtgtgacttgccttgggcttccacaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaaaagtttagaaacttgaaccacctaaaacggatctacggttatttagttatgattttccgaagttttaatctattagaaaatcgagaaaaaggaaaaagagagagagatgacgtcagccctaaggatgatgacgtcagcccttgcgatgacgtcggcatgacgtcagcacgacggccggctcgggtcgacgagctcgccggcgttagggaggttggcggcggaaacggagaccatctacacgtagaggacaacgagacgaacccgttggtactcaccacgacgagaaacgatgcacgacggcggccggcgacgagaaggaagacggcggcggctcgggtcgacggcgacgagcgagctccggtggtcggcggcaggaaagaaggggcggccgagcttccttgcaccacggcgcacctcttggcgatgacggcaagcgacggcgacggcggagacggcgcggcggcgttgctgaagacggccggcgacggcggcggacttggagagcgtcgcggcggcgctaggaggcacgggaggactcgggagagggggcaaacggaagaggagatcaaggggaagctttatatgagctcggattgaagagatcgagctccaaacgggaggaatcgaatcgggaagaaatcgaactcggttttagggataaaaccaaaacgaactcgattcggacccaatcctcaacgattctctttgattcttgggggaaaagaaagaggagaacgagaggaacaaaacccctcaaaatcccaaaggaattgggctcggatttgggcgcaatcggagcgggaagcggcggctagggttcgggttcgcgcggcggcggccggaggtcggggacggacctgacaggtgggccccacctgtcggcctccgtgagagaggggcgggcggcggcggcttgggccggcgtgggccgcgcgtggggagagagagaaaagggagagttgggccgaaaacggcccaacggcctaagagggggatttttgaactttttcgaataaaacaatttgtgaaatgttgtttcaattattaaaaatacttcccttactcaaataattcccagaaaattctagaaaatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacaaacctaccccccttaaacagaatctcgtcctcgagattcagaagaactagcgaacagatgaggatgagctgacttcaattcatcttctcgctcccaagtggcttcttcttccgaatgattactccattgaaccttgcagaaccgtataacacgattcctggttttcctctcacttacttccaaaattctaactggcttctcaacataagttaaatcttcttgaagctctatacgatcaggatctgcttcctccgtaggtactcgtaaacatttcttcaactgagacacatggaacacgtcatgtattcccgccattgacggaggcaactctaactgataagctacttcacctcttcgactcacgatcttaaaaggtcctacaaaacgcggtgctaatttccctttggtttggaaacgatgaacacctcgtaacggcgtgacccgaaggtatacataatctccttcttcgaaaaccaaatctctgcgacgattgtcggcatagctcttctgacgcgactgggcaacgcgcaacctttcttggataatcttcactttttcttccgcctctcgcaatatgtcagtcccaaaaacttgacgttcaccggtttgatcccaaaggagcggcgtacggcactttcgaccatataatgcttcattcggagacatttgcaaactagcttgataactatggttatatgagaattccgcatacggcaaattcttatcccaacttccaccaaaatctagaacacaagctctcaacatatcttctaaaatttggtttactctttccgtctgaccatctgtttgagggtgataagcagtactgaaattcaaacgggtacccaattctgattgtaacttctgccaaaacttcgaagtaaactggcttcctctatctgacactatcttcttaggaacaccatgcaaacataccactctggccatgtataactctgcaagcttattccccgtgtaagttgttttgaccggtatgaaatgagcgactttggtcaacctatcaaccactacccaaatagaatcatgtcctgccgacgttctgggtagaccggttataaaatccattcctatttcttcccacttccactctggaatcttcaatggttgtaacagaccggctggcttctgatgttctgctttgacccgctgacatacatcacatagagccacatattctgctatctcacgtcgcatactggcccaccagaattgtagctttaagtcttgatacatcttagtgcttccagggtgaatggaatacaaagtttcatgtgcttctttcatgatagtatccttcaactccttattctctgggacacaaattctttctcctaaccacacagttccttgctcatcttctacaaaaccgatggctttaccccttctcatgttcttctttatttcctggatatcaggatcattcacttgagcttctctaacttgatcaaacagagtaggtttagcttctaatgcggccacaaaacctttactgactattcccaagttcaacttttcaaattcttggcacaactcccaaggtaaacgttgaccttctgacatattacagtagcttttcctgctaagagcatcggctacaacatttgccttccccgggtgataatggatttccatatcatagtctttaatcaactctaaccatcttcgctgacgcatattcaaatcaggttgagtgaaaatgtacttcaaacttttatgatccgtatatatttctgtacggttaccgaaaagataatgacgccaaatcttcaatgcatgcaccacagctgccaactctaggtcatgcgttgggtagttattctcatgaggacgcaattgcctagatgcataagcaaccacctttccttcttgcatcaacacacaacccaaaccgagtcgggatgcatcacaatacacttggaaacctttcctcgaatcaggcaaaattaacacaggcgcagtcactagccttttcttcagtacttggaaacttcgttcacaatcctccgtccacttgtacttcacttccttctgaagtagacgagtcattggtctggcgatctttgaaaagttctcaataaacctgcggtaatactgtcacgtcccaaaacgactctaaaatacatcctcgaaattatgcaaagaataagtaaaatccatgtgaaagcctccaacaattaaaatgtgcaaatgtaaaagtcaaataaggcttggaggatttttgtatatttcctaaaagcctaaaatgcgtaaataaattttagtggaattttcagagcacaaata

SEQ ID NO: 10564 - DNA, 1680 bp, Oryza sativa
gaagagatcgagctccaaacgggaggaatcgaatcgggaagaaatcgaactcggttttagggataaaagcaaaacgaactcgattcggacccaatcctcaacgattctctttgattattgggggaaaagaaagaggagaacgagaggaacaaaacccctcaaaatcccaaaggaattgggctcggatttgggcggaatcggagcgggaagcggcggctagggttcgggctcgcgcggcggcggccggaggtcggggacggacttgacaggtgggccccacctgtcggcctccgtgagagaggggcgggcggcggcggcttgggccggcgtgggccgcgcgcggggagagagaaaaaagggagagttgggccgaaaacggcccaacggcctaagagggggatttttgaactttttcgaataaaacaatttgtgaaatgttgtttcaattattaaaaatacttcccttactcaaataattcccagaaaattctagaacatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacatacacgaagccaaagaacttgctaaaaagacagagcatgaactaagggaccggattacccaactccaggattcaaactttgaactgagtggctcatcaaaaggtaacctcaagatctgccccattaatttgtgttgttataatcgtatcctcaactatctggaatcaaaacagtgcaagctgccaagatagctcaactggagaaacgaattcaggccttagaaagtgtcacgtcctgataaattcatcccaaaataaaaatcatcttctaaaaggaataatagaattaattaaaattcgaaaagaaattggcaaacactaaaatacgtacaagaaaaattcaaatatggcccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgcccgcccgtgccctagcgccgccgccgccgctgaatccgccgcatcccgctttccccgcgcgccttaatgaggggggaattactccccgcgtttccctctcccgattcccccccttttccctctctctctccctcggattcgtccggattcatcccgcgaagttcgccggcgtcttcaatggcggccgaaatccccgcggccggtttccttcctcctcggccgcttctctcccttccgacgctataaaatcgttgcccgagctccgctcttccgtttccgccgctcgccgctcgctctcgccgtcgatttcgtgcccgcgccgtgctccgctctcttcgccatcgccgccgagc

SEQ ID NO: 10565 - DNA, 5729 bp, Oryza sativa
gctcccgtcggccgtgccggagaggccgccctcgggcgcgccctcgcggctgccaagtgggcccggccgtccgccgcccgcgcccgcgggtgcggctgacgcgcggaacccacggcgccgaccgccgccagccgcgtgcgcccggtccaccgtggaccgtggggctgacgcgtgggccccacttcccgtggacccggtccgcgcgcccgctcccccggctgacgcaataaataggattttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagcccttttcttttccgttggtcgtgtagacgctgcagcttcggaagatccgcttttcgtggaagtcgaagccggcgtttgggaaagcgagcaaggcaagtcacatcatccttgagcatattgaaatcccagtttacaaaattattttaatttaaattaatgcattatcgctttatttaaattcccgcgttatcactgttttatttagccatgcctatttacctttgttatgaccttacttttattgttattgttattattaccttgttcaccctagaataaacaaaaccccaactagtgggtactctattcctggttccactagtatgaatttaggtagatgcttcgctgattaattaggcaaccttaggtggttttacaactttagactttgggaattctcatatcatttggacactatggaatggttggcttatgttggaattggacacacacctctcttcctctttcaaaacccctaaaacctgtttttggtggggtttgggtgcatgccagttgtgggaagtagcaccccggccactataaggattaagctcgggcctctgttgcaaagcactaccgtacttccacatgtctaatgggtaaggcttagtttgtggctcagtctaatcataaacaaaagtacacggattggagatggatgaagtcgggtgtcgatggacatactccaggacaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagcccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaattatttgcgaaagttcctttttctccttcccctaatgctatttgcaaaaggtttactccgttcttccttcttcggatttcaactagtactagatggtcaggtcagtgaagaagaagatatcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaataaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaaccgcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcacactaagaaaacgagagttccgctacctgaagcaaggagatttgaccgtcacagagtacctgcacgagttctatcgtttggctcaatatgcaccagaagatgtggaaacggatgaagacaaacaagagaagtttctccaggggttaaaagatgagcttgcagtgcaactacttctagaggattatgaagattttgagaaacttgtggacaaagccatgcaactcgaaagtgagcataatcggatgacgaactgcaagagaaggatggttaacaacccagtatttccaggtggtaaccaaagacagcgcactgagccacttcagatcaccggatcttctgttgtgtatcaagagttcctgccccaagaagatgaacgcaatgcaggcaacaacaatagcaatactaatgctgatgataccaccaacaaccatggttcttgccccattcatgaccacttagatcaagcgtgcaatgtcaacatcattcaccaagatatcgacgatagtatcaatgaaggcacccagaatgacaaccctagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaattctaacccatagtagatacaatgtaccgatgttaagcaccgtccctttttgtttaaggcagtgccccgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagtttggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgagccacatcaaggtttcactgaaaggcagcaagccaaaggacctcatcatccccagaagcgtccgcaatccacattcaagaataccacctgttagagataagccgaaagatgattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcagattaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagttatcgacccttgcatcaaatagcagaagtagctatcacccggagaccaggaaagctaatatgagacagttgatggcgagttagaagcaaatgacaagcatggtatcctagtaatgacaagcaggttacgacgcatgacatgaagttgataacttgtccgaggttgactccgaagatatgaatcatgagaagttctggaacggaagcatcactgaactaccgcaacttagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatt

SEQ ID NO: 10566 - DNA, 2179 bp, Oryza sativa
acagtagttcatcatcacgtcttccgtccgtataccgtggtggtatgtggcacgtggttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagcccgctgctgtttatttttgattgtcaggccttaagtgcctttgtaataatgtaaatattatcgatataataaagatgtgtcttttatatcatgtttgtgtggtgtaccccggctttttctgggacggggattaatacactagcgttcgggaaaaggcaattttcccggtcgcgacagaaagtaacaaggcagaattggctgcacaaagggactcggctttgaaggaggttgaaggtattgtcagccaacaacctgagtttctctctttgatgcagcagatcattgacatgaatttgttattgtagaccgcaagatcaagtcccaagcccaattcgacgtcctggttggcaagatcaaaagacttgaaggagccagggatgaggtcgccaatgccgctaccccgcttgtccaggcaatgttctataataacaatggtccgagtagattcgatgcttccgaagtatttgacaagctgagaatcgctccggacacctatttcaagaatattaaagaagccggaagcatgggagcaggtttagcgctagcaatgaccaaatccctgtacccgaagatcgatattgatgccattgatggttttacggatgggacaagcgaagaggctgcccttgatcttatcaacgacactcaaaaagcagccgacaagattgcaggtgatgtcgtagatcggtttcaggataccgaccttcggccgactggtaacaataactctgatgatgagaagactgatactgattaaatgtaaatgtattggatgacgaatgatggaggcacaatttgtataataccggtgtatttatgctgtgcttggtgtttcttgctaagctgttgatttcttaaaagcctttatcaagctttgttgagcctaaaacccgcaaaagctattaaaaactttcagtcctcgtaaactaagtagaaaaatcaagcaaggcaatgatagaccaagtaagcaaattgaattgataaaaatcacactccattattattatagtagcccccgactgacaacctcaagaaaaaaaaggcttgatgttgacagtcaagatagggaaatacatagagaaacttaagcgtagaaacgacgaagatgttcgatattccaagaattgtcaacaagtgtaccatcttcacgcttgagtcggtaggaacctggccgggtgacttcagagattataaatgacccttcccatagaggagataacttgtgccgatctcgtgtagtttggattttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattattagagtttattaaaaagaaaaacctaaaaataaatcctcttcctcctttgggccaagcccagcccaaaggctccctctcctcc

SEQ ID NO: 10567 - DNA, 13059 bp, Oryza sativa
  unsure (1)..(13059): unsure at all n locations
tgtggttgtactcattcttgctcaatctttcccctcttcagtaagagaagctttggagaagatgtcttaggtggagtcctggcttataccccagttgagcgcctgtggagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatgcactagcgttcgggaaaaggcaattttcccggtcgtgacaagctggtatcagagccatctcgactgtaggataagccaagtggataaaacctaaggacatattttataaataaaactatttgcgaaagttcctctttttctccttcccctaatgctatttgcaaaaggtttactcttttcttccttcaaatttcaactagtactagatggtcagctttgcgaagaagaagatgtcgccaattgtttgccgaagctccggaagactgcaggatccgctagcgaagtgtaggaagcagtgaagccagctgtgaagaaggagtgaagatcttggagaaccagtcgcagaacctaagccgccctctagggtagagtcgttagttgtgtgtttccttgcttgtgtgtgtagcgcgtggtttgcatcagtggggtgtgatgtaaccatgctaggttgtttgcttaagcaacttgcagaataagcaaaacaaacaatacatcaataagaagagttagttcctttaaggtcctgtctctagttctggtctattctttcctggcttgtttcctctctcacctcaatccctgtaacagatgtttaacagagaaaaaggaaagaatgtcagcgggtatgcctccagtaactcaagttttcaactcaatccaccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggtccccttttgtcatgattgtagagagcaaggacactatgccctgaattgtccatgggtatatgtcaaagaagccccttcccttggtttagcagggcagacatcgctaaaccagcctcctcacaccaagtcaagcttgcagcctagtgtgcaaagtagagagctcaacggagagaatccattgaatcccgggaaatactttcctcctagcctctcgtaccacgtggggtcacatactaagcaagccaaaggcagaagagtaagaatcagaagagaaaagccccgatgcgaactgaagaagaagtacgtaagatgactattaccagcaccgaatggcctccagcagggataactattcctagacgtcaaagaggaaatactttccgaggtgcacgacagttgacccagcacctcctaagccatggtggcagagtatctgatagtgaagggtcagatcaagtctccttggatgatgaagatgagtctccccgacatctcggcgaggaagagatggaatcaaaggcatgcacccgttgcggggaaattgaacacgttgctagcatgtgtctcacactctgcactcattgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcctgctgcacctgaccctgcaataaatcatagcgataataccttcagcaccaaccattctctgcaccgacagcctcagcaaagaattgtcgtcgatgaaagaagttgtgtctctccccgacctactccaggccaagcaaagggcaatcaacctccggagggcgataccaagcggaagaccgttattcgcctcaaccagcaaccagaaggaaacttctcctgtgaatgatagcaatatgcagtcctatcacatcatcacagaaccaatcaaggatgcagtcactagaacaatgccagctatgtatccatgtttgtgattttcagttcgctacttatcactgtaatcgggagtttgcagcaatcatgtaataaataaatatattcatgattataaacaatgagtttgttatgtttatggaagattcatgttgaggatgcaatgtaccaatgctaagcacctttccttttaggcaatgcttagtattcatgtaatgagggagaaatgtgtaatacagacaagttctatgaggattcttttggaagatgcggatatgtgattatgtgtataattgcttactgataaaggagacctagggtctcattccagaggaactatgttctaacctcgagttaataatcaacctgatgatggaaatgaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcctagttatgaaccaagtgaaatgttcgaagatagtctatagaggtcagattaaaatcgcatctaacaacaaagcttcagatttggcaggaaaacgatcagacaataacaagttcagcagtaaagtcaattaggaagacgtcaaagcatgtcaagtgggataagttggttctgttgagaaacataattcaaaggcaaagttatcgacccttgcatcgaatagcagaagtagctagcacccggagaccaggaaaactaatatgaggcagtttgtggcaaattagaagtaaatgacaagcatgatattcttatgatgacaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcatgtgaagagaagattccatctgcaacaagggatcgagccaagcagcctagagtggagaagttttgctaagcaagtttgttataaaagacgcgatggaagaagtcagacaagaagagaagaccgcccaacctatcttcatgctagccgcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattattagagtttattaaaaagaaaaacctaaaaataaatcctcttcctcctttgggccaagcccagcccaaagtctccctctcctccctctctttctctccctctccttctctccctcctcctcttgggcctcatcccctcctggcccagctccctcccttcccctcggcccagctccctcctccctctctctcccgggctgcctctccccccccttccctcctgggctgcccggcccaggccgcctccccatcctctactcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgccaggcgagtcgtcttcctcccgcccggcttctctctctcccgtgcgaaccctagctcgctccctcctccaaatccgcttgattcaattggccaattccaaaattaattggggggttttaatccccattgaatcctcttcaattgcccccaaattcccccttgatttgtgccttcaatccccgggaacggacgcgccaagtccggccgctttccatggccgtcggccgttattcccgtggccgttctgccctctcccgagcccggctcccgcccccaccctataaaatgggatcccctcactccgttctatcgttttaaccccatcccgagcctccccgtggtccctagccctctccccgccgccctcctctctctcccacgccgccggccgcctccagccgcctgtgccgcctcgaccgtgcaccggccggtcgcgccgtcgcctcctccagcgtcgccgccacctcctccaccccggcctgccctccgtttcgcgcggtgaccgccggaggcgcgttcccgccatcgcccttctctttcctccgcgccggccgcctccagccgcctctccctcctcgccggagcgccgtccggccgcgccgtcttctccctcggcctcgcagccacctcctctccctcggtcagccctccgtttcgcgggaaagcaccggagacgcgtcctcgccggcaaaacagtggcgttgccgccactgttccacctccggccgccactgtcgcgtttcccgtgcgccggccgacgtcgccaccacctccctcggctccgcgacgccgccctcatccccggcatcacctcctcctcgctcgaagctcgccggagtggcctccacgtcggcgtccagtacctccccgcctccggccggctcctgtacgtcgccggtacgccgatcgacgtcgccgcgttgtcctctcctccagctgctcctctgtttcgccggaacaccgtcgcccgtgctggcctctccatcctcatcgtcgccgacgtcccttcggccgcccgttcatcctcgccggctcgtcgtctcgcggcgccgcctccgtcatcgtcatcgctgcggcgtgttccacgccatcctcgcattcgtgcagccgctgccggctgccctcgtcgcctcctcgccggccccggtcgtcgtcgtcgtcgtcctctcatcattcccggtcgtcgtggcgttcgtccctccgtcgagccgttctcatccgtcgtccgcatcagtcaagcaagccgcggcagccccgtcctcgtcttcgtcctcagctccgcgtcgtcaagccttgtgccagccgcgtctcgccttcgtccaaggatcgccgccgaagtcgttccctcgccgttcgcctccgtcgtccccgagctgtctccgccgcgcccgttcgtcgttgtcgtccccacgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtgtctagtggagtccgtttgtcgaccactcgcctcggttgacacacagggtccgcttccatcgacccgtggaccgtctctgtgtacccggtctaccgcggtcctttaggttgacatgtggggtccgcatgtcaacggcgcagccttcctgtcttttccaggctagtgcttacacatattttatagttgcaaagcttaattataataatccgcaaatccccatataacagcattaaacttcggatgatcatatcttggtcatacgaactccgaatcgacccgttcaagtctcctaatgtttgttataacctaaagaaccctgtgctttctttttatgtattgttattgcttctttgtaggcttgtagctttgcttgtgtgcttcgcgtagctttcgtcgtcccggaggttcccgaagcgtggttcgtggtcgtcgccgaaggttcggaaggccgttccctctgagcaaggcaagtcacatcatccttgagcatattgaatcccagtttataaaattatttttatttaaattaatgcattatcgctttatttaaattcccgcgttatcactgttttatttagccatgcctatttacctttgttaaggcattattattgctattgttattattaccttgttcaccctaggataaacaaaaccccaactagtgggtactctattcatggttccactagtatgaatttaggtagatgcttcgctgattaattaggcaatattaggtggttttacaactttagacgttgggaattctcatatcatttggatactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcatatcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtaactctaggatcgtctttataaaatggctttgggcaactaagtgacttttaaatgctgttttctgcaaaacttaaccccgatattattatccccttgtacccccccttgcattaatcatgcatctgccggtgtgacttgctgagtactgtggttgtactcattcttgctcaatctttcccctcttcagtaagagaagctttggagaagatgtcttaggtggagtcctggcttataccccagttgagcgcctgtggagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgtgacagattttcctcaaaaccaggtcgccgactagaaaagctcgtgatcgaacgttgcgattatgatagcgtcgcaacccttgtaaatatcgggccgactgaattaaagctgcttcgcggatttcttccaatcggtgcagatcattcactcggtcctcttcgtagcgttcttcgcgaaaattgtgaaagcgcaaagattcgaattcaacttcactaggcaatattgcttctgccccgtagacaaggaaaaaaggtgactggcctgtggcccgactaggtgtagtacgcaaagaccaaagtactgatggcagctgttccacccattttccagcatagggttttagccggtcaaaaactcgcgcttttatcccttgaagtatcatgccgttggctcgttcgacctgtccgttgctcatcgggtgcgctactgaggcatagcaaattttaattccgaagtcttcgcaaaagtcgttaaaaactccgcgagtgaattgtgtgccattatcggtgataatccgattaggcactccaaacctatgcacaatgttgatgaagaaatctcgagctttatctgctgtgattgtgacaacccgtttagcttcaatccacttggagaatttgtcaatggccacaaagagatgcgtgtaaccgccgactgcctttttgaacgggccaaccatgtcgagcccccaaaccgcaaacggccaagacagtgggattgtttggaactcttgagatggtagatggatttgtctggcgaaaaattggcaaccttcgcacgtgtgcacaattttgtcggtgtcggatactgcagtaggccagaaaaaaccctgccggtaagctttgccgacaatggtgcgtgcggcggcatggtttccgcatattccagaatgtatgtctttcaacaattgtctcccttcctctagagatacgcagcgttgcagaattcctgaaggtcttttcttgtataactcggtttcatgaataacataaagcctacttcgccttgaaatccgctcggcttcatctttatcttgagggagttcttgagaagttaaaaatcgtatgaggggctctctccagtcggcttcaatcatggctatgtcttgagtgtccgcaacttgagttgtttctttctgaggtacggtcggctcataaaggtgttcgacgaatacatcggagggggccacctcgcgcttggatccaaagttggcaagtctatcggcggcttcgttattgtgtcggagaacgtgactaagctcgagtccatcgaacttgtcttccaatttgcgtacctcttgtcgatatgctgtcatgttgtcgtcaatgcaggaccactctttcataacttggttgacgactagctgtgaatcccctcgaactattagacgcttgatccctagggaaatcacgatccgtagtccatggaggagcacctcatactctgcgacgttgtgggatgtggaaaaatgtatccaaagcacataacttaatctttcttcggttggggaaattagaaccactcccgctctagtgcccgaaagcctttttgatccgtcaaaatgcatggtccagtgctccatcttttctgcgggaatatcctcctggcactcggtccattcggcgacgaagtcggctaatgcttgggacttgattgaggttcggggcttgaaggatatgtccaaagacatcaactccaaatcccatttagcaatccgtccgtttgcttcgcggttgtgcagtatatcgccgagcggaaacgatgtaaccaccgttaccgagtgaccgtggaagtagtgggataatttcctggtagtaatcagaataccgtataacagcttctgaacctgaggatatctcgttttggagtcggctaggacctcgctgacaaagtagatcggtcgctggactttttggacatgggcttcttcctcacgttcgacgaccaagactgtactcacaacctgggaggtggctgatacgtatagtagcaacggctcctgtaggtgtggcgaggctaagactggtggctcggtgaggagtttcttgaagtcttcgaaagccttctgtgcttcgggtccccactggaaattgtctgttttctttaatatcttgaagaagggcatcccccgctcgccaagtcgtgaaacgaatcggctgagcgccgccatgcatccagtcagcttctggacgtctttctgggagcttggcggtttcatgttgaggatagcgttgactttctccgggttggcttgtatgcctctatgagacaccataaaaccaagcagcttccctgacggtactccgaaggtgcacttttcagggtttagtttcatcctgaaagcgcggatgcttgcgaaggtttcttctaggtccgagattaaatcatccttctgcttagtcttgacaactacatcatccacgtaagcttcgacattgcggccaatttgcgtcgagaagcatctctgaatcatgcgttgataagttgctcctgcattttttagtccgaatggcatggtgatgtagcaataggccccgaagggcgtgatgaatgaagtcttcaagcagtcggattccttcagtcggatctgatgataccccgagtagcaatccaaaaaactgagtagctcgcagccggcggtcgaatcgactacctggtcaatgcgaggcaacccaaaaggatctttagggcaagacttgttgaggtcggtataatcgacacacatacgtcattgcccagttttcttccgaactaggaccgggttagccagccagtcgggataaaggacttctttaatgaagcctgctgctaacagcttggttaatacctccttgatcgcatccttcttgtcttgtgcgaagcggcggagtcgttgtttaataggtttagcgtcttctttgacgtgcaaggagtgctcaatcacctctctaggaatatcaggcatatcagatggtttccacgcaaagatatctttattattttgaagaaaggtgacgagcgcgctttcctatttacaatctaactcggcgcctattacagcagttttagtgggatcagaaggatctaggggaatctttttagtcttagcatcgctttctccgctcttcgagaccttggtcgcaggcacttctccttcgcctgccgtggtcgcagccagtcggatatcttctcgggcagacgccatctcgcgagtctgggccatctcgcaactttccttatcgcatgtgacggcttgcttgatgtcgctccgtagggataggactcctcggggaccgggcatcttcatcatcatgtaagtgtagtgcgggacggccatgaacttggctaacgccagacgtccgagtatggcgtggtatgctgtctcgaaatcggcgacttcgaagcagatattctccgtgcggaagttttcccgagtgccaaaggtgaccggaagggtgatctggccgagtggagttgcagataaccctgggatgactccgtgaaaaggcgcattgcttggtcttaactcggagcgaggaatctgcatatcatccagggttttggcgaagaggatatttagtgcactgccaccgtcgatgagggttctgcgaagcttgacattacggaccactgggtctagtaccagggggtatcgccccgggtggaccactcggtcgggatgatccgagcggtcaaacttgattgctgtctctgaccatcgaagatattggggtatgttgggctgaacagcgttaatctcccgttcagtcaacttttgctttcttttagattcataagccaaggggccgccgaagatgtggttaagctccttgcggtggtcttagaaacctgccggggggtcgccatcgtccttcttcttcgacgtgctttgtttttcgtcggagttcttccgtgtagtcttggtgtattgttccgcgaactgcttgtagacgaaacaatctttggccgcgtggttggacttaggatgatgcgggcattgggagttcatgatcttgtcgaacgtgttgacgcgcgaacgctttgatgatcttccaccccctcccgtagccggtgtatccttttttggcttccaactggagcccgactgctttgatgcgatgacggcgtcttcagccttggcgtactcgttggctttttcaaacataagtttgactgttttgggaggcttacgcccgaacttgccgaccaattcttcgtggcgaattcctttggtgaatgcggcgatgataacatcgtcggtgatgtcagagatcttgttgcattgttcagaaaatcgccggatgtaatctcgaagagattctccggacttctgaataacattgtaaagatcgaattgtgtgccggggcgctcgaaagtgccttggaagttggcgatgaagtggtcgcgtaattcggcccaagatccgattgtaccacggggcaatccatggagccaggaccgggcggaatctgctaaagccactggtaaatagttcgccaaggccttgctatctcctcctgctgcgcggattgcgagaccgtagacggtaagccatgattccgggttggtggaaccgtcatacttctctattccagtcggcttaaagccggctggccaatccactcgacgcaggtcgttggtgaaagcggcaactccgtctaggtcgtcgtcgtggcgatctagcgaatgatgatggcctcgggctgcccggcgctgtatgatcgtgtcgcaaagatcgacggggcgacgacgaggtggcgaacgaggtcattccactcggcgctccctatgatggtcgggaggcgagtggacagatcactcgtcgtgacccctgctcctgcgattagatcctgcgccagtgatgctaaggcttggctggtggtagtcgtgagatcgaagatgggggactcagctgccactcgacgtgcggacgcttccggagttaactgggaccgaagccgcaatcatggtcttggtctggttcaagatgttgacgacgtggtcagactgattgagctcgttctccttcaggagggtgtcgagaagggtgatcgcggcaacagcattctgttgtggggtgcggaaaaccggtgtcccctcaacgtcttgttggccgataagatctcgcgctcggtgccctgcttccaaggctcgtagccgccggtcttcagcctcctttgcggcccgctcacgctcctgttgctcacgccgtagccgttcttgttcttgtgcttcacgttcctcctccagtcggcgccgctcggcctcgcgtcgtgcttcggtttcccgggcttggcgttgctcctccgtctcgttatcggccataaagacgccgaaatagagaggggtgtagttgtcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10568 - DNA, 765 bp, Oryza sativa
  unsure (1)..(765): unsure at all n locations
ccgattaggctctccaaccatatgcncaatgttaatgaagaatcctcgagctatatctgctgtgattgtgaccacccgttaaccttccatccactttgagaatttgcaaaggcccacaaagagatgcgtgtacccccggactgcttttttgaacggcccactcatgtcgagcccccaaccggcaaccgggccaagacagtgggattgtttgcaactccttcagatggtagatgcatttgtctggcganaaattgcaacttttcgcacgtgtgcacaattttgtcggtgtcgaatactgcagtaggccagaaaaaaccctgccggtaagctttgccgacaatggtgcgtgcgncggcatggtttccgcatattccagaatgtatgtcttcaaacaattgtctcccttcctctagagatacgcagcgttgcagaattcttgaaggtcttttctagtataactcggtttcatgaataacataaagcttacttcgccttgaaatccgctcggcttcatctttatcttgagggagttcttgagaagtaaaaaatcgtatgaggggctctctccagtcggtttcaatcatggctatgtcttgagtgtccgcaacttgagttgtttctttgtaaggtacggtcggctcataaaggtgttcgacgaatacatcggagggggccacctcgcgcttggatccaaagttggcaagtctatcggcggcttcgttattgtgtcggagaacgtgaataagctcgagtccatgatgaact

SEQ ID NO: 10569 - DNA, 672 bp, Oryza sativa
gatatgtaaaagcggctcttaggtgtccgagatttgtaggtttatttgagtgggttgttatgacttttgggttgaagaatgccggtgcaacgtatcagaggacaatgaatttgatcttccatgatttgctaggtattatcttagagatctatattgatgatattgttgtcaaatcggatggtatggaaggacatatggtcgatttgagattagcttttgagaggatgcgccggtatggtttgaagatgaacccacttaaatgtgcttttggtgtgtcggcggggaagttcttaggattcatggtgcatgagagaggagctgagattgatcctaagatgatagaaaaaattcgtgatttcaaagcgccgacatgtaagaaggaagttcaaaagttgctaggtaaggtgaattatttgatgaggtttatttctaacctggcaggtaaaatcgatgcttttgttcctatacttcgcttgaagaaagaagccgattttacttgggaagcaaaacaacaagaggcatttgaagagttgaagaggtatttatctactccacccgttgtgcgagcacctaaagccggaaagccttttcggttatatattgcctccgaggacaaagtcattggtgccgttttgacacaagaggaagatggcaaggaatatatcattacat

SEQ ID NO: 10570 - DNA, 701 bp, Oryza sativa
aatcaattacctccgtatgagtcatattcttcaaaggcacggcttcggcccacttggtgaagtaatccgtagcaactagcacgaacctatgcccctttgatgacgaaggataaatttgaccaatgaaatccaaaacccatcctcggaatggccatggtttgattatagggttcaacatggcggcgggcgccaattgaacattgccgaaccgttgacaagcctcacataccatataatatttgaagcaatcatcaatcatcctcggccaatagaaccccgctcttttaagcaaccaattcatcttgtgggccgattgatgagttccacaaattccttcatgtacctctcccatagccaccttagattgatcttcatctaagcactttaacaagacaccatctatatttcggcgatacaaatctccatcaagcaatgtatatttaagtgcttgccgccgaattttccgatcaaccttaagcgtgcgatcttttagatattgaatcaaaggaattctccaatcctcttcttgtatcctggcacaaacgtccgaattgtaaataattcggactccaaatcgatggagcgtgcccccaacgctctgctgaacaccggtcagaccggccacgcaaggacggtcaaaccgctcgtgaacgccggtcagaccggcggcatgccgcccgtcagaccggcccaagtcacca

SEQ ID NO: 10571 - DNA, 24199 bp, Oryza sativa
ggatttgtctctctctcccggaccctaatctttccatcgcgtcgccggtcgccgtgggccttcgccaccgcctccttgcccctttaaaaggacccccaagcccgccgctacctgccgccacccttgcctttgcccgccgctgtcggtagcgccctagcaccgtgcagccgtgcgccgccgtcgccgccgttcgtccagccgtgcgccgccgccgctccggtcgtcgtcgtcgctcgggaaggccgccgtcgtgatcgccaagccatcgccgacctcgtccgcccctccgtcgtcgccgtaggccaccggaacaccgtcgccgtcgtcaagccgatcatctccgccgccttttcctcaccgccgtcgccgtccgttgatcttccgccgttgttttggtcaccggtgagttcgccgcgtcgccctctacgtgttggtgtcctctgttcgtgccgccgcgccgtcgttcgccggcaagcatgcacgcccgagccgccgccggtagtgacatctccgctgacgtcatcgtcgtcgttccccgtggcctggtcgtagaccgttggatcttggccgtccgttttggataggatcgatctcggccgttcgtttccgtgagccaccgccgtgcacccggtccaccgcgaaccctagccactgacgcaataattcccttttccttttcaaaaataattcattattgcgtcataattcaattaaaatctaaataaatgatttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgttttttctcttttctgtttagattccgacgtttccgaagagttcgttttcgcactagaagaatttgaagagttccaaggccagcaaggcaagtcacacaggtcccaaacaaccctttgagcatgttgatcccgtttaaagctattttttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcgtagcaccagactgagaagtggcggagataagtccacgggggtcgctggggagttcatgccttgtttataaggggatgattatgatccaggaaaggtgcgctttggtggattgtgttgtgcgaggggtactgtcacacctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaaaaatttgtttagctcctggtttggaatggtatattcctggtttggagatagatctgtacagccgggtatggttgttccggatggttgggcctgagcagcatgggtgtgctgtttagtgttgattaaaattgatgattaattactctactgttttataattctcaaatgtttgctaaatgctgcttttgcaaatgagctctatattatgccattctttggtatccttgtgcacttgcatatttgctgcgtggcttgctgagtatgtcatatactcaccttgcaatcattcatcagaggaggagttctacagtgatgctgatagtgtggaggattaggtgtagccctggtcaagctgcctgtggagtggagtcgtctgcgccgtttatctctttttttttccgctgcttagatctttattgattgagaggaactatctacctctgtaatgacattttattcgcttattaattagagtaataattgtactctattatgaatttgttattgtgtgcctcggctgattcctggacgagggttcacacacatgtaagcgtttggaattttggatagaaattccgggcgtgacagtttctacacaacatccaagacatcatgtgagataagtagcattaaatttatgtatagaatagttgtgtttgcattggaagagtagtgtctagtactagtttcttgatgatgtgtagtttatggaaactatatgtagtgttttgggttgggaatggccttaatcacctcgatctaacctagtaaacataaagtaagacattgtgcaatttaatttatatccgcatgtgaacttaaattgaaggcaagcgaaaatggttttttaagtagtgtagtgaggtaattacagagcgtaagtatacaaaagaaatgagatacataccctatatatataggttatcaacaaggaaaacaaattaattggtgagttgcagtcaaaggtacaaacgatcttcgttagtatataaacttgtcagtctatccttgtcgtcatccttgtcgctgtcgatacgaaatataccagcgtgttcattaagaatccagacgattgttgtgagctcaccaccacaggcgagctgcttggcatgggaatcccttgtgcatcgcacggatgcatacaccagaagacgcacccatgctctgaagataaggcgcatcattttcgatgtatcaaacctgttactttcgtctttcaattcaggaatcatatctataagtctctgatatcttgtgtaattaagatttatatcatccggggtatatgggttcgggcctatacgacttagcagcacacgcgcgaaactcgttccgtcagagagaattatattcttgtcgtaaagaatacttgccttttctggcctgagccagtgtccactgacaccaggtctccatttgctgcgcagcgcattctttaagcttggcttctgttccatttctactaggcgatgggccagcttcacctttttctctgtcaagttaccgtgatattcttccttgggcaatatttcatcgtcattagttagagcgtaaccaactgcttcgtacaggctgcgtagcttaaggcccggtagcatatttgggcgcacggcgaccaggaacaccatgtaatctgacaacaccttgatcgcctgcacttctttggacgaggatgagtattgatggctgcataagaggaagacgtccgtggcaatgtgccagatcaggatgctctcttggaatgcaggtgagaagttcagagcatcttctaattcccgctgatgtagatgtgcttccttcggcggcagcggcggcgtcggtgccggcgcctctttttttttatctggatacggctccggtggtgcagctggtttggcttcgtcggctttctcgataggaacagtaggcgggtacgctgacttaagatattcccatatactttcgaacaaatgcttgcagaaatctgatgacatacgaaagcccttcaagtagtggtattggaactccatacaattatcctctggaacaatcttcaccaatattgagatgaatatcctcgtcagcaagaaggtcttggtctgatcttgatcattactagtgcactcgtgcaatatgttgtactgccccatggttccggaccacatcctatagctggttggctccttactgagaaggaaccgaaatagattcaatgagacgatgagacgacggagcagtcgccatttccctgagcacagaagtgcgtgatgaagccagattcgtggcctatcattcaggaaagaataggtccatgtcgaagccactgctttgagtagccatatgatatccagaatgacggtgccagcgagcaatatataggtgatgaagacgtcagccgtcggctgaccttccttgctgtggaaccagaacaacaggaacgcggtggctccagcgaatggaaaggcgacacggatggcgtagccaccccaagtgtgcaccattgctgccttggtgtacaggatgtcatacatgagggagagctccatctcaaccaccttgtacagtgtcttgttttcatcccatgttttcgggagtatttcttgttgctgggcatcatgctcgtattgcaaattatcgatgaaggcacccttggtgatatggagattgccatgagcaaccagcatgatttggtcattatctggtttgccgccacgccttagactttggaggcttgttactcttcgacttggaacctccttcttgctttcgcttcgcatgttttccaggttgccacgctgcagcgcgaaaaacgccccctccaaatatttgcagatggccatacagcagatgatcgaggagacccacagcatggagtcgccaggcatggcgaacatattctggtgcaggatataggcaggtgacacaggtccaacaagctgaagaaacacgtttacactctggcgaaacgagagaacgccgtcttccaaggcgtaggcggtgatgttgtccggcataccagcgtgtagcagcatgaacgccacccagagcgtcaccagctgctcctcctgcggcgtgcgtccggcggccagcatggccagcgcggtggtcggggcccaacgtgacatctggttcgccacccacaggatgacaatccgaaagcctgtcgcactatttcggcggacttcggcacacaagacgaggccgagatgtgccacggagctgatgattaccactaccctggtcgacaacagattccatccaggcatcgtcgccccctgctaatgaatgcatgtgttagtcgagccacaatagagattaacctaaacaatcaagagatgcagattactcaaagcaaaacgaactaattatgtaaacccacgcgtacgagacttacctaccccttttcgaatctgaatttgatggcgttcgatcgatttcctagttaaccactcatggattttacgtctgaatggtatccctatatcaagcttggaaatcagtctcaagctagctaccagcgctagtacagcagcaaacaagatgtacagtgtacacctcttgaattgtgccttgctggtgtgtttaattaacaatgcttgcatccatcaaggatttataggcactactatagaaaaggatatgtgtcagttgacaaccacatatgggtgctggattttgcaaccagaacctttgagttctctcaaaggtgcctttgaggtctcaggaatgaaaagaaaaaaaggccgggtcgttgcatcagcttgatcaagccgatgcatcgggcaattagtccccatcaccccaaccatatttcatcgcacttttaactacatttaatccaagaaaatacaagaacaataagaacacaaaaacataaacataaacaacacaagcaatgtgaaaggaggggagggcgctaccgcctcctcccctcccgccgaatctgacggaggggagggcaccactgccgctgcctcccctctcgtcgaatttgttggaggggagggtgccgctgccacctctgagtcgctgggccgccgcagcctccccttctgccggatttggcgaaggggagggcgccaccaccaggtaatgcggtggagagagagggagcaagagttagctgagagagggggagagagagagggataggggaggaggcggagaggataaaggagaggggtaataaagaaatagagcaaggggtgatcaaaagggagagatattggtggaaacaagctgtgattcggcttagtcgggtggttttcttaataagtgccattatttcataaaactgacacctacattataaatatagttatcggtttttaaaaaatcaggacctatgatatattataggtgttgatttttatttagaaccgacacctatctctcaacaaaggtaccggttctagccgatggtgtgtcatggatgcgcgttttggatggaaaaagcaagataggtgacggttttagcattttcggcatatagtgccgatcggtatgttattgcgtgcgctctgcaatttcattaccccaaaggctaatatgctggagtgtatgctagcatgatgatcaacatttttaataaatttgcgctattctaggcaaggatgtagtactaggtatgcactgtgcttttactagccacctaatagaaacaaactagagggactaaatttaacgcactgatctataaatatcaattgtttgtacaactatatatatagcaccacatgagcatcactaccatatgggggaatatgtggtgggatcctagttgcttctaccacagctgtatttgctaaaactcctcttccacaatctccaagtgaatctagttagtagctaactcatttccttgaaggaatctctcttctcagaatcataaggaacgagtgttctagagtttatgttttagctgacaacatgtcaaattacagcattcttaatttcaccaggatttaggtcatgtttggcattactccagatctcaaagccataatagatttgaagtttatacattaaattacagtgctaatttagaaatataagtttcatctgcaatatgcaaaaaaaaatgtaaatgttatcaatgtaattatagacgatgtagatccacgccaaaaaaaaaaaatcaatccagaatttaacatctgcttccaacctatgtaaatagtgagaaaaattctaaaaataagtcgagatgtactttgtaatgcagctaccatcttacattgtcaaaagggcaagtactatctagtactttgcgagttacttgaactaaacgacgtgcatcacaaacttccaccatcccacaccactagcattccaaggtcatgttcccccttcccatcctcttcgcacttctcccattgtaactctcttatactatcatgtttatatcttatactatgtacctaacaaactttctctcccaaaaccactcaataatttttggatcttgccgcactggctagaaactgaccgagggagaagaggcggttcattttcccttcagcttcccctttacgtgtgttgggcataggaggagcaacagtgaggaggaagtcatgaggtggaagggagcgtgtcatcagagtagaaggttggctacactgcccggggacttgagacttccattgacctcacctctgctggttttgttgacaccgtacatacctggcttcgaatatgccacctccacaaagcaccggtcgccaatctttttcatattggagctctccgcattgttgggacaacttgggagtagcatcctcactagcaaccgccttcttcctctccgcactagttgagggcaactatctccgcatcaagctatcctcctcaagccatcaacgatgaagtcatgtcctcgtctcctccgctgtggccaccaccgccttgtaacgacaactgcgcagtcccaggcatgcttaggctgccttcttctgctgatggatggattagtcccaacactaattccccgatgtcatcgagatttctgcacctggatgtttcctcaatgtggtgacgacaacctcattccgagccccatgccttgagctaccgatctcatccacaatgccatcagttcaaagggtggtgataggggccagacgacgattgcaaatctagacatagcgacatgatgatagctagctgatggtagcagatctgactagcaatatttgcgcacggaggcacgaaaggcaattggtggcggtggtgccttagtcttcgagaggagaggtggagaaatgccattaccataactttccaatccctcctctctattgggtttagtcccatgttgctaacaattgagggtctagtaacaagtattgaggtcaatgcataggcttagataaaacaaaagagattgttggccttggactgaaacaagtcttcgaggctacataggttaatgggggagattgttggggctgatgtgagacggaggagattgttaagtttagtcttaaattggtaactgacgatacgagagtacaactcaaaatacgagggctgtccgcacccatcagctattcttttgggttgtgtaggtcaaaggacgagcttgtggtgttggtcggacctatggcctatgtgtggccaacagttgatgagctggtctacgctctctaatagtactatctcgccggtgaagcccatgatgaccaccatcgtgttgtaatcctgcgctggtgcatcaggcagtggttgcttgctctctcaatgctggtatagtgtcctacgcctttgtccatgcatgcataagtgcttggaaaaaaaattgaatgacttgtctcataaaaaactttagaaaatacctcacatgatgatattctaatgaaaaaaatgcatacgagtgaactgtggaaatttgatgtttcaattggcataatactctgttgcacattttatgtttagatctattttttaaatttttttcaatattttagccattgggacttgacgtttcacgtggctgttggtgttgcaatcactattttttaaaagttgcatttctttgaagagttttatcaagaaaattgaaacatttgagccagtgcagaaactatttcctacatgtggtgaaagcacctgattcttaggataaattagccatccaatctttagccatgtgctgaactcttgttgggcctgaatatccattacagaacacactagaaacgggttgtgtcatgtgttaatcgcaataactaaattattaaattttgtcatattttttagcaattattgctgccatgttttaatagattcaggctactaataattatccaacaaaactaatctaaaaaaaggaagaaaatggtaaatgtcgatcagctaaaagtaatgacggctcgctgtgttcaccacctgtagcaatattttaactatactcccttcatctcaaattttaactaccattatggttcatatgtagtacgaatgaagcaatattttgggacggaattaaggagtatacaggtgcagtaccatgaatacacttcctttcttatcatgtgaaacctcgttccacttgttctctcttgataccaaaacaggtcgccctgtaaacatcatgccccaaccatcgacattacctcctacctgtaattaagggcgtcgcataacgatgaacacatacgacaaaattgattgctgcaacaactcatgctctgcaacttgtttcatggcctacctagttgcaacttgcaagtgaggaggtggatgtgtccttggccatgtaccgcatgtatcccatgtatcgaacaagtgaggaagaacatatccccctatgtgttcgatacatgggactgggaaccatcttcttcacacggaaaacggagcggtccattagcgattgattaattaagtattcgctattttttttaaaaaatagattaatttgattttttaagcaactttcgtataaaattttttttgcaaaaaaaaaggtacagtttgaaaagtgtgcgcgcaaaaaacgagaaaaataggttgggaacaccctgaaacgaatgctattcttccctctactttcctaactcaggccctatttacttcccaaaacataaattttcatgttgtcacaatgaatgtttgaacacatgtatggagtattaaatgtaggaaaaaacaattaccagaccctaatggggtttcctgacagaatctataatttgtttcattattatactacgtttaatactttaaatgtgtgtccgtatatccgatgtgaaaatcaaacctaaaaattttcccgaactaaacaaggcctcacctcattctttttacccgtgcacgcttttcaaactgctaaataatgatattttttttcaaatattttctacaggaaacttgctttaaaaacctatctatatatctatctatactaatcgggcactttgaaagagctctcactttaatcagaaaactccgaccgttggttaaatgagccgtagcatcagaacaatgaattacaatctaataatctataacgctgttggctaattaagtctttaaacgtgatgccgtgatgggctcttttcaaagcccatatactctaccaacccatgctcttttataccaagaggaacggtagcaaatcggatggcagcgagagattgttggcaacttttttgacaagttgacaagtacgatcgcagcaccttaagccttgcggtgatcctagagtcgccaaccacctcgatctagcaaagagctaaacctagatgggttttgataactaaaccggctagcggagccgatttctagatagctacccgtctcgtgggcaaaacaaaaggttttcaggacaaacctacaaagagatgtcgcactctcgcagcggcggcggacggtttacggcgcaaaccgacaaagatggacaaactaagagaaaactaaaagcaatatgaaaagaacgattcgattgattgatagattgatttttacagtgaacctgccttgtcccttatataggggttggttttgccctctacaggccctcctccacgtacaacttggggtagaaaccaaaggaaacccgaaacatgcctttccgagtaagaaacctcgaaacccgacgaaacagggtcggactcggacctgccggtcagaccggccacacaccgccggtctgaccggcctacaaccggcggactgaccgcccaacacatggcggtcagactggcccactcggaggaaaccggtagatttccaaattttggcaatctttcctattttaatcctagatgccaaagttgggtgtaaacacatgcccccctgcctttttgatgaacaatgtgaatctaaaagcatagagcatgtttttggtcttaggacgataattcaattaccgaccatagtacctcctaagcatcttgccaaacactcgggaagtatttcttcaagtatttcccgttgattgcccgctgaaaacgctccccttgaagtgtctccaaaaagtatgcgttccctcgaacaatgccgcacactcgataaggaccttcccaactaggagaccgcttaccgaactccttggatcgagtacccaaaggcaaaattgtcttccaaaccaagtctccaacttgaaacaattttgctttcaccctcttcttgtacgccttggccaccctcttcttctctttttctatctcttccaatgccttcaagcgcttgtcgatgacttcatcaaggttgtctcccatcaacatcttgtaatattcacttgacaaatcatcttgcttgatataatgaagagaaccaagatttacctccactggtaaaacggcttctcgaccataaaccaactcaaaaggagtgactttagtggcaccatgtttagatattctatgcgcccacaatgcttcagaaagcacgtcatgccacctcttcgggtgttcctcaatcttcttttttactagctttaacaatgttttattagtcgactcggcttgtccattagcctgagcgtagtaaggagaagaactcaacaatttaatgccataagatttggtaaaactcttcacttccttagacataaaaaaagcaccttggtccgtagttaatgtttgcggaatactgaacctatgaataatatgctttaaaataaaatcaattacctccgtatgagtcatattcttcaaaggcacggcttcggcccacttggtgaagtaatccgtagcaactagcacgaacctatgcccctttgatgacgaaggataaatttgaccaatgaaatccaaaacccatcctcggaatggccatggtttgattatagggttcaacatggcggcgggcgccaattgaacattgccgaaccgttgacaagcctcacatcccatataatatttgaagcaatcatcaatcatcctcggccaatagaaccccgctcttctaagcaaccaattcatcttgtgggccgattgatgagttccacaaattccttcatgtacctctcccatagccaccttagattgatcttcatctaagcactttaacaagacaccatctatatttcggcgatacaaatctccatcaagcaatgtatatttaagtgcttgccgccgaattttccgatcaaccttaagcgtgcgatcttttagatattgaatcaaaggaattctccaatcctcttctgtatcctgggcacaaacgtccgaattgtcaaataattcggactccaaatcgattgaagcgtgccccccagcgctctgctgaacaccggtcagaccggccacgcagggacggtcagaccgctcgggaacgccggtcagaccggcggcatgcggccggtcagaccgccccaggtcaccagtcagaccggccgtgcaatgccggtcagaccgcccctggtccccaattctgccaatttcgcataaagatttaaaatcaagtatcgactcttctaatatcataaataacccctttttcacattataaccaaatgcttgttgtgccaagtcattcgctctagaattatcacgcctagcaatatgtctaatagcaaaattttcaaaattggtaataatatctaaacatgaatcgaggtaactatttagtgacccgtccaagcatttgtagattctggcgacttgttgcaccaccaattccgaatcaccaaaggcctccacatatttagatccaaccatctccataacttgtaagccgaacaataaagcattgtattcggcttgattatttgtgcaataatattccaaacgaaccgatgcctcataacacatgccattaggtgaaaacaaaactacccctatgccttgaccttctttgcaagaagaaccatcaaaataaatcttctaaggtataatttcaattaagcaaacctctccctcataagcaacatctatatgatggtctactataaaatcacatacaatttggccttttatagttttcaatagttcataagccaaatcatattctatcaaagcatatgcccacttgccaattctcccacttagaattggcctttgcaacatgtgtttaataacatcggcttgacaagtaactatgcatgtactagataacaaataatgcctcaacttggtacaagcatagtataagcataaacaaagtctttctataaagacatacctcgtttcggcatccaaaagacggcggctcaaatatgtaatgatatattccttgccatcttcctcttgtgtcaaaacggcaccaatgactttgtcctcggaggcaatatataaccgaaaaggctttccggctttaggtgctcgcacaacgggtggagtagataaatacctcttcaactcttcaaatgcctcttgttgttttgcttcccaagtaaaatcggcttctttcttcaagcgaagtataggaacaaaagcatcgattttacctgccaggttagaaataaacctcatcaaataattcaccttacctagcaacttttgaacttccttcttacatgtcggcgctttgaaatcacgaattttttctatcatcttaggatcaatctcagctcctctctcatgcaccatgaatcctaagaacttccccgccgacacaccaaaagcacatttaagtgggttcatcttcaaaccataccggcgcatcctctcaaaagctaatctcaaatcgaccatatgtccttccataccatccgatttgacaacaatatcatcaatatagatctctaagataatacctagcaaatcatggaagatcaaattcattgtcctctgatacgttgcaccggcattcttcaacccaaaagtcataacaacccactcaaataaacctacaaatcccggacacctaagagccgtcttgtacatatcctcctccgccataaagatttgattgtagccggcattaccatctaaaaagctaatcaccttatgacccgaggcatcattattggatactatagtgaactatatgtctttgttgtctcggtgacgcataatgttgttgaagacacattgcctggggagctattttatttgataaactcatcagctagtctcaaaatcaaggggagaatgttggttaattttatcggctaatgccggttagttaggataaggataaaatcccaccgattttcctatcctaacaagaaacaaactaagagataaatctgttttgtgtgatcggtaaatagattcgaattttagattgagaaaacccccgagcccccccctcccgtgtcgcttatataaagaaagagaaggagggaggctgagtgactacttaactctctccaaccctaaaccctaaatcaatcgcccgatcgattagacactggaaggggttcgtgaggtatctcacaacagaagaaacaaagaagaagaaagaagagaagcaatagcttcatctcaggtcagttagatcaattaatttccgcataagtagaaggtgactatgtttaggctaagattcaattaattagttggattaaattccaacattatggactctgactctcgctctcatataggctaagcatatccaaccacattcgagcccgattctatcgaaatgttatcggctcataactctattattaaaagtagaaactaaaatacacattcattagctcggaaactagccaaaccctggacttgggggggccctaatgggcgatcgatcgccaggcgatcgcctgggtgatcggatctggcccccctccccctatactcctccctcctctcccctctttctcctccccttctcctctttgtactacagtagaccacacaattgttttttaaaaacaaaagttagaaaaatttatgtctagaaattctatatataaaaaatttgaattcaaattcaaatttgaatcgggtatgtaaacttttgacttataaactttgggtctataaactttaggtgtataagctttagatgtatagaaatactatgtatagaaaagatttgaattcaaattcaaatttgaatcagatataattcaaattcaaatttgaatcgggtatataaacttaggtctataaactttaggtgtataaactttcgatgtatagaaatactacatatgaaaaatatttgaattcaaattcaaatttgaataagatatttgaattcaaattcaaatttgaaacgggtatataaacttttgacttataaactttaggtctataaactttagatgtatagaaatactatatataaaaaatatttgaattcaaattcaaatttgaatcggatatataaacttttgacttataaatttttgggctctaaactttagatgtgtaaactttaggtatataaatttactaaaatcggaaagtaatgcggtgccaaaaaaggaaaccagatggagaggtggagggagggaagggggggcgggggtggaaatgatcgccctgggcgagcgagggcgatccctcgctcagtagcatttccggttacgctgcccctcttatgtctatccctctcgagctgacatccatgatatggatgctttcgaatgttcaacaattattagatgaaattatagaatctcgttgcacgtttttcaaactgctaaacgatgttttttgcgaaaactttatatatgaaagttactctaaaatatcatattaatccattttcaagtttgtaataattaaaactaaattaatcacacgttactaccatctagttttgcgtaaaacacttcatgatcaaatatgtaaaaacgtgttttttccacctgaaaaaaaaaatttctagtagtgtccgtcgggctgacaggcacgctctgcctgccgcgcgccttgcacgccaccatgccatcctgtcgatcgcttgcctgaggtgatattgaacgtgacagattttgtgacagaatcggagactgacgttaaagtggtaagagcaagtcgtaatttatgttatagcaatcctacacaatcttagatgctatcgaacgagacaaaatttgtgacaattagcctgccgtgttggaaatttgtctaggttactactagcctagtccacctgatgccactagaattattgtttgccatgttggaataatgaaatgagtcatctggcctggtgttcttggcgtaactaactaatgttctaattattaaatttcttaagaatatacatgacactagctagctagaaacaagtgattagctccctcttgatattattacaacatgaatactgttggtaacttttttgacaagttgacaagcacgatcatagcacccttaagctttgcggtgatccaagagtcgccaaccacctcgatctagcaaagagctaaatctagatgggttttaataactaaaccggctagcggagccgatttctagataactacccgtctcgtaggcaaacggaaggttttcaagacaaacctacaaagagatgtcgcactctcgcagcggcagcggacggtttatggcgcaaaccaacaaagatggacaaactaagagaaaactaaaagcaatatgaaaagaacgattcgattgattgatagtagattgatttttacaatgaaccagccttgtcccttatataggggttggtcttgccttctacaggcccttctccacgtccaactcggggtaaaaaccaaaggaaacccgaaacatgctttcccgagcaaggaaacctcgaaacccgacgcaacagaatcggactcgggcctaccggtcagactggccacataccgccggtctgaccgcccaacacacggcggtcagaccggcctacctccaaggaaaccggtagacttccaaattttggcaatatttcctattttaagcctaggtgccaaatttgggtgtaaacacatgcccccctgcctttttgatgaacaacgtgaatctaaaagcatagaacatgtttttggtcttaggacgataatccaattaccggccatagtacctcctaagcgtcttgccaaatactcgggaagtatttcttcaagtattttccattgattgctcgttgaaaacgctccccttgtagtgtctccaaaaagtatgcgtttcctcgaacaatgccactaactcaataaggacctttccaactaggagaccacttaccgaactccttggatcgagtacccaaaggcaaaattgtcttccaaaccaagtctccaacttgaaacaattttgctttcaccctcttgttgtacgccttggccaccctcttcttctctttctctatctcttccaacgccttcaagcgcttgtcgataacttcatcaaggttgtctcccatcaatgtcttgtaatcttcacttgacaaatcatcttgcttgatataacgaagagaaccaagattcacctctaccggtaaaacggcttcttaaccataaaccaactcaaaaggagtgactttagtggcaccatgtttagatatcctatgcgcccactacgcttcggaaagcacctcatgccacctcttcaggtgttcctcaatcttcttttttactagctttaacaatgtcttattactcgactcggcttgtccattagcctgagcgtagtaagaagaagaactcaacaatttaatatcataagattcggtaaaactcttcacttccttagacataaaagaagcaccttggtccgtagttaatgtttgcggaataccgaatctatgaataatatgcttcaaaataaagtcaattacctccgtatgagtcatattcttcaaagacacggcttcggcccacttggtgaagtaatccgtagcgactagcacgaacctatgcccttttgatgacgaaggataaatttgaccaatgaaatccaaagcccatcctcggaacggccatggtttgattatatggttcaatacggcggcgggcgccaattgaacattgccgaaccgttgacaagcctcgcatcctctataatatttgaagcaatcatcaatcatcctcggccaataaaaccccgctcttctaagcaaccaattcatcttgtggtccgattgacgagttccacaaattccttcatgtacttctcccttagccactttagattgatcttcatctaagcacttcaacaagacaccatctatgtttcggcgatataaatctccatcaagcaatgtatatttgaatgcttgccgtcgaatctttcgatcaaccttatgtgtgggatctttcaaatattgaatcaaaggaattctccaatcctcttctgtatcttgggcacaaacgtccgaattcacaattaattcggcctcaaaattacttgaaacgtgccctccagcaccctgcctagaaccggtcagaccggccacacagggccgatcagacctctcagggacgccggtcagaccggcggcatgcggccggtcagaccgcccctggtcaccggtcagaccggccgtgcaacgccggtcagaccgcctctggtccccaactttgccaatttcgcacaaaaatttaaaatcaagcaccggctcttctaatatcagaaataaccccctttttacattataacctctgcttgttgcgccaagccatttgctctagaattatcacacctagcaatatatctaatagcaaaattatcaaaattggcaataatatctaaacatgaatcgaggtacctatttagtgatccatccaagcatttgtagattccggcgacttgttgcaccaccaattccgagtcaccaaaggcctccacatatttagctccaaacatccctatcacttgtaagccgaacaataaagcattgtattcggcttgattatttgtgcaataatattccaaacgaaccgatacctcataacacatgccattaggtgaaattaaaacgacccctatgccttgaccttctttgcaagaagaaccatcaaaataaatcttccaaggtataacttcaactaagcaaacctctccctcataagcaacatctatatgatggtccactataaaatcacatacaatttggccctttataatttttaatgattcataagtcaaatcatattctatcaaagcatatgcccacttgccaattctcccatttagaattggcctttgcaacatgtgtttaataacatcggcttgacaagtaactatgcatgtactagacaacaaataatgcctcaacttggtacaagcatagtataagcatagacaaagtctctctataaaaacataccttgtttcggcatccaaaagacggcggctcaaatatgtaatgatatattccttgccatcttcctcttgcgtcaaaacgggaccaatgactttgtcctcggaggcaatatataaccgaaaaggctttccggctttaggcgctcgcacaacgggtggagtagataaatacttcttcaactcttcaaatgcctcttgttgttttgccccccaagtaaaatcggcttcttttttcaaacgaagtatagaaaaaaaagcatcgattttacctgctaggttagaaataaacctcatcaaataattcaccttacctagcaacttttgaacttccttcttacatgtcggcgctttgaaatcatgaattttttctatcttcttaggatcaatctcagctcctctctcatgcaccatgaatcctaagaacttccccgccgacacaccaaaagcacatttaagtgggttcatcttcaaaccataccggcgcatcctctcaaaagctaatctcaaatcgactatatggccttccataccatccgatttgacaataatatcatcaatatagatctctaagataatacctagcaaatcatggaagatcaaattcattgccctttgatatattgcaccggcattcttcaacctaaaagtcatgacaacccactcaaacaaaccaacaaatcccgggcacctaaaagccgtcttgtacatatcctcctccgccacaaagatttgattgtaaccggcattaccatctaaaaagctaatcaccttatgacccgaggcatcattaatcatcatgtcggctataggcataggatactcatctttaggagtagctttatttaaatctctaaaatctatgcaaactctaatcttaccactccccttcttctccaccgggactatgctagaaacccactccgcataacgacatggcctaataaaccccgccttcaataaccgatcaatctcttctttgactcggtcatataataaaggattaaaacgacgaggtggttgcttataaggcctaaaacccggtttaattggaagccgaggctcaacaagctcacggctaagacccggcatctcatggtattcccatgcaaagcaatcaacatactctttaagtaactcgattaccttaaccttataatcggctttcatgtttttgtttacaaaagtcggccttggtttaattccatcacctatgtctacttcctctaatggatcggccgatgtaaacccttgtccaagcttctctacctcatcaaaatctctaacagtttctccaatatcgttctttgtagaccgatattcttgcaccctttttttaaccactctaaactagcctctttactcattatacaagtttatatggcttagccgtgctacactagccggctttacagagataggtacaaatttgccatcggagatactaataaaatcatagctagaaaaatccctccccgataagtattagatattcccatggcgccactcaaaagtagcatcggccatcgcaacctctgccgatgtatccgcttgcacaatttcaacatcatcgccgtcccattggattaaacattgatgcaaggtagaaggcacacaacaattggcatgaatcgaacaacgacccaaaataacattgtagttaccttgcacatcgacgatgaagaaagcggttggtagcgtcttgtttcccacggtgagctccgctgaaacgatacccctcgcctccgttggttaaccgttgaagccattgagaatcatgttagtcttcttcaactcatcatcctcgtgccccaacttcttgaataacgagtacgacatcaagttcacagcagcacctatatccaatagcatcctagagaccggcttcccatcaacatggcctttgaggtagagaagcttcatgtgacggtttgattcatcgggcttctaaaaaaccgtgtctttaggacctaatgagaattgagcaacctcggcttcatccatagcacaaaactccataggcaacatacacaccatgttgatatccatgtcttcctatggagacgattttccttcgtcaaccgattgttcttccttctcctcaacatcaatcggttttgccttctctatggacttaggcctccataccggtggtggtcgcaactcattgaactttttatccctttgttctttcgcctttttctctcttagttcttgggtccgaagacgttgcaaccttctcttttgtgtagccgttaaatctttaggcatccacctaggatttggctctgttccaggaggtaaataatgtcctctattaaccttgctcgaagacgatgaaaccctcacatcgccctttgtagccctctcatcaaaccggcgctggagcccagtcagaccggtcgtagaccaccggtcagaccggtcgtagaccaccggtcagaccggccagacgcgccggtcagaccggcctgaagcctcggtcggaccgctgtctagtcggcggtcagaccggcctgattgcccggtcagaccggctacatggccgtggtcagaccggccgactgcgatgagctggtaccggcttcggattttttgtttggggacttttcaactccatctccagaaggtataggcacatcatgggatcctattttgatagtaatcacctccgaagtcctttcctccaccttggtgcgctttccttccctcttttcttcattaacccgatttttaccataaaattggcttttgtttggtgaagataagcgctcatggattggcctccgtggtcgtccccacccttggttgaattgcattggaggcatatggttgtacattggcggcgttgccccccatgacatgaagtaaggataagaataacccggcggcggcattggataagaacccaatgacatgtcttgtggatgaaagtatggaggtgaacgcaaccgtcttagtgaatgaccaaatcgccccttagaaggtgatcttggtcttttccatttgtcgtgattcctctcaccaccttgcttctcatacttctccaaaagcatatcaaaggtcactttggttttcctaggagccttagaagtcgaagcttcacccttattctccttccaaacaccaacctccggcttctttggcaccatcatcttaggccttggctcaccaatgaccacttcctttcccttagtagattcggcttgctccggccgaatcaacaccttcttattattgaaattaattgtatttactggaaaaggatcatgatcaagcttcatcttggagccatcggtgaatttcaatcgtccttcatctatggccgattgaacctgtcgttgaaacacattgcaatcattagtagagtgagaatgagaatcatgccacttacaatatgcccgacgttttaactcttcttgtgatggtatgacatggcctttaggtaatctaatttgtttctcttgtaaaagataatcaaaaatcttatcacacttggccacatcaaaactatacttaacttcactttgccgatctttacgaggagtcggcattaaattagaacaaacaaaaggtttatttttgttggtccatgaccattcggcaacataaatatcatgatcaccctcctcttcactatcactagcatcagagtaatcaactacattaacattaggctttttgttgaatggtctagcaaattttttattatccttaacccggcattcctgagccagagccctttgcataagttgactaacatcaagaaattattggccatctagtttctctctaagaggagcaacaaaaccattaaaagcaagcccggccaaatctctatcagttatattcaaagtataacatcggtttctaacatctctaaatctcttaatataatcaacaacagatttattatatttttgtcgcgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttactggaattttcagagcacaaataataattattaagaaataaacaaagttaaaatgattttataaaaagaaaaaccctaaaaagtcccctttccctccccctctccctcttgggccggttcggcccagctccctccctctcccttctcctccccgcggcccatccggcctctccctgcgcgcgcgccgctgacgggcgggcccgcccaccaacctcgctgacgggtggggcccacccgtcatccccttcctcctgccgctcccgccgccttgcccgcgccctagcgccgccgccgccgcgaattccgccgcctcccgccgtccccgcgcgcaataaagtggggggaattattccccgggatcccatccccctttccccccatttttccctccctctcttcctcggattcatttggaaacctctcccctaacctcgccggcgccattaatggcggccaggtctcccgcgcccatttcccccttctccgggcgccttttttactcccaaccctatataaacccttcccgagctccccaccgccgtttccgccactcaccgcccttttcccccgccggaatcgagctcgcgccgtcgctttctctctccgccgtcgccgccgagctccggtccaccgccgtcgtcgccccggaccacctcccacctcggcgccg

SEQ ID NO: 10572 - DNA, 10324 bp, Oryza sativa
gtgcctatgggcgccgccggctaccataggggcgcgggcgcgccacctcccgccggtcgtaccgtcgagggcgtctttaagcacgcctagcggctgccgcgtggggcccggccgtcagccgcccgcgccctcgggtgcggctgacgcgtggggcccacggcgccggccggtgtaagccgggtgcacccggtccaccgtgggccgtgagactgccgcgtgggtcccactcccgtggacccggtccgcgcgccccctcccccggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaagttattttgatttaaattattgcattgtcgctttacttaaattcccgcattatcactgttttatttagccatgcctacttacctttgttatgaccttattattgctattgttattatttccttgttcaccctagaataaacaaaaccccaactagtggacactctactcatggtaccactagtatgattttaggtagatgcttcgctaattaattaggcaacattaggtggttttacaactctagactttgggaatattcatatcacctggacactatggaatggttggattattgtggaattggattcacacctcccactctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcggcggtcgatggacatctctaggacaaatgaaggctacacgagctgcggcccggtagtcgagatgtcatggcacagtaccggtgtcctgctgctaggggctcagtcctgcctacctgtcccgggggttccggccgtaggtggggttgggtcggtactcttgtctatggctaggatgggttggaaactatgtcatgtcttccgtccatatgccgtggtggtatgtggcacgtggttacacgtgaggaagacgtgtcttatgggtaaagatgtacacctctgatcagagtaaaacctattcgaatagccgcgccctcggttaggggcaagccgagcaatgtacccaagttagcgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggatcatgtttacaaaataactttgagcaactaagtgtcttttaatgctgtttactgcaaatcctaaccccctatattatggcttccttgtacccccttgcatttattctgcacttgtgggtgtgtcttgttgagtacagtggttgtactcagtcttgctcaatttttcccaaacccagaagaggaggccctggaagatgaaggctttggtgtctagctcgtgcctgtcgtcaagcgcctgtggtcgtcgccctagtcttccgttgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccattgggttaattccggtcgtgacaatttttgcttaaccgatgttaaatcacataacctaagctcagtttctccagtatagaaataatcatgaaattgttcctctaattgagcccaagtatgaattgaatttgccggtaaagaagtaaaccatataaaagcattaccggataaagataaagaaaacaagcgcaatttaaaagtatcactattagcctcaccacattgcgctaaaaattgacctatatgctcccatgtggtcttaccatcctcaccactaaattttgtaaattcgggaactctataatttctagggaacgacacattatcataataatccggatatggttttttgtaaggcctatcacgattcctagtttcgatcccgaatttagtcctcataatatcactaatcatgttctccatgttattaggtccttgtggatttggtggtgggtttggtggcctaataggtttggtttgtggcgcaatatgattatattggccttgactagtatcgggaggatatcctctaaaaacatcattgtaggcattagggatatgtgggggaatttgaggactagtggtggcagtagatacaggggatcaaatgttctaaagtggtacgaataactagcattagtcattggatcaattccctgtatcggcacaattgcgccggtctgaccggcccaaggcccggtctgaccggcgtcatgttgcatggtcggaccagcctgagggccggtctgaccggtgggataatacccggtcggaccggccatctggccggtcggaccgacggcataatacccggtctgaccggccgtctggccggtctgaccgacggctgtgtcgcggtctgaccggccgtcaggcccgatcgaaccggtcacgaacgccgctccgttggttttggaccctattggatctataggaggttgatcagcagtggtataggctttatcttttaatgtgtaatcatccataaaagagcctagcctactccttaaaaacccatcaactttttccttaaacatcacatctaatctatctttaaaattagccatagatgaatctattgtatttgcaatttgttggtcgatagattgtgatacctcgtcattacttaccacgtcgggagcgagcttaggacgtggcccgggcttgatgatcacgccttgacgagtcctagtagtcaacctcatcaacgcctcccgtgtgagctcggtgatgtattcctggacatctttgcgatcctctccttcaaagtcatctaatgtgaccggtatcacatgagatggctccacctccgtcttagatgatggcttcgtcatggcgaagtcgaagttgagttgacgatgaacggatctcttccccattggagtcgccaaaaatcgtgttggcaacttttttgacaagttgacaagcacgatcgtagcaccttaagccttgcggtgattctaaagtcgccaaccacctcgatctagcaaagagctaaacctagatgggttttgataactaaaccggctagcggagccgatttctagataactacccgtctcgtgggcaaacggaaggttttcaagacaaacctacaaagagatgtcgcactctcgcagcggtagcggacggtttacggcgcaaaccgacaaagatggacaaactaagagaaaactaaaagcaatataaaaagaatgattcgattgattgatagtagattgattttaacaatgaaccagccttgtcccttatataggggttggtcttgccctctacaggcccttctccatgtccaactcggggtaaaaaccaaaggaaacccgaaacatgccttccaaagcaaggaaacctcgaaacccgacgcaacagaatcggactcgggcctgtcggtcagaccggccacataccgccggtctgaccggccttcaaccggcggtctgaccgcccaacacacggcggtcagaccggcctacctcgaaggaaaccggtagacttccaaattttggcaatatttcctattttaagcctaggtgccaaatttgggtgtaaacaaatacttccgtacgtcggttggcaaaaccatccgggcataaaactaggtgccactgccaggttcccaaacttgtaccatacaatcaaatcaattcttgacattgttatactcactggctcactggtagagagaatctttaccaccggttaaaaacccctttattttttttatttttggttgttgcagccgaaactaataaatcgtgactaaacatctcgatctaaaatacatactaaatcaaaaaaaatatatgggatatggattttgaactcaatatctctcaccttagccctcatacgtcctatctactacacacatctaatttagatggagatgctttctttctagctaaagaggtatatttagtaactgttggtgttccaacagtactaaaaatatctttagtacagattagtgttaccaaacagtactaaagatgcattttaaagatgcattttagtatagttagtaacacacaccacaaccaaagatgtttgtaggaacttgacttttataaccgatattaaagtatctctaactgatatatttgtgttttgggccctacggtaaaatatatcgtttctttggtagtgacccagctcttggggatgaaatacccaaaaggttcacgaaaagcatccatttaattacctctttgctaatcagaatgcttagcaaatcattttattaaaatgtttgctacaaagcggtgatggtttttttccggggatgtttttttttcctgtcaaccaaaaagtacttatgaaaaaattgaaaatataaattatatgcgtgggtgatatatcactttacaaatgcacgtcttttccttaaaatcacactagattaaatcaaacatattacaagcaaatgaagaagaaaattttaactgtaaatagtacaagtattagcaagagtaatttatttttttcttcgatctatggatcaaatttaacttgcatgtttgtatagtaatatatctatattaatgagaaaattaacaccatttcactcttctaaattatttcattgaagtacttagcccataaactagtttttagctcattctacaccctaaactattgaaaatgttttacatactttacacacagatgctatttcttttttttctttctatataagtcataatttacactcaacttttggtaggacgatagatgcattacaaagtacctctcgacttatttttagaattattctcactatttacataggttggaggcagatgttaaattctggattgaaattttagttctgtgttggcccacctggcagaatattctttccagcattttttttcaggtcagaagaaaacaatgtttaaattcttaaaatttatgtccgagactggagttctgtttccgccattacgcgtaatattaaggccctctttggcacaactctgaatccaaaatttctcggagctggatattcctaggttcacaaattcatggatctagatctatgattacattgataacatttagataaagtttttgtgcatattgcagatgaaacttaaatttttaaagcaactgtaattgaatgtataaacttcaagtctattatgggtctaaaatctggagtagtcccaaacaggacctaaatccctgtgaaattaatatgctgtaatttgaaatgttgtaagctaaaacatgaactcaagaacactcattccatatgattttgagaagagagatttcttcaaggaaattagttaactactaattaactagattcacttggagattgtggaataggagagttttaggaaatacagctgtgtcagaagcaactgggatcccacatattcccgcatatgatagtgatcctcatgtggtgatataatatatagttgtacaaacaattgatatttatagatcagtgcgttacttttagtccctttagtttgtttctattaggtggctagcaaaagcacagtgcatacctattactagcttagaatagcgcaaatgatttaaaatgttgatcatcatgctagcatgcactccagcatattagccttttggtgaatgaaattgtagaagcgcatgcaataacataacgatcggcagtatatttgccggaaatgttaaaaccgaaacctagctattgtgcgttttccacccaaaacgcgcatccatggcacaccatcggctagaaccggtacctttgttgagagatagggtccgctttaaataaaaaccgttacctataatatgttttaggtcctggtttttcaagaaccgataactatatttatattgtaggtttgtttttataaaaaaaatggcacttgttaagaaaaccgacagactgagtagaataagccgaatcacgacttgtttccacctatatctctcccttttgatcgcccctcactcactctttttattacccccctctctcccccttatcctctccgcctcctccctatccctctctctccaccgcaccacccggcggtagcgccctcccctcccctctcattgcttgtgttgttgatgttcttgtgttattagtgttcttgcattttcttggattaaatgtaattaaaagtgtaatcagatctggttggggtgaaggggacttattcgatgcatgcatcgagccggtctcttttttttttcattcctaggaccttaaaccggcacatttgagagaactcaaaaaggttcctgttgccaaattcggcacccatatgtggttggcaaccgacacatatccttttctgtagtagtgcctataaatccttgatggggtaccagcattgttaattaaacacacaattattcaagtggtgtacatcttgtttactgctgtccaagcactggtagcttgaaactgatatccaagcttgataagggtaccattcagacgtatagttcacgagtgacgattaaccaggaaatcaatctaacgccataaaattcagactcgaaggggtaggtaagtctcgtacgcgtgggtttacgtaattagttcatttagctttgagtactctgcatctcttgattgggtaggaaagtcttgattgtttaggttaatctctagagggctgctacaaaacgggatcccattgtaatggaatagacatattaactattctcttgcacgagtatcacaggtatcaggtcctatatatcacaaaggattccttgtggctcccgcagctattgtgactaattttccctaaactcaagaggcatctttaacctgggagaaggccaatataatgttatgtttggcatatcactcataaatattaagattatcatccctgttagtgtcaggggagaattttgagaagtttgtcaagactaatgcttagtacaaatttagtgcctatgcacatttgccgccataatttaaaaggtagcacaaaaaaattgcgtggcgtgcaaacatagtgggatggacatcacacatttcatatgcgccacttgtccatttcatatgattcttctcccattaggctacggtcattttcagagttgtaatactaagacaaagtggaccataattgacttggttcatcattccacaaatcaataagaaatatagaagactaagaggcaaactatgtaagatcctattaatcttgtcatttgatggaaaagatgaagctttactaaggggttgtagcaactccaaatttaataataataaagctcactttcctctcaaggggaaataaaattgcctctatgtcctatgtatgctactcttgaaattttcttctgtaagttctttgcaagcaatagggacatgcttaatgtcctgatttaagaaagtagttaaataagaagattaatggcattattttgggttgaatcattatgagacattgtcgaaattatggcattatttttcggccacatttctaggggagaatatacgtctcattaaggtcgagacacttcacccttagaaatttctgacatctattattacttagataaagctaaagtaaatcaagtgattcaagttcataaggtattatgcttccattacataaataataaaataagtgggagctcatcaagagctctaataagagaagattattctacctcatttatgactcatagctccattatgtggatgttataattttgtgacttgcacaattaaatatacataacatagcttgagggttttgttatggaaagacaagtcacatatggggtgcatacttaagaaatccatttgtggacttaatcaagcattgatgatgttttaaattctgctgcatcattagtgaactaagcttaaataagaatgaggacaataattattctataatgatggaagtaagacgtcattgaaattgtgtcattgtcgcttatgtcacatacctaggggagtttggaacgtctaatgagatagagatattctttcccttagattttaatggcattgtttagctttaagtgaaaatttcactaagttaagaaattagccaacaaatgattatttatggctatgtttacccataagcgacctccgatttcctttaagaaatgtaagacactaatgctaaaatcaaatgaagttatgagatctgattatggtggtaaacactaaataaagcttgttcaccttataagacattaaaaataagcattcatccaaatggttttccaaccatctaagaataaattgagatggatgaacaaaataagacattaaagtgttcatctaaatggtttttgaaccatacaagaataattgagattgatgaacaaaataaagaattttgtagaagtttctgaatgagtcaaaatactgggccatttaagtgggttaataaaattaagcctgactctaatggaaatttcgaacaattcaagtgaggtggacaagtgcatgaaaattaaaggtgggaatttcattcaccggtactctatactaatgacattttattgtcaagcaatgcatattgctgttagaaaccgagaaaatttttccctgagttattttggtctgaaggagtactggcttatatcaataagtcatatattgacataaagaaataatttgagagaatttagttatagttagtcaagctaaaattaaattataaagataatcatttatgattcagcagagagaagcttgagattagctcaaatctggatgcatacagatttggcatatatttttactgggaatcttggcagtatttaattaaatccagactagaccactggtattaagaatgttttgcattatttgcatgacaatcttaagtaacatgctcatatttctaaagtccaatgatctcagaagtttagaggcatttagacactcattttgtgagatgtgtggatatttataaagtttattcagattaagctatgtccacgcataggggagcaataaccatggaaaagctccaaaataatctcttactgcatagtcgatgatgcaattagattttaaagcatgttatgattaatcatatatataagaatatttcccaaaactaagagtggtaaatagcgcttataaaccactcaaaaggtgtaaaccactcaattatactgtgttataagttgtgcactaatcaaacacggttttctattctagtaacaacatgttgtgtgctttctgcctaacactttgatatagttgtgaaagatatgtcctgggatcgaattattattaagctaagcttttgctcatggatccatactttaaaggctcataaagttaagattaattaagatatgttctggccaatacatgtataaataagagcctaactaagatcctagatgagggggacttaattttcaatcaacacccactaagttaagcttgagtttatttggatactatagtgaactgtatgtcttgttgtctcggtgacgcataatgttgttgaaaacacatcgcttggggagctattttatttgataaactcgtcagctagtctcaaaatcaaggggagaatgttggttaattttatcggctaatgccggttagttaggataaggataaaatcccaccgattttcctatcctaacaagaaataaactaagagataaatctgttttgtgtgatcggtacaaaatagattcgaattttagattgagaaaacccccgagccccaccagtgttgcttatataaaaaaagaaaaagagggaggctgagtgaatacttaactct

SEQ ID NO: 10573 - DNA, 8034 bp, Oryza sativa
  unsure (1)..(8034): unsure at all n locations
gtctctagctgctccccgacggcgaggcaaggctcgtccggtcgtgcttccaccgccaacggctttgccgcgctgtgcagcacctcggccgcctcctcgccttcgacatccatcgccggagtccgcttttgccgccgcctcgtgcctctccttcctcgtctaatccctccattctctttattagatcgagggcaagcccgtccgcctcttccagggcgccgcccatcaccggagcgctgctgccttccttcgccctgagctctgccagccacctccctccatctccgtgcccctcggtgagcacccatctcctttttctcggttccttccgccgctccccgtgccgccactcacagccggtgttgccgccggtggtcgtcaggctggcgccgccaccgcccagtcgggttggctagcgagccaacccacccttccgccgtgcaccgccactgtggactcggtccacggtcgactagcacctttggctccgctgactagtggggcctgccctttgtggatgtggtccacacctctccccttgctgacatcagcaatcggcttttccctttgtaaaataattattaattgcgtcataaatcgataataattccagaaatccatttaaatggctcaaaatttctaaaattcatatatagttcatatgaataacgaattgagccattcaacttgcaaaattcatctaaaattgatccctgttgacggtcgttatagaccaatttcgaccgctaatataactaaaataatagagaattggttatgctcataatgcatattttgttttgaaataatttagttccacttgtacttggagaataatttgttgcatgtactgagcaaataaaatgagaagaaatgaggaaaactcactcctaagcaagcatatggataagatgggcccacatgataggtgtaaccgtcctgaaaactgcatcaactaccataaccatcatgaggacccacctgtcagccactctactgtacttgggggcctgctgggccgacccaggttcggccgaacccctggcagctgtggctccggctggccctacacatggtcatccaggatcacttgccaatgacggttcaggggcagaaaggacattttgccttctccataaccgtcataccgaccctataaaaggaggagctcacttcacttctcaacacagtcaagcaagctcaagatttctctctacactttatttagtagtttttgtgctaactaaagtagaatagaatagttttcggagtcctcggagtcttcgaaagagttcgggtatggctctagtatcttttctatcggcttttgtaagacttccagcattaatgaaatattcttctttatatactttcggtactttgtttagtctgagtatcggctttactttacatttgtgtcgtattaattgtatggttagcttcccagagtggtatttattaatgtaaacgaggtacttagattaataagtatcattatctgggcatatatgctacggatctgtagaggtgggccgctgatgatgatagctcagtacaggtcttcctccacgatagtatatattcctaagacaaattcctccgtatttagccccggttggacggccatgacaggttgtcgtaaggaattcggcaacccagggtggtctctcgaaacaccaggagggcactattaggggatattggccacatgattgtatactagcaattgtagactaaagattgagtgtatattagaagtataggaattgagttcttttctatttctccttctacttagtttaggatcattattagagggaatctaaaagcgactacttagtttaggatcattattagagggaatctaaaagcttcgcttcgtgtcactctacccatatgctgaattaacccctactaggctttgatgaaggcaagtaatatatatgtatataatcattagcatggttctctctttcaatatcttcccttagaattaaataaatacgataccctggaatactcccgggtgaaatgctataatggtatatccgtatgcttgtggattttttctgtaaccaaccaggactaaagatctatttttgtcccggttgtttaacaaccaggaagaaaaacgtccacccacacgcgcgcaccaagtctccggcgcttctctctgcatcctgtgcatgcacagcccctctctctctccatctcccatccttatcaatttttcttctcctcccttatctccatcctgtgcatgcatcctctccatccttctccttccatactccccttgctcttctctcaccctctctccagctcccctcccctcccctccctctctccctcctcccctccactccctctccccctccacccctcccctcccctccggcaggccgcgacagaagcagaggcggccggcggcgggatggaggctgagtgtgggccggtggcagccgggcgcgagccaacggtagggaggccggccggcgggatgcaagaagagcgcgggccggcaacggccgggcgagggccagtgggatggaggccggccggcggtggcccggcgcgggccggaggcctcgccctcccctccccagatccggacggagaagaagctgcgggatgggggtgatttgatttttttgagtttttttatctttttttttatgatttgtggatgttgtgatttgtgaatgttttgaatgaatatgtgaatcgatattgtgaatgaatctgcgatgttgtgaatgagtctgtgaatcgttgttgtgaatgaatctgtgaatcaatattgtgaacgtatttgtgatgttgtgaatgaatctatgaatggatattgtgaatgaatttgtgatgtatttgtgatgaatctgtgaatcgtctgtgaatgaaaagatatgaaaggaggaaaaataaaagaaaaagccgaaggagaaaaaaaaattagtcctcccggttggtaacactaaccgggactaaagatgcaaccgtcttttgtcccggttggtgttaccaaccgggactaaggatccatctttagtaccgcttatttcaagcgggactaaagatgggcatctttagtcccggattcctcctcccggttggaaacttaggagtaaaggggttaccaactgggagtacaaatggtttctccaccagtgtgtaagtattttacgatttatttacatttggatctgtatattaatttatcattttgtaccctagctgattcctagacagggatttaatacacaaaatagtctgaaaatttaggctaaatttctggacgtaacatgaaaatagccaaattggcctcactagtcagacctcttagaaacctgtagcctgaccgaagttcattgtccacttttaccatctaaacacgtgcggtgagaccgtcttttgcctgaatgttctgaaccacttctatatttaatctaaatttgacctattgtcaaatttggatgtcagcccatacaaattgcattccttagatttgaactttgaaataaccaatggttgatagttgacagtgtctcgagatcgatttttactgtagtgcacgaatcttggtgtattcctagccatttaaaagtcaatatgtgtacattttcatgtagctgaaaactagacaatcccacagctggaaaatattttgtcagccagacgatgctcggcaggtgatgttggaagcgcgatgccgccaaaacaaggtgaggaagaagacgagagtacctacagaacagagctcaaattgaatgataaggaactcgataacacatcgggtgtaaattaaacagcatttgccatccagctgaaaccactacaagaaaacataatgttttcggcggccatacgatttcttcggtcaaaaatgggctgccaatattagtctttaaccctcgtttcctgattaagtgattatacccctatatatactcccttcggactgataatattagtcgttttgaataagggtaaagtcaaactttaaaatctttaactataaataatttttaaaatatttatcttgcaaatatgaaaactatatgtatagattagtcttaaaaagtacttcaataaaatcacatatttattgatatttcaatataaattataatagaaaatagttgtaaaagttatttttggagaccgtgctcttgtccaaaacgaaaagtattatcaacgaaaagtattatcaacccggagggagtacatctaaaactaaataataagatctggcctagacaagcatatatatttccatccatacacataaaatatcatactaatattcatttgtagtaaattcatgcgaatcaaattagcgaagtcgacggaggacgacgacgaccctaacgtatgtaatattatagtgaactttagtttcttgcattatatattatcaacaacaacaaaattagcatcacgaaaatactttcctatatgaatcaaatgatttgacaggcataatattaaataatacaatttacaagtatccacttttttaaaaataaaatgttctgttttattttggggcggagcgggggtatattgacggagatagtaacgcatgaaattgagaaaacgacggcagataaaccaagtctttggcggctgacggagatagtacctcgtgacttgctcaatgtgcctgcatgtgacggcagcgggtaaatgttgttaactaataacatgcgccaaaagctagtttcgttcaactatatatggcaacttttctgttaaatttccaaggatcccagatcgaagtcggcccaatcagctggcaacttcaagaatacatgaaaaagaaatgttgatttggcagagtgccaccaaatgtagtttcgttcaactatatatggctacttttcgctgaaaaattaaatgtccatactaattaaagctgctaatattgaatttcttcttcctcagatatatatatttcacatctatagcttgcgattatcgaagtctaagtaatgtaattgttcacgtttaaaactttgctaattacttgttttaattaactaacctttgcatccattcgaaatttcattaatcttacagaaacttttgtcccgggctcccggcacggtaattccttgtgcatacattgataacgctgcaaatacaaagtgagttacactggaaaacaaaatatcgagatggagtcctaaacaatttgctgcagttaaaaatacactagtacgaaatacgaaatatgatacgccagcatgttagtaggaaaagaactcttcaggctttttctttttgccatccctgtgatcaatgcgaaatacgccagcatgttcattgaggatccagaggatggttgtgagctcgccgccacaggcgagctgcttggcatgggaatcccttgtgcatcggaccgacgcaaacatcagaagacgcacccatgccatgaagatatgttccagcatttccgacatagagaagtcctccttgtcccattttttcagttcaggaatcaactgcttaagtcttttatacctatcgaagccaggggattcggagctgaaggttttgggcgtcgtaatgttggacttttctcctgggattttcattacccgacttagcagcgccaaggcgaagctagttccgtcagagagaattatattctggtcgaaaagagcacttgcgagttctggcctcgacttgtgggtactatatcctggcctccagttgctgatattcatcggcctcatgggtttgggctgtttctccttgtctattaggagttgggcgagattcttctttccttccacgctgttattaacagaagattgtaattggttgcccttaatttcgttcagtgctttgagggcaccttcgtacaggctgcgtagcttaaggcctggtagcatgcttgggcgcaccacgacgaggaacaccatgtaattcgacagtgccttgatcgcccgtacatgccgcaacgatgatgcatattcaccactgatcaagaggaagatgtctgtggtgatgtgcaagataaggatggtctcttggaatgcaggtgcaaagtccagagcctcttctagttcccgatgcattgctgcttgcggttccgccaacaccgccgctacttgttctggtaattccaatgcgggcaccatgggcggctgcttgtcaggaataataggcgggtacgctgacttgagacattcccatatactttcgaacataaggttcctaacatctgatgactgatagcataacatatgaaagcccaacgagttgtggtatctgtactccatccaacggtcatccagtgaaactaattccaacactgatttccacatcttcaacttccatgttatgtcacgagtgcactcgtcaaacaagttgtattgcccaatgattcctagccacctcctatagctagttgttggatgatccttggaaaagaacctcgacggatccagggagacgatggaacggcgaatcatgcgccatttccctgagcacagaagggaatggtgaagccaggagcgtggcctatcatgcaagaaggaataggtccatgtcgaggccactgctctgaggagccatttgatatccaggatgacgatgccacccagtacgatataggtgatcaaaacgtcaggctgctgcagaccttccttgctctgagaccaaaacagcaagaacattgcagatgtgatgaaatgggaggagaaacggatggcatagccaccccatgtgtggaccatggctgccttggtgtacaagatgtcatacatgagggagagctccatgtccaccacatcgtacaacatctcattctcattccaggtttcagggcggacaatctcttgtttgtcgacatcatgctcgtaagccatattgtcgatgaaggcgcccttggtgatatggagcatgtcatgagccgccagcaggatttgctcgttattgtccatcttcctgcggcctatacgccttaagtttcggatgctattgcttagttttattggcttcttctgctcggcctccttttggcttgaacttcgcatcttctctagcttggcgcgccgcagagcgaatgctctctccccatacttgacaatgcccatgatgaacatgactgatgaggacacccggacaatcgtgccgccgctactgaagaatacattcttgtacagtatatagattgttcccaacacctgcatgaaaaaccctatcatgtcgcgccatgataggatgttgtcttccaaggagtaggaggtgatgttgtccggaccaccagcatggaacatcagcaatgcggcccagatcgtcaccagctgcaccgactgggacgacggtgtgctgccgccgatggaggacagcttgccaagcgcgaacgtcggggcccaattagccaactggtacgccagccacaggaccaacgtctccatgcctgtggctttacggcggcgaacatcggcgaggaagacgaggaggagttgtgccacgaagctggagagtattgccaaccggatcatccacgcattccagaagagctgcaagccaatcatccatccaggcatcgccgaccctgctatagtgaatgggtacatgttagtccacaaggacaaaagattaacgcaaattacatgttaagagatcaaggacaacaactgatccaggatatataaaactgaatgaatatccgttacacctcccagtataatcactgatcaactacgcacctgattgatatcccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10574 - DNA, 622 bp, Oryza sativa
cggctcggcccaactctccctccctctctctcctctcccccgcggcccatcggcctttccccgcgcgcgcgccgctgacaggtgggcccgcccgccaccctcgctgacgggtggggcccacctgtcatagtctacctcgcgccgctcccgccgcccgcccgtgccctagcgccgccgccgccgccgaatccgccgcatcccgccatccccgcgcgcattaaagtggagggaaatattccccgcgaatccctctccctttccccccgctttcccctctctctctccctcggattcgctcggatttactcccgcaatcctcgccggcgcaatcaatggcggccaagatttccgcggccgattccttcctctccggccaccctctctccctccgacgctatataatcgttccccgtgcttcgctcctccgtttccgccactcgccgctcactctccccgtcggattcgagctcgcgccgttgtcctctctctccgccgtcgccgccgagctccggttcgccgccgtcgtcgctccggacctcctcccgactcggcgtcacctccttcggcttcgccgcgttctcgtcgacctcggccacccctccgcttcgctcgccgaccgccg

SEQ ID NO: 10575 - DNA, 748 bp, Oryza sativa
aggtggaacagtgccgcaaacgccactgtttggccggcgaggacgcgtctccggtgcttcccgcgaaacgagggctgactgaggaataggaggtgctgcaagcccaaggagaagacggcgcgcccgaacggcgctccgccgagtaggaaaagccggctgagccggccggcgcggagaaaaaataaggccgatgccggaaacgcgcctccgccggtcaccgcgcaaaacgaaggcaagcccggggtgaagaagttgacgacgacgctgaagaagccgacggcgcgaccgcccggcgcacgttcaagcggcacaagtcgtctgaagcggcccgccggcgtggaatatagagaaggccgcggggaaaaggcctagggaccacgggaaggctcgggatggggttaaaacgatagaccggagtgaggggatcccattttatagggtggggccggaacccgggctcggaaaagggcggaccggccacgggaataacggccgacggccatgaaagcggccggacttggcgcgtccgttcccggggattgaaggcccaaatcaagggggaatttggggccaattgaagaggatccaatggggattaaaaccccccaattaattttggaattggccaattgaatcaagcgcatttggagaagggaccaagctagggttcgcacgggagagaaagaagccgggcgggagaaaaacaacgcgcctggcgcgtgggccccacgcggtcgggcgcgcggtc

SEQ ID NO: 10576 - DNA, 849 bp, Oryza sativa
aggatatgtacaagacggcttttaggtgcccgggatttgttggtttgtttgagtgggttgtcatgacttttaggttgaagaatgccggtgcaatatatcaaagggcaatgaatttgatcttccatgatttgctaggtattatcttagagatctatattgatgatattattgtcaaatcggatggtatggaaggccatatagccgatttgagattagcttttgagaggatgcgccggtatggtttgaagatgaacccacttaaatgtgcttttggtgtgtcggcggggaggttcttaggattcatggtgcatgagagaggagttgagattgatcctaagaagatagaaaaaattcatgatttcaaagcgccgacatgcaagaaagaggtccaaaagttgctaggtaaggtgaattatttgaggaggtttatttctaacctagcgggtaaaatcgatgcttttttttctatacttcgtttgaaaaaagaagccgatttcacttggggggcaaaacaacaagaggcgtttgaagagttgaagaagtatttatctactccacttgttgtgcgagcgcctaaagccggaaagccttttcggttatatattgcctccgaggacaaagtcattggtcccgttttgacgcaagaggaagatggcaaggaatatatcattacatatttgagcccccgtcttttggatgccgaaacaaggtatgtttttatagagagactttgtctatgcttatactatgcttgtaccaagttgaggcattatttgttgtctaggacatgcatagttacttgtcaagccgatgttattaaacacatgttgcaaggccaattctaaatgg

SEQ ID NO: 10577 - DNA, 1123 bp, Oryza sativa
aaataattttataaactgggattcaatatgctcaaggatgatgtgacttgccttgctcagagggaacggccttccgaaccttcggcgacgaccacgaaccacgcttcgggaacctccgggacgacgaaagttacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgcaactataaaatatgtgtaagcgctagcctggaaaagacaggaaggctgcgccgttgacatgcagaccccacatgtcaacctaaaggaccgcggtagaccgggtacacagagacggtccacgggtcgatggaagtggaccccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgtggggacgacaacgacgaacgggcgcggcggagacagctcggggacgacggaggcgaaccgcgagggaacgacttcggcggcgatccttggacgaaggcgagacgcggctggcacaaggcttgacgacgcggagctgaggacgaagacgaggacggggctgccgcggcttgcttgactgatgcggacgacggatgagaacggctcgacggagggacgaacgccacgacgaccgggaatgatgagaggacgacgacgacgacgaccggggccggcgaggaggcgacgagggcagccggcagcggctgcacgaatgcgaggatggcgtggaacacgccgcagcgatgacgatgacggaggcggcgccgcgagacgacgagccggcgagaatgaacg

SEQ ID NO: 10578 - DNA, 681 bp, Oryza sativa
  unsure (1)..(681): unsure at all n locations
tagttcatcagctcgaagacgatgaaaccctcacatcgccctttgtagccctctcatcaaaccggcgctggagcccagtcagaccggtcgtagaccaccggtcagaccggtcgtagaccaccggtcagaccggccagacgcgccggtcagaccggcctgaagcctcggtcggaccgctgtctagtcggcggtcagaccggcctgattgcccggtcagaccggctacatggccgtggtcagaccggccgactgcgatgagctggtaccggcttcagattttttgtttggagactcttcaactccatctccagaaaggtaggcacatcatgggatcctattttgatagtaatcacctncgaagtcctttcctccaccttggtgcgctttccttcccttttttttcattaacccgatttttaccataaaattggctttttgtttggtgaaagataagcgctcatggattggccttcggggtccgccccacccttgggtgaattgcattggaggcatatggttgtacattggcggcgttgccccccatgacatgaagtgaggataagaataaccccgcggccggcttgggataaaaccccatgacatgttctggggatgaaaagtttgaggtgaacgcaaccggcttagtggatgaccaaaatcgcccctaagaaggagatctgg

SEQ ID NO: 10579 - DNA, 655 bp, Oryza sativa
tcatacgtgagcatcagctttatgccaagttcagtaaatgtgaattttggttgtccgaagcgaagattcttggtcatgtcatcttgtctggaggaatggcagcagatccaagcaatgtggagtcagtcttaagttggaagcaacccatgacggtttcagaaattcgccgtttccttggacttgctgggtatttgtgacgaccagaaataacccaacgggcgttcctgacgtgcgtgcattaatacttgtgccaggaggcaacgtacaccaacagttgatacaattcacagtttaacaagcggtagcgtgaataggtcacttattacatgggcaccgaaggcccatcacacacaaagacataccgcgaacagttgacgactagggctacaaccacaggcgcttgacggcaagctcgagctaaacaccaaagactgtatctttaaagtgcttctcttcttggcttgagaaaaagttggcaagactgagttcaaccaccgttctaacaagacacagccacatatgcaggatacatgcaagggagtacatgggaattataccatacaggggacatggttgcagtctacaggatttaaagacattttgttgctcagaatatcttgttaacacgatcctaataactatacaaatgttatta

SEQ ID NO: 10580 - DNA, 1130 bp, Oryza sativa
ctagggcacgggcgctgcggcgggcgcggctagagaagggagatgacaggtgggtcccacccgtcagcgagagtgcgggcgggcccgcctgtcagcggcgcgcgcgcgcgcgggaaaccgatggtccgcgggagaagagagagagagagggagggaatgggccgagccggcccaagagggaaagggggggggggaaaagaacttcttttaggatttttctttttataaaaccttttcaactttgtttatttcttttcaattattatttgtgctctgaaaattccactaaaatttatttaagcattttaggcttttaggaaatatacaaaaatcctccaagcctcatttgacttttatctttgcacattttaattgttggaggctttcacaataaatttttaattattcttttgcacaattttgaggatgaattttagagtcgatttgggacgcgacaatgaggccgtagctggcgtgaggcataggccaccacataaccttcctgcatgagcacgcaccccaatccttggcgcgaagcgtcacagtacaccatgaagtccttgcgagtatccggcaagattaacactggcgaggaaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcggggtccacagcaactcctttagcagatatcacgtgccctaagaatttgacttcggacaaccatgtcacgtcctgataaattcatcccgaaattaaaaatcattttctaaaaggaataatagaattaattaaaattcaaaaagaaattggcaaacactaaaatacgtacaagaaaaatccaaatgtggcccggggaatttttgttaaattctccttggtctaaaaggagccctcaaattttagtggaattttcagagcacaaattataattattaagaaataaacaaagttaaaatgggtttataaaaagaaaaatcctaaaaag

SEQ ID NO: 10581 - DNA, 9267 bp, Oryza sativa
acacatcatctggatcatattgaatcccagtttataaaattatgtggattaaaataatggcattatcgcttaatttaaattcccgcgttatcactgttttatttagccatgcctatttacctttgttatgaccatattattattgttattgttattattattaccttgttcaccctagacaaacaaaacctcaactagtgggcactctactcatagtaccactaggataattttaggtagatgcttcgcaatttaattaggtaacattaggtggttttacaactatagactttgggaaatattcatatcacctggatactttggaatggttggctattgtggaattggtttcacaccgctccttcctttcaaaacccctaaaatggttttgggctgggctaggggtgcatggttttgatggtagcacctcggccgtataaggaccggtcttcgggcctctgttgcaaagcactaccgtactttcacatgtctagtgggtaaggcttagtttgtggctcagtctagtcataaacaaaagtacacggattggagatggatgaagtcgggggtcgatggacattctccagggcaaatgaaggctacacgagctgcgggcccgtagtcaagatgtcattgcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaatccttaaaacctgcttatcaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaggatcgcgtttgcaaaatagctttgtgcaactaaattttctttaaatgctgattactgcaaccctaaccctttatagtataattcccttgtactcccttgcatttattctgcatttgtgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaactcccgttgggttatttccggtcgtggcaaggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctatcacggcctctttccgatatgtcgtggtggcatgtcggcgcacggaaacgtgttgtgcggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacgtgggttagcgttggacagtggatgtttaatattaattaattgttacaacggtttaatctttcaatctctgtttataaatgctcgctttatgcaaatgaaccactttagctcttctttgataactccctgcatcatacccctattccggtatgacttgctgagtacagtgggtagtactcagccttgctctatttccccccgatcccagagctcgagtatgtgtccgatggcgggttctccgaggagtaggcttcgtccgtgccgtcgaggatgcctgtggagtggtgttcccgctgcagttcaagtcaaggcttagctccagttttcttttgttttccgctgcatttctgtaagacttttatgatgtttgtaagacgtggatctgaatgtcaacatagtcgtttgtgtaccccggccggtcctggacgggggttttaatgcacattctgcttggaatcctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaggggaaaaatcttggtcgctcgtttaaagtgagatttttcaaaacgagtcagtctagggttttagtaaagctattgggattcattcgttagtcagttgggatttgatgggtgaaatgcattaggtcctagctcaggaatttgggttgcaaggtatttatgctttatttgttattattagtatgtatctaatttctcattattttatcgttatgtgagtctgtcttatttattcgctctcatgcaaaatgatctatgcataaaatttcgctcttattcgattcccttatttgagtcttttattgctttatttacatttggatttgagcatgcattgatcctactcctttgtattctctagatggccggtcacccacccaaccaccgtggagaaggcatgattgacttcgtggcagagttggcacgcatgacactggtggtgggctaccccaatgcgccagaatacacgacgattcccccgctcagtggcgaacttcctcaccgtgtccgcttggaggtccacggctacgtggggacttgcctcgctaatatggcggttgaggcgtcaggaggcacagcggatcacgcttgtcaggaggcagcctacttgatgatggccagactgcgggagcgccacaactacatcttccacgacacggcgtaccgcttccaccctcgtcgagcccacggtgacgacgtcagttccttccgtccgacagctggcgagaacgacaccacctttggtcacatgtgtactgtgatgaggggattggacaggatgcactcggacctgcacaaggcgaccaaggccttgaatgatgggaagctcatgaggatcgtcgctctgaaggatgagatagcgcgcctgaagaaggagaatgctcagttgaagggtcttccagcaccaggaggagtccggatccgcactacgcctcgtaagaggacgactgcacccgtgcgcatccagctcgcgcccaggaacccagttccgaccgcagctcctgcagcacctccagttccgcccgcagctccggcagttcctgcagctccagctccagctcccgcgttcgatctctccttcgccctagcatcagccgccaggggtccagccagtggtaccggaggttggttgtctgctactcccagtggcagccgcgaccgcagcagcagcagctccaggggctgagagtcgggcagcggcgagacttatctgccaggctccaggagtcgttcagagggacctggtgatgagcaggaggacgccttcgactccaccgaccgcaggagccgttccgagcattaggctcgttttccattagtttaccgactgtctagcttctgcttgttagtttgtgtgtttaggttgcttgtttggggtcagtcgacggtcgatatcatgtgcctatgatatggctgtcttaataaggatttttgtttgctcttttaagtgttttaattcagatcagaacaattgcagttttaattcctttgtaataaagcttagttcctgagcatctgtttttcttcttttccccgtctgcttttccctccagatggtctacaccaggactggcaaccgcacgacaggcgagggcagcaacggcgaagaacgcgttgatggtgtgcaccccaacagcgattccggcaatggtccgccaccacttcccgagaatccgacccttgcccaagttatggcacatcagactcagatgatggcagccatgatgcagcagatgcagcagcagcaccagcagatgcaccaaaggatgatgcagcacgccgaacagcagcaccagcagtttggtccccctccccctcagtccaagttgccagagtttctacgcgtcaggccacccaccttctccagcaccaccaaccctatggaggcgaacgactggctccatgcaatagagaagaagctgaatctcctgtagtgcaatgatcaggagaaggtcgcttttgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccaccagggcaacaggactgtgacagagtacctccacgagttcaatcgcctcgcgcgatatgcaccagaggatgtccgcaccgatgccgagaagcaggagaagttcatggcgggtctggatgatgagctgaccaaccaactgatatccggggattacgctgactttgagaggctggttgacaaggcaattcgtcaggaggaccaacgcaacaagatggacaggaagaggaaggccgcacagttcagggcacctcagggaagtcaccagaggccgcgcttcactcccggacagcagggtggacctaccaccatgatcgtccgtcagcaccgcccgttcaactccagcaactttcaccagggctctagtggcagtcagaaccaccatggaggtcagcccaaccgcggtgcagctccacgcccaccaatggcaccggcacagtcaggcccgcccgcgcaagccaagaaggagactggagcaaaaccagggtcctgcttcaactgtggcgagcttggccacttcgccgacaaatgcccgaagcccaggcgtgccgggccaaggtttatccaggctcgtgtcaaccacgcatctgcagaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagagttcataccccgagaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcattgattgtgcgaatcgcacagtcaccttgaccaacgagaagggagaaaccgtggtgtacaaatcaccagactcaccaaagcaaggagtctccttgaatcagattgaagcggaaatcccagtggacaccgtggagaagaacttgagaaaattggaagatatacccatagtctgcgagtatccggaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacattcgaccaagcacttcaccttggggcgctccggtcatttttgtggagaaaaaggataagacgaagaggatgtgcgtcgattatcgcgcacttaacgaggtcacaatcaagaataaatatcctttaccgcggatcgatgatttgtttgatcaactgaaaggagctagagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttattgtggtgttcatcgacgacattcttatctattcaaagtctgaagaagaacatgaacaacatctccgtctagtactcgagaagttgaaggagcaccagctatacgccaagttcagcaagtgtgacttctggttgacggaagtcaaatttctgggccatgtcattacagctcagggtgtggcagttgatccatcgaacgtggagtcagttaccaaatggaccccaccgaagaccgtgtcgcagattcggagttttcttggacttgcgggttattaccgtcgattcatcgaaaatttctccagaatcgcccgacccatgactcagttgcttaagaaagatgagaagtttaaatggacagccgagtgcgataagagcttcgaggagctcaagaagaaattagtatccgcaccagttttgattctgcccgacccgacgaaagacttccaagtctattgtgatgcatcccgtcacggacttggatgcgtcctaatgcaagagggcagagtggttgcgtatgcctcgcggcagttgcgtccacacgaagggaattatccaactcatgacttggaattggcagcagtggttcatgctttgaagatctggaggcactatctgattggcaaccgctgcgaagtatatacggaccataagagtctgaaatacattttcacccaaccggatctaaatcttcgacaacgaagatggttgtaactaatcaaagactatgacatgagcattcactaccacccgggaaaggccaatgtagtggcagacgcattaagccggaaaagttactgcactgccctatgcaccgagggcatgtgtgaggaattgcggcaggagtttgagcatctcaacgtgggtattgttgaacacgggttcgtagccgctctggaagcacggcctacgctcgtggatcaagtcagagcagctcaagtaaatgattctgaaatagtagagctgaaaaagaatatgagagtcggaaaagcccgggatttccacgaggatgaacacggcacaatcaggatgggagaaagattgtgtgtacccgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccagcgagtgaaggcagagcaccaaagaccagcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccaaccgaggtagtcagttcacctcaaagttttggcagatactgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctgggatcagacaggcgaacgtcaactgttcggaatagaagtattagcggaagcagaacagaaagtcagaatcatcagggaaagattgaggattgctcagtctcgacagaagagctacgcggataaccgtcgaagggagctcacttttgaggcaggagattacgtgtatcttcgtgtcactccgctccgaggagtacaccgttttcagacgaaaggcaagctggcaccacgcttcgtgggaccatacaaaattttggaacgaaggggagaagttgcttatcagctagaacttccatccaacatgatcggcatccatgacgtgttccatgtgtcccaattaaagaaatgcttaagggtacctgaagaacaggctgattcggaacacattgatatccaagaggacctaacatatgtggagaagccggttcgtatacttgataccagtgaaaggagaaccagaaacaaggtcaccaggttttgctgagtgcagtggagtcaccattcagaagaggaagcaacctgggaaagggaagatgatttgaaagccgcccatccgcacctcttcaccagctcctccgaatctcagggccgagcttccgtttaaggggggtaggtttgtcacaccccgaagttttccccccaagccaaaattgtaatttataaatgaccccaagaaaatgcaggtgaaatcaggagaaaaccctaagaaagtaatgcaaataataatcggatttgacatgtggaatttttcttgagttctatatgtcgaaattcattaacaggatttttagtagaattttcagagctctagaaataattttaaccaattaaaattgagcaagcaatatttttaattccagggaaaatcctttttctttttctttttctttttcctctctttttcctttttttttcgaatgggccgccggcccattccctcctttctttctccccctccctgctgggccggccgcaggccgaggcccagccaggccgccccgctgcgtcctctctcggggtcgccgacaggtggggcccaccagtcgggcccgtctccctcctccagccctggttaatattgcgcaataaatgatttaaggttttttcttttatagtaataaacacagtgaatcttctaaaaatcataactaattcatccgagctccgtttaatcccattcatgtctcagtaaatcaagaaaaatgtgtagaatccattaaaaatggttttgtt

SEQ ID NO: 10582 - DNA, 707 bp, Oryza sativa
cgatcggctttcatgccgatccgagcccggggggctgccgccgccgccgtccgtccgatcggcccgagggcgatccgggccgtcggtcccgtggatcggcggtggatcacccgcgtggtcccggtccacggtggaccgccctccccgtgccgctgaccggtgagcccgcgggccgacgcctcctctttcctccccgtgccgctgaccggtgggccccgcatgtcggcgccgcgccacccgtgctgacgtcagccctggttaatattgcgcaataaatgatttaaggttttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgccttgtatgtcgctagattccggttcctccgacgctccggtgtacttcgagatagtcgccgaggttcctccagcagcagagcaaggcaagtcatgcttgtcacttgatcatattgatcctatattgcaaatgctctattgttttctttcaaataccgcatttgttttgcaatattactatagagatggttacctattgttacggccatactattttgataccatgctcctttgttagcttgggttataa

SEQ ID NO: 10583 - DNA, 315 bp, Oryza sativa
acgggtgttccggcggcgaacctcgacggggaaggggcggccgaggtagatcttgaccccgcgaacccgacggcgacgacggcgcggcgcggcggcgaccctagcggcggctagcggcggccgaagtagcaaaaacggcggcggcgggtggttgcacggcgcgggagcgatggggagctcgggagagtgcggcgaaatggggaaaaagcgagagaggacgacggcgatgcttaaaaagggggagagagagccggacgtggccgggagaggcgggaattgccggccgacgtgggggagtgtggaagagagagaggc

SEQ ID NO: 10584 - DNA, 1635 bp, Oryza sativa
aacctccggaacaggcaggcaggattaagcccctagcagcagggcaccaaccttctgcaatgacatctcgactaccgggccgcagctcgtgtagccttcatttgccctggagaatgtccatcgacccccgacttcatccatctccaatccgtgtacttttgtttataactagactgagccacaaactaagccttacccactagacatgtgaaagtacggtagtgctttgcaacagaggcccgagcttaatccttatagtggccggggtgctacttcccacaactggcatgcacccaaaccccaccgaaaacaggtttttaggggttttgaaagaggaagagaggtgtatgtcaaattccaccataaaccaacaattccatagtgtccagatgatatgagtattcccaaagtctagagttataaaaccacctaatattgcctaattaatcagcgaagcatctacctaaattcatactagtggaaccatgaatagaatacccactagttggggttttgtttatcctagggtgaacaaggtaataatatcaatagcaataataataaggtcataacaaaggtaaataggcatggctaaataaaacagtgacaacgcgggaattttaaataaagcgataatgcattaatttaaactaaaataattttataaactgggattcaatatgctcaaggatgatgtgacttgccttgctcagagagaacggccttccgaaccttcggcgacgaccacgaaccacgctttgggaacctccggaacgacgaaagctacgcgaagcacacaagcaaagctacaagcctataaagaagcaataacaatacataaaaaacaaagcacagggttctttaggttataacaaacattaagagacttgaacggatcgattcggagttcgtatgaccaagatatgatcatccgaagtttaatgctgtatatatggcgatttgcggattattataattaagctttgcaactataaaaaatgtggaagcgctagcctggaaaagacaggaaggctgcgctgctgacatgcggaccccacatgtcaacctaaaggaccgcggtagaccgggtacacagagacggtccacgggtcgacggaagcggatcccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacacggccggcacgaggcttgacgacgcggagccgaggacgaagacgatgacggggctgctgcacacttgacgaaacgcgggcggcggacgagaacggctcgacggagggacgaacgccacgacgaccgggaacgacgagaggacgacga

SEQ ID NO: 10585 - DNA, 9765 bp, Oryza sativa
accccgagattcggaagaactggcgaagtgatcgggatgggctgccttcagctcgtcttcacgctcccaggtagcttcttcctcggcgtggttgctccattggaccttgcaaaaacggattacccggttcctagtcttgcgctccatggtgtccaggattttcactggcctctccacgtaggtcaagtcttcgcgaacttcaatttgctctgagtcggcctgctcggatagcactcgaagacatttcttgagttgcgacacatggaacacatcatgcacgttgcccaaggaggcgggcagctccaactggtaagcgacttctccgcgccgagcaatgatacggaaaggaccgacataccgaggtgcgagcttcccttttgtctgaaacctgtgtacacctcgcaatggcgtgacccgaagatacacaaagtcatccactgcgaattccagatcacggcgtcggttatcggcataacttttctgccgggactgtgccacctttaaattatcccgaatgattctgaccttagcttcagcttctctcaggatatccgtcccgaacacttggctttctccaacttggtcccacaatagcggtgtccggcatttgcgcccgtacaacgcttcataaggtgccatttgtatgctggcttgatagctgttattgtaggagaactcggcataggggagactcttatcccaagtcttcccgaagtctaggacacatgcgcggagcatatcttctagaatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttattccctccataggtggtcttcacaggaatgaatcgagctaccttggttaatcgatccactattacccatatagaatcatacccaccttgggtttttggaagtccggtgatgaaatccatcccaatttcatcccatttccactccggcacttggagaggttggagaagtccggccggtcgctggtgttctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaacctgcggctttaccttgtttcatattcttgaggagtccatgcatgtccggatcattcttctgagcctcgcagatttgatcgagcaaggtgggcttggcttccaacgcagccaagaatccgcgaccaactatgcttaggttcagggcttccatctgttgattaagctcgggtggaatgcctcggacgttgagagtgttgcaatggctctttcgacttagagcgtcggcaaccacgttggccttaccaggatgatagtgtattcccacatcatagtccttgatgagttctaaccatctcctttgccgaagattcagatccgactgggtgaagatgtatttcaaactcttatgatcagtatatatttcacagcggttcccaatgagatagtgccgccagatttttagagcatgaaccaccgctgctaactccaagtcatgtgtagggtagttgccttcatgaggtcgtagctggcgtgaagcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcacattgtgggctccacacaaatttctcttctttcttcaccaactgtgtcatgggtcgagcgatcttggagaagttctcgataaacctccggtagtatcctgccaaacccaagaaactgcgaatctgagtgactgtcttgggttgcttccattcggtgacggcagtcactgtttcgggatccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacaaacttatccaagtattccatgaacactttgttcatcaagttcatgaagaaggcaggagcattggtcaagccgaacgacatcaccgtgaattcatacaacccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgttttgtctttcttctccacaaaaatcacaggagcaccccatggggaagtactcggacgtatgtaccccttttctttcaactcttccaactgtttctttacttcggccagttcatttgctgccatacggtagggtcgcttgtgcagaggagtggttcctggaacaagatctatccggaactcaatctctcgcttgggcggcataccaggtagttcttccggaaacacgtctccgaactctctgacgatggggatttctgacagacctatctgatgcagttctgaacttctgacagaggttggaggtgcaaagaaaacaaccggctgttccggtcctcggtacagagtgacagtgcgtctcgcgcaatccactactccttggaattgagccaaccaattcatcccaaggatcacatccaagttcttggtatctagcagaatcagatccgagggaaaaggaattccctgaatttctataggaacggcagggctataatactttgctgtcataaccccgccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtcgggagttgtcagcacgtcctcggccgtcacgtgattcacacgaccacggatgacgtccttgccaccgttgttggagcggggaggcgcttggccttgctgacgccttggctttgggcatttatccgcaaagtgcccgggctcgaagcagttgaagcacagacgctgctgaccttgagcgtccctgcggccttgaacaggcggcacagctggcgtaggaggacggggcgcacgagtcccttgctgattctgctgctgctgcggctgtgggacgcgcaccacgaactgaggtcggggcgctgggcgaggttgctgctgctgttgttgctgctgcgaggaggatccccctgggtagggattggtgtagcgaaccctctggttagcaccctgttgattgcggaaattcgccaagcggcgcttgtgcgattccagctccttgtgcttggcttccaagcggatgctcttgtccaccagtcgttgaaaatccggatagtccccagagactagacgaacggacagctcagggtccattcccgccaagaacttctcctgcttctcctcatcttcccgcacatcctccggggcataacgggctagattgttgaactcatgcaaatactccatcacggagcggttgccttgcttcaactcccgaaattcccttttcttaagagccacgactccagcgggcacatgggttctccggaaagcggcggtgaagcgagcccaagtaatcggttgcccttctggctgcgtggcctggaaatggtcccaccagagagatgcgggcccctgcagctggtgggcggcgaagatgactttctcttcgtcgctgcactgcaccgtgtccagcttcttccccacggcatgcaaccaatccaaagcatccacggggttgttggagctggagaaggtaggtgggcggatgcggaggaattcggcgagtttggagtgttggggagggggtggtggagcattctgttgtggcgggttttggaggtggtggaggaaagcattcatcatgttggcttgctgggcgaggatctgggtgagaatggcattggtgtctggtggtggtggtgaaggtgggttgccttgggggttggggttgctgccctcgggttggttgccttcaccggtgttaacatttctcctggtcgtcaccatctgaaaaccccacacagaaccagcaaacagagaaggagagctgacgattaaaactaaccacccacgactactataattcttgaatttatcactgctattaaattggttcattaaggttcaagttgcttaggcaaataaaataagacaggctccgacatagttacaccacaccccggcgtaaccatgccccacacgactcaagaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcgcgaggggtctcgacgaagcaagtccacgccagggactgacgaacaagctcgggcctggaggtgctcttacgggcggtgatcttctggctgcggcagacgcggcgacgcttgggacggctgatctctccctgggcgatcttgagctggtgcagctgcgcctccaacgcgtcgaggtccttcttgagctgcagattctcctgtcgcagctccaggatcttcaggttgttctccaccatgccacggcgcaccatctgatggaagtcgatacgagccgcgtcgtacgcctccaccatgcgtgccagatgcacgacggtagcgtcatcctccgagctggcgtctcggaaggtggcgtagtcgcaagctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagtggcctggcctggtaatccactccatgtggataccccaagaccacgcacatgcctcgcagctccaagacgaagccagtcatgtgcaaaccacgacgggtgacgctgccggccatctaaaaacaaagaaaagaaaagcaacattttcaaagatcagattttgacgataaatgaagcagcaagacaaagagagaatagcgggttttcacaaataataaaggatttttattttttttttgaaaatatagctaaggcttgggatctacggctcgtcctagggtcaagggaggctctgataccaacttgtcacgaccggaaataacccaacgggctttcctgacgtgcgtgcattaatccttgtcccaggaggcaaggtacaccaaaagttgatacaaatcagagtttaacaagcggaagcgtatataaaattattacatgggcaacgaaggcccagcacactcagagacaacgaaaaacagcggaagactagggcgacgaccacaggcgcttgacggcaggcacgagctagacaccgaagccttcatcttcagggaactcctcatctgggcttgggaaaattaagcaagactgagtacaaccaccgtactcaacaagacacacccacaaatgcagaataaatgcaagggagtacaagggaaatataccatagaggggttagggttgcagtaaacagcatttaaagacatttagttgctcaagctattttgtaaacacgatcctagagctatacaatgttattaaccaaggccgtgaaccctcacgaacctgccttaacccaaggcctacgatgattcagaccgaactggcaacccgacctgggtcccagctcgtcccaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatggtgtccaaatgatatgagaatttcccaagtctaaagttataaaaccacctaatgttgcctaattaatcagcgaagcatctacctaaattcatactagtggaaccatgaatagagtacccactagttggggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaatcgacggcttcgacttccacgaagagcggatcttccgaagctgcagcgtctacacgaccaacggaaaagaaaaaggctttaacactaattaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaatctcatttattgcgtcagccgagggggcgggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcacccgagggcggcctcgccggcgcggccgacgggagcggcgcgcacccgcgccccgatggtcgccgccggcgaccaacggcgcggcggagtggcacccgagagagaggaggaaagggggaaggcgaacggcggtcttcggctcaccccgggacaacgacgacgacgagaacggcggccggagcggaggaaagcggcggcgcggttcgggatgacgatgacgacggcgctccggcagtcgacgggcgaagcggagcggcggacggggtcgacggcaacacggcgaagcggacggaggtgtcgccgagtaaggaggaagtccggagcggcggcggcggcggaacggagctcggcggcgacggcggagagaaaggagcacggcgcgagcacgattccgacggcgagagcgagcggcaagcggcggaaacggaagagcggagctcggggagcaattatatagcaacgggagggagagagtgcggccggagagagaggaaacgggcgcggagatctcggctccattgaatacgccggcgaggtttgcgggattgattccgagcgaatccaagggagagagagaggggaaagagggggaatcgggagaggggattgcggggaataattcccccctcttgattgcacgcggggcggacgggagcggcgggattcgcggcggcgctagggcacgggcgtcggcggcggcgggaggagggagatgacaggtgggccccacctgtcagcgagagtggcgggcgggcccgcctgtcagcggcgcgcgcgcgcgcggggagccgatgggccggggggagagagagagagagagggagggaatgggccgagccggcccaagaagggaggaggagggggaaaagacttcttttagggttttctttttataaaacctttttaactttgtttatttcttttcacttattatttgtgctctgaaaattccactaaaatttgtttaagcattttaggcttttaggaaatatacaaaaatcctccaagcctcatttgacttttatctttgcacattttaattgttggaggctttcacatgaattttaattattctttgcacaatttcgaggatagattttagagtcgatttgggacgcgacagggaacgcgcctccggcggtcaccgcgcgaaacggagggcaggccggggtggaggaggtggcggcgacgctggaggaggcgacggcgcggccggccggcgcacggtcgaggcggcaccggcggctggaggcgtccagcggcacgggagagagagggcgacggtggggaggtggctagggaccacgggagaccgcgggagggggctaaagcgatagaacggagcgagggggttgcattttataggagagaagagggagccggccacgggggaggtcggaacggtggcgggattggcggccggcggcaaaggtaggcggccggacttggcgcgtccgttcccggcgattgggggtggcattcaagggggaaaacgggggaaaacgaagaggaatcaatggggattaattccccccaatcaatttggaaagagccggcttgaatagagcggatttacaggaggaatggcgctagggttcacggaagagaaaggaagaaggccggcggctgaaggtcagggacgcgcctgacaggcgggtcccacacgggaggcgcgcggcgtcagcgcaggttcggcgcgcgtgcatgagggaagtaggggtcggctcgggcagggggcggcttggaccgggcggccggcccaggaagagagaagggagagtcggcttgggcgggcaggccgggaggggagggaggaacggcccgagagagagaggggagggggagggggagggagagaaaaagagggaggagaggaggacttcgtccgcgggccgagagggagaggggaggactttgggccaaaattggcccaaaagaaaaggaggattatttttaggtttttctttttaataaactttgttaattgtttttgttgcttaataattat

SEQ ID NO: 10586 - DNA, 913 bp, Oryza sativa
cggcacttgaagatggggcctcagttccagaacttcgcatagttcatatctttggagttaacctcatacacgttacccacttcatgtcatgcgtcgagatcagctcgtcattactaggataccatgtttgtcatcataagaatatcatgcttgtcatttacttctatcttgccacaaactgcctcatattagttttcctggtctccgggtgctagctacttctgctattcgatgcgagggtcgataactttgcctttgaattatgtttctcaacagaaccaacttatcccacttgacatgctttgacgtcttcctaaatgactttactgctgaacttgttattgtctgatcgttaccccgccaattctgaagcttcgctgttacatgtgattttaatctgacctctgtaaactatcttcgaacatatcacttggttcataactgggaatagttcccacgaacaggcaactcggatttactttctttacattcagtttacttcccactatccccttcatgttgtcattatttagcattcaaagcattcctttacacattcaaccctgacatccgaaaaagacacatctgaaactcttgtccaaacaaatgtctctttggttaatcgcttgattttcttttccctcaacaggttgtttattaactcgaggttagaacatagttcctccgaaatgagaccctaggtctcctttgacagtaaacaattatacacataatcccatatcagcatcttccgaaagaatcctcatagaacttgtctgtattacacatttctcccttattacatgaatacaaggcactgccttaaacaaaaagggaaggtgcttaacatcggtacattgtatcctcaacatgaatcatccataaacatagcaaactcattgttcataatcat

SEQ ID NO: 10587 - DNA, 9094 bp, Oryza sativa
  unsure (1)..(9094): unsure at all n locations
caattcatttgctgccatacggtagggtcgcttgtacagaggagtggttcctggagcaagatctatccggaactcaatctctctcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagattgtcacaccctaaaaattttaaatatataaattgttgtttaattggaatttttagaaattaaattaaaagcctacaagctaaaccctaattttctaggaaaattttcaacataaaagtgggctagataaaattttattaaatactatgcttgctcctctattttctagaattttctgggaattatttgagcaagggaagtatttttaataattgaaacaacatttcataaaatgttttattcaaaaaagttcaaaagttcccccttcttggtccttgggccgatttcggcccgtctctctctttcctctctctcctccgcgcgcggcccaagccggcccagccaagccggccgcgcccgcgcccctctctcccggaggctgacagatggggcccacctgtcagggccgtcttcaacctccggccgccgccgcgccgagccgccgaaccctagcgccgctttcccgctccaaatccggccgaatccgagcccgattccttcgattgagttaggggttttgttcctctcaatctcctctttcttttcccccaagaatcaaagaaatccgttgaggattcgatccgaatcgaactcattttgatttatctctaaaaaccgagttcgtgttcttcccgatccgattcctctcgtttgcggcttggtctcttcgattcgagctcatataaaccttccccgtgatctcctctttcgtttgcccttttcccgagtcctcccgtgcctcctagcgccgccgcgacgcgtcgcacgtccgccgccgccgccggccatcttcggcatcgccgccgtgccgtctccgccgtcgcctttggtcgccgccaccgccgttaggtgcgccgtgaggagaggaagctcgtccgcccctccgtttgcgccgccgatcatcggagctccctcgacgccgtcgacccgagccgccgcgccgcctcttctcgtcgccggccgccgtcgtgcatcgtttcttgtcgtggtgagtaccaatgagttcgtctcgtcgcccgctacgcgttggtgccctccaatcccgccgccgaagtccctagcgccggcgagctctccttcccgagccggccgccgtcgctgacgtcatgccgacgtcaaccctagggctgacgtcatcagggccagggctgacgtcatccttctctctttttcctttttctcgattttcaaatagattaaaactttggaaaatcataactaaataaccgtagatccgttttaggtggttcaagtttctaaatttttctaaaatcaagatctacatgataaaaatatccacatgtactgtttatgcttgtttttgtactgttttgttgattttatttatttgctttagttttcgacgttccggaggagagcgtttccgttgaggaaggttccgaagcgtttgtggaagctcaaggcaagtcacacagatcccaaataaccctttgagcatgttgatcctgtttaaagctattattttatttcaactatgcattgttttcgaatgtcatcgggtggtgaacttttcccagttaattattggccgaagttgactttattttcctatgggttataatttgattagcatgaaccttatatattggattggttcagctaaatgctatctataggtttgcttagacatgcctagaaacattagctaattaaatgggttaattataaactatgttatactattatttaatgatggttattttaatggtagctcatgatggtcaatcgtgtgatgataattaattgataattaaaacctgattaaggtgggttgtgagcatatggttttgatggttgtgctcatgacaattaaggaccggttcgcgagctactgttgtgaaacatctatcgtgccaaccacaagccagcgtgggcaacggctttatcttttgtatagcatggttcattatggtgtgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccacggttatgggtgagttgagcaatgtttttcgtgattagtctcacacttctcattaatggtaataatgtagtaattaatttatttcctggtttggaatggttaattcctggtatggagggttaatttgttcaactggggttggttgatcaaatgtggttgggcctatgcaacacgggtgtgttgtatggtgtttatttaatattgattaattattcaactgttttacttctctcttaaatatttgttaaatgctgttttctgcaaatgagctatattatgccatcctttgctatcctgtgcacttgcatatttgctgtgtggcttgttgagtatgtcatatgctcattcttgcaatattcattcatcagaggaggagtacttcagtgaaggtgatgatctggaggaataggcttgttctggttaagttgcctgtggagtggagttgccgtcgctgttccgtagtttgttttagttttgttttccgctgcgtagaatgttgtttttgtttgagaggaactatctacctctgtaataattttattttgcgaatatttaataattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtaaccttcaaaatattttggaaaaaaaaaatagaactgctcttctcttttctcttttaaattaactaagttggcagcatatgcaaggttatgcacaaaatttattgaaattcaaattcttttcttttaaaagcaaaaagttgttcttctcgaaatatttttttttctctttaccaaattttattgattggtcggcactgtacatttattatggtatcgaattaatcatgttagcactagtactactgatctttcctatggtgacactgtaccgtgcttataatagatcataattatttcagttttattttaattatttgtcaaaaaaaaatatatttgtttctgtttaaaaagttaaattctaaaaatatattttataaaatagctttgtatgtgtcttttcttctattttcttcctttttggtcaaaaatcagttaaggttagctgcaccaactagacttagctaacttaaaatatgctttaattcttctcttctatgtctctttagatgccgccccgttcaccaagaaatttgatcgaggtgttaggactcgtcagggagctgaggttgatggcttttgaagtaggctatgaagttgctcccgagtatcgccagattccccatgaccccgacgaggagaaatgtcgtgttcgtgtgacattggctagtgatagtgaagatcttccatcttttaagtttgaagctggaggaagatcgtactgccatgcttgtcaagaagtagctttggtggccattggagagttgcgtcaacactttgaagaagaattggattcatcagctttccagtatcatcctcacaagcctcatggtcaagactatggatcttatacctgtcctgatggcgaagagagtgctactctgatgcatgtggtgcatatgcttagtgctatggatacagtaagtgtggagcgagacaaagcagctcatgacagggaaaattggaatcgaggcaagatttgcaagttgaagagcaaggtgcaccgtctacagaaggaattagctgaacttaagggagagatgccgccgccaacatccaagcttcgcctcactgcaagaaagagaacctgtccgccccctcgtctccagttagcttcgaagattcgcgtgatgggtgaagctgtgcccgatcgtgctgaacctgtcatcgacatcataagtgatgaggaagaggaggaagatcctgaagaaagagagccagctactccagaggaagaagattcatcgcttcgttccgacgcaaggtggaagtagtcgtctagttagatcgttgccttagatcgttgtgttagattgtttgcttaagtttgcttgtgagtgtgtgggttttagttgttgcttacatcatgggggggatgtaacagcatgagtctagttctttgcttgtcagagtggtgaggtagtgttaatgcaacttaaatgtaatcctacacagttaagagcaatatagaaatttaaattaattaaataactccgttctaagggtgtctctctgtctttctttccttttgtctctgcttaccgtcagatggtgaacacgcgcactggaagtggaagtggaagtggagctaataacaatgagggagaacctacgctagcccagattttggcccaacaaacacaactgatcaatctgttagtgcagcaggcacagaatcagcagggaaataatcagaaccagaatccaccccctcctccccaaaataagttggcagatttcttacgtgtcagaccccctaccttttccagcacaaccaatccagtagaagcaggagattggctgcatgcggtggagaagaagttggatttgatccagtgtactgagcaggagaaagtttcatttgcttcgcatcaattgcatggacctgctgctgaatggtgggatcattttcgccaaggcagggctggaggagaacctatcacttggcaggagttcacagctgcttttaagaagacgcatataccgtcaggtgttgtagctctaaagaagagagaatttagagcactcaatcagggatctcgttcggtcacagaatacctccatgatttcaaccgtttagcacgctatgctccagaagatgttcgcactgatgaagagcgtcaggagaagtttttggagggactgaatgatgagttgtcttatactttgatgtctacggaatttcgggatttccagcagttggtggacaaggcgattcgtcaggaagacaagtataaccggatggagcagaagaagcgcagggctgctcaatttaaggcacaacagggcagtaatcagaggccgcgactcgttactggacctcaagttccatcgtaccctcaaggaggatcttcatcagttgtccgtccccagcgccagttctacaacaacaatactggtaatcgtggcaatgacaaccgcaatgtggttgctcgtcctgcagcaacttcagttcagaaccagcccgtcaggaaggaacagggaagcaagcccgtgatatgcttcaattgtggtgatcctggacattatgctgataagtgtccgaagcctcggcgtgtgaagaacgttccagcccccgaacaactccaatgttccagcaccgaaggcgcgtgttaatcatgttgcagcagcataagctcagaatgcaccacatgttgttttgggtacgtttcctgttaactctatacccgcaactgtgctttttgattccggtgctacacattcctttttgtataaaagttttgcaagcaaacatgggatggaagttgttagtcttgggagacctttactagttaataccccaggcaaccaagtattttcgacacagtattgtccttctgttaccatagaaatagaagaagttcctttcccgtcctctcttatcttgctagaatccaaagatctagatgttatcctagggatggattggttatctcgtcacagaggagttatagattgtgccaaccgtaaggtgactgtaaccaatagcaatggggaaattgtttctttctttgcatcctctcctaaatctcatggtgtggtcttaaaccaagttactttacaagagattcctatagtgcaagactacccagatgtgtttccggaggatttgccaggtatgccacctaagagagatatagagtttcggatagacttggtacctggaactaacccaatccataagagaccgtacagaatggcagctaatgagttagctgaggtgaagaagcaggtggatgatttgcttcagaaaggatacataagacccagtacttcgccatggggagcgccagtcatctttgtggagaagaaagatcatactcagagaatgtgcgtggattatcgagcgctgaatgaggttactattaagaataagtatccgctacccagaatcgatgatctgtttgatcaattgaaaggtgctacagttttctccaagatagatctccgttctggatatcatcaacttcgaatccgtgaggaagatataccaaagactgccttcacaactcggtatggtttgttcgagtgtactgttatgtcatttggactcactaatgccccagcctttttcatgaatctaatgaataaggtgtttatggaatatctggataagtttgtcgtggtgtttattgatgacattcttatttactccaagacgaaggaagaacatgaagagcatcttcgtctagctttagagaaattacgtgagcatcacttttatgccaagttcagtaaatgtgaattttggttgtccgaagtgaagtttcttggtcatgtcatctcatctggaggagtggcagtagatccaagcaatgtggagtcagtgttaagttggaagcaacccaagacggtttcagaagttcgtagtttccttggacttgcagggtattaccgcaggtttattgagaacttttcaaagatcgccagaccaatgactcgtctgcttcagaaggaagtgaagtataagtggacagaagattgcgagcgaagtttccaagaactgaagaaaaggctagtgtctgcgcccgtattaattttgcctgattcgaggaaaggtttccaagtgtattgtgatgcatctcgactcggtttgggttgtgtgttgatgcaagaaggaaaggtggttgcttatgcatctaggcaattacgtcctcatgagaataactacccaacgcatgacctagaattggccgctgtggtgcatgcattgaagatttggcgtcattatctttatggtaaccgtacggagatatatacggatcataaaagtttgaagtacattttcactcaacctgatttgaacatgcgtcagcgaagatggttagagttgattaaggactatgatatggaaatccattatcatccggggaaagcaaatgttgtagccgatgcccttagcaggaaaagctactgtaatatgtcagaaggtagatgtttaccttgggagttatgccaagaatttgaaaagttaaacttgggaatagtcagcaaaggttttgtggccgctttggaagctaaacctactctgtttgatcaaattagagaagctcaagtgaatgatcctgatatctaggaaataaagaaaaacatgcgaagagttaaagccatcggttttgtagaagatgaacaaggtactgtgtggttaggagaacaattttgtgtcccagaaaataagnagttgaaagatactatcatgaaagaagctcatgaaactttgtattctattcaccctggaagtactaagatgtatcaagacttaaagcaacaattttggtgggctagtatgcgacgtgagatagcagagtatgtggctctatgtgatgtatgtcagcgggtcaaagcagaacatcagaagccagctggtctgttacaactgttgaagattccagagtggaagtgggaagaaatagggatggattttataaccggtttacccagaacgtcgacaggacatgattctatttgggtagtggttgataggttgacaaaagtcgctcatttcataccggtcaaaacaacctatacgggacataagcttgcagagttatatatggccagagtggtatgtttgcatggtgttcctaaaaagatagtgtcagatagaggtagccagtttacttcgaagttttggcagaaattacaatcagaattgggtacccgtttgaatttcagtactgcttatcaccctcaaacagatggtcagacggaaagagtaaaccaaattttagaagatatgttgagagcctgtgttttagatttcggtggaagttgggataagaatttgccgtatgcggaattttcctataacaatagttatcaagctagtttgcaaatgtctccgaatgaagcattatatggtcgaaagtgccgtacgccgcttctttgggatcaaaccggagagcgtcaagtttttgggacagacatattgcgagaggcggaagaaaaagtgaagattatccaagaaaggttgcgcgttgctcagtcgcgtcagaagagctatgccgacaatcgtcgcagggatttggctttcgaagaaggagattatgtgtatcttcgggttacgccgttacgaggagttcatcgtttccaaaccaaagggaaattggcaccgcgttttgtgggaccttttaagatcgtgagtcgaagaggtgaagtagcctatcagttagagttgcctccgtcaatggcgggaatacatgacgtgtttcatgtgtctcagttgaagaagtgtttacgtgtaccaacggaggaaacagatcctgatcgtatagagcttcaagaagatttaacgtatgttgagaagccagtcagaatcttggaagtaagcgagaggaaaaccagga

SEQ ID NO: 10588 - DNA, 616 bp, Oryza sativa
ggagctccggcggtcggcgggcgaagcgaatgggcggacggggtcggcgacaacgcgcttaagccgatggaggtgacgccgagtcgggaggaagcccggagcgacgttggcggcgaaccggaggtcgacggcgacggctgagagagaggtgcacggcgcgagcactaatccgactgcgaaagcgatcggcgagcggcggaaacggaagacggagctcgggggacgattatatagcgtcgggagggggagagcgcggccggagaggaaggaaaccggcgcggagatctcggccgccattgatgacgccggcgaggattgcgggcgcgatttcggacgaatccgagggagagagagaggggaaagaggggggaaagagggagggaatcacggggagtgatttccccctctttattgcgcgcggggacggcgtgatgcggcggattcggcggcggcggcggcgctagggcacgggcgcggcggcgggcgcggcgcgaggagggagatgacatgtgggtcccacccgtcagcgagagtggcgggcgggcccgcctgtcatctgcgcgcgcgcgctgtgagggcctattggccgcgggtgagatgagagagggggagggag

SEQ ID NO: 10589 - DNA, 905 bp, Oryza sativa
tgacggccgggccccacttggcagccgcggggcgcgcccgaagtcgtcctcgccggcacggccgacgggggacggcgctcccgcgccccgatggtcaccgccggcgaccaccggcgcggcggatcggcgcccgagagagcggagaggagaggaaagagaaaggggcggtccccggctcacccggggacgacgaggacggcgaaaacgacggccggagcgaaggaaagcggcggcgcggttcgggacggcgaggacgacggtgctccggcggtcggcgggcgaaacggaggagcggacggggtcgacgacgacacggcgaagccgatgggggtgacgccgagatgggaggaagtccggggcgacggcggcggcgaaccggagctcggcggcgacggcggagagagaggacgacggcgcgagcacgaatccgacggaaagagcgagcggcgagcggcggaaacggaggagggaggcacggggagcgattatatagggttgggagggggagaaagcggccgggcgagggggaaacggccgcgaaagatgcggccgccattgatgccggcgaggtttaggggaaagattccgagcgaatccaagggagagagagcgggaaaagtggggggaaatgtcgagggaatcacggggagtaattccccccacttcaatgcgcgcggggacggcgggatgcggcggattcggcggcggcggcggcgctagggcacgggcgggcggcgggagcggcgggaggacagggatgacaggtgggccccacccgtcagcgagggtggcgggcgggcccgcctgtcaacggcgcgcgcgcggggaggaggccgatgggccgcgggggagaggggagagagggagggagctgggccgagccggcccagtaggggaaggggggg

SEQ ID NO: 10590 - DNA, 3647 bp, Oryza sativa
ggagggaagctgggccgagccggcccagtaggggaagggggggaaagaagactttttaggatttttctttttataaaaccattttaactttgtttatttcttaataattattatttgtgctctgaaaattccactaaaatttgagggctccttttagaccaaggagaatttaacaaaaattccccgggccacatttggatttttcttgtacgtattttagtgtttgccaatttcttttcgaattttaattaattctattattccttttagaaaatgatttttaatttcgggatgaatttatcaggacgtgacaaatccaccccccttacaagaatctcgtccccgagattcgaggaggctagcaggaagataggtcggacggtcttctcttcttgtctgacttcttccgtcgcgtcttctataacgaacttgcctagccaaacttctccactctggactgcttggctcgatctcctgttgcggatggaaccttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcatgagaataccatgcttgtcatttacttctagcttgccaccaactgcctcatattagctttcctggtctccgggtgctaactacttctgctattcgatgcaagggtcaaccactctaactacaagttatgcttcccaagagaaccaatttatcccacttgacatgctttgacgtcttcccgaatgactttgctgccggacttgttattgcctgatcgtgatcctgccagacctgaagcttcgttgctagaggtgattttaatctgacctctgtagactatcttcgaacatatcacttggttcataactgggaatagctcccacgaacaagcagctcggattcactttctttacattccgtttacttcccattattatcttcaggttgtcctcagttagcattcaacgtattcctttacacctttaaccttgatgtgttctttcccattgggtcatctcccaagacatggcatttcctggtaaccggtgcttgcactttttactccgtgtagcatctgatactgagttgaggatttcactccttgccttcatagaaacacttttacctaggtcatcttgcttacttaatgacaaggtgactgttgcggggcaattactatcaggggtcttccttgagcgatgcagagcatgtttctgtttatcaatcacctttcggcctactttttttcatgctggagaacatctttgccaatctcttttatcgatcatctttcggcttatctctaacaggtggtattctttaatgtggattgcggacgcttctggggacgatgaggtccttcggcttgctgcctttcagtgaaaccttgatgtggttcgtcaaaaagctgcactgactaccttcagggaaatacattgcttgctatctgtatctatgccactagggtttaattgccgatggtcatctttagtgcttcctcgagatggggagcatccaaattgttcttctgccatatcacctttgacccttttctgataccagataaacgaattaccaaccatcgactactacgttctcaaatattgatgtctcctgggtcttcttaactgtttgcaggtatatccgaacttattaatgtagagccatggtgggtaccctcatgggtttcatccaacaatccttatcttgatctgtaaaaggcgtatccaaactcctatccccaactactgtctcattggctttttaacccaacacagtttaattggttttcttttccatcaacaggttggttattaactcgaggttagaacatagttcctctgaaatgagaccctaggtctcctttgacagtaaacaattatacacctaatcccatatcagcatcttctgaaagagtcctcatagaacttgtttttattacacatttctcccatattacaagaatacgaggcactgccttaatcaaaaagggaaggtgcttaacatcggtacattgcatcctcaacatgaatcatccataagcatagcaagctcactgtttatagacatgaatatatttatttattacaggattgctgcaaactttcgattacggtgataagtagcgaactgaaaatcacaaacatggctactcattctgattctgaagaggtatagctggcattgttctagtgactgcatcatccttgattggttctgtgatgatgtgataggactgcatattgctatcattcacaggagaagcttccttctgattgctggttgaagcgaataacggtcttctgcttggtatcgccctcctgaggttgattgccctttgctcggcctggagtaggtcggggagagacacaacttcttccatcgacgacaattctttgctgaggctgtcggtgcagagaatggttggtgctgaagatattattgccatgatttattgcagagttaggtggagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcacagaaaacatgtgaccttgcgagtgggacactcccctggtgaatggtcttcttcatagtgagtgcagagtgtgagacacatgctagcaacgtgtccagtttctccacaacgggtgcatgcctttgatccgaagaagacacatctgaaactcttagtccaaacaaatgtctctttggttgatcacttgattttcttcgccatcaagcgctaggttatttgattcataacagattatgagcttacggaaatgagaccctaggtctccctaatcaacaacaaaatatacacaactcacagcacttgcaatcttaacatggatccttcataaacttatcaaactccttcataatctcatgtttctctgttattacatgattgacggggaacaactataaaacataagtatttgaacactgatataagagtattatggttgcttctgactagcgctaggcttaacaggtactgcatttgctccagtgaccacttggcgattggcatgtctgcttccttaacaggtactacagttgtaacagacaataactttcttacgctcgggttcttcatcttgtacttgatttcttggctgctgtgctggaacatccaaagatacaatgccgatactggcctctgtcttgtcaactgatggctggggctgaaattgagcattgacaccttgtggtaatgcactcgctggagttggagctgttgcaacgcgggctataagactgcttcgggatgcatggatgacaattcgctgaggagcaagcttctgattgcagggagttgcgtggactgacgtgctggcaactatgtttctcggttttgggcacttgtcggcgaaatggcccattccttgacaattgaagcaacagatatcttcccggactcggcatttt

SEQ ID NO: 10591 - DNA, 765 bp, Oryza sativa
tatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtcttcataaaatggctttgggcaactaagtgacttttaaatgctgctttctgcaaaacttaacccctatattattatccccttgtaccctcccttgcattaattatgcatctccggtgtggctcgctgagtactgtggttgtactcattcttgctcaacctttcccctcttcagtaagagaagctgtggagaagatgtcttaggtggagtcctggcttataccccagttgagcgcctgtgaagatggagccgtaggcccgctagttcgctgctgtttatttttgattgtcaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgtgacaaaccagaactcacacttgctaagtttggcatacaattgatgttcccgcaactttcccaacaccagacggagatggtgctgatggtcttcctctgattgtgagtatacc

SEQ ID NO: 10592 - DNA, 2779 bp, Oryza sativa
agaatatgcatatgagctaatggaaaatgaatccctacaaacctgtgttatctttgctcttacggaatcgtttaaccactgaatatggtaaggatgtggatgtgtatatgtggtcaagccaagcttcctgaccaaatcagaactcaccaaattgttgtagctacatccatcaatgatcatacgtgcacgacggttgttgatgacaaagaaaatctgaaacaaattatggcgttgcaacctctcaggctgctgtacctacatgctgagcacccgctgcacaatgatggtcctgtaggccgttgtgtcatcacgaccaaagacttcgccatcctcatcctcaacttcttcttcctcctcttcctcatcatcttcaacattggaggtggtgatgtagccaacttctgtagcaacatatgcccgttgactagggtaatctttctgcacatgcccaaacccctagcaacggtggcactgaatgcgtcccgtcgaggcgacagatgaggcactcttggcaggtacctgcgaagaacttttacctgactctgctggtcatgggggaggtggttttggtgctgcagaaactccagaagcagctggttgcttgcttgttggtaggggaggtgcccggaaagagacggccttgggcagtcccgcagatggcgtcgtgcgaggagtgtatgtactcgccctgttcttgccctgctactcacgcccctgcaattccttctttgcaagcatagcaaactgaaacaactagttgacagagttaaattccttataatcaactatgttttgaatttccaccctcaaaccagaataaaaacgacaaatggcatcctcgatcctctccactatgccacagcacttcaaacccttttgtagctcaccatagtaatcctgtacagacttatccccttgttctaaacgcatcagtttttttgcgtaaatctctatgataagatggaggaacaaatctattgcgcatagctaccttaagttcttcccaagtagtaggtaaaactcccccgtcagataacccatcccaccacatgatagcaaaatctttgaactcactactggcttgtcgaactctatgttgctcaggcacaaggtggacattaaacttttgttctactatcatctcccaatcaaggtatttctcagcatcataatatcccgaaaaagatggtattttaaacttaaccttagcataaggttcatcgggcacacgattattattaccttgttggtagtggtgagtgccaccgatacctgtgcggtttgtccaagatgatgttgtagtcgtgcttccttgtagcttgtgcattaacattgccactagaatcatacaccgtgtcttcaggatgaccatcatcgttgctgccgctcactttctcaacggaaggttatgtgtctccaacgcaacaacccaatcagttagcatggatatccgcttgtccagcctctccatgtggtttaggaagccaattttattgaaagcatcttggacagcctttgcaacggcctccatcatgtccttttgagcattttcttggaaagttcgtgtaacatcctgaaaattcccgacaataaaaatcacttaaattttgaactttttaaaacttttgcatcatgctggttgttatggttgatattgcttgccgaaatgtaaataatcacaaagaaagcaaatccaaacaaagggaaggttaattactaatttaatttatagatcaaatattaaatattcgaaccatgctgatagcttgatgccatgattagctaaaagaaacagtaaaatcaaatctaaatcatttgaatccaatctcacatgaaatataagaacacatgaaatgatgatcactagtataatgatcgtgtttaaaaataagtaattcaccggaatatatagattgatacttagaacatttcaccgagtccctcatgacatgaaaatcactcatataaaataatggtcatataaataaattaagcattatatataaataagaatatgtgagtgtttaattaaacaattagattaatgttgtaccgagtctcaatttatatttatagaatgactagatccacgtaaaatacattgttatacaaataggttcattcgatgtgctattgcaataataatggccacattaggatattttaattaattttagaaccctcaaagcctccaaaattatctaggttaattttataattagacctcatttaaataatgcaatagaaatatatatatataaataaaatatgggtaatattaaaaattgagtaaactttcatctaaattatcacatctattgggtaaacatcaattgtgtgaaatctagaatttatgggacaagttttaataggaaatatgccctaaaattggataaataggaaaaagtcactgttcattatggcctaggtgctcgatgtggttccatagccctgcccctccactgctgcgccgccctagccggcctcgagccccgcccgtaccggcgccgtcgctatcccgtcgcctgtcgcgtcccaaaacgactctaaaatacatcctcgaaattatgcctagaataattaaaatccgtgtgaaagcctccaacaattaaaatgtgcaaagttaaaagtcaaaaaaaggcttggaggatttttgtatatttcctaaaagcctaaaatgcataaataaattttagtggaattttcagagcacaaattataattaagaagaaataaacaaagttaaaaaggttttataaaaagaaaaaccctaaaaaaa

SEQ ID NO: 10593 - DNA, 6325 bp, Oryza sativa
taaaatttatttacacattttaggcttttaggaaatatacaaaaatcctccaagcctcatttgacttttatctttgcacattttaattgttggaggctttcacatgaattttaattattctttgcacaattttgaggatgtattttagagtcgttttgggacgcgacactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccaaagcggtggtactaatccaacattaccattagaactgacagtctaaacattaatatgattttccccattgtgaactagttgaactaagcatggctaagcaaccctagtcctaactctattcatgttataacccaagctaacaaaggagcgtggtatcaaaatagtatggccgtaacaataggtaaccatcccatagtaatattgcaaaacaaatgcggtatttgaaagaaaacaatagagcatttgcaatataggatcaatatgatcaagtgacaagcatgacttgccttgctctgctgctggaggaacctcggcgactatctcgaagtacaccggagcgtcggaggaaccggaatctagcgacatacaaggcaaacattgcaaacaggctataagactactgaaacagagaacaaaaccatttttaatggattctacacatttttcttgatttactgagacatgaatgggattaaacggagctcggatgaattagttatgatttttagaagattcactgtgtttattactataaaagaaaaaaccttaaatcatttattgcgcaatattaaccagggctggaggagggagacgggcccgactggtgggccccacctgtcggcgaccccgagagaggacgcagcggggcggcctggctgggcctcggcctgcggccggcccagcagggagggggagaaagaaaggagggaatgggccggcggcccattcgaaaaaaaaaggaaaaagagaggaaaaagaaaaagaaaaagaaaaaggattttccctggaattaaaaatattgcttgctcaattttaattggttaaaattatttctagagctctgaaaattccactaaaaatcctgttaatgaatttcgacatatagaactcaagaaaaattccacatgtcaaatccgattattatttgcattactttcttagggttttctcctgatttcacctgcattttcttggggtcatttataaattacaattttggcttggggggaaaacttcggggtgtgacagccacccgcgcccttaggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccatttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgttgacgctgcagcttcggatgatccgctcttcgtggaagttgaagccggcgtttgggaaagcgagcaaggcaagtcacatcatccttgaacatattgaatcccagtttataaaattatgttgctttaaattattgcattatcgctttatttaaattcccacgttatcactgttttatctagccatgcctatttacctttgttatgaccttattattattgttattgttattattaccttgttcaccctagattaaacaaaaccccaactagtggacactctactcatggtaccactagtatgattttaggtagatgcttcgctgtttaattaggtaacattaggtgattttacaactttagactttgggatattctcatcacctggacactatggaattgttggattattgtggaattggattcacacctccccctctgttcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggctataaacaaaagtacacggatggagatggacgaagtcgggggtcgatggacatctctaggacaaatgaaggctacacgagctgcggcccggtagtcgagatgtcatggcatagggccggtgtcctgctgctaggggctcagtcctgcctacctgtcccgggggtttcggccgtaggtgggattgggtcggtactcttgtctatggctagggtgggttggaaactatgtcacgtctcccgtctgtataccgtggtggtatgtggcacgtggctacacgtgaggaagatgtgtcttgtgggtaaagatgtacacctctgatcagagtttaacctattcgaatagccgcgccctcggttatgggcaagccgagcaatgtacccaagttagtgttttaattcttagaacctgcttaacaactaaaatgtggaatggttggcctgggttggcttgggacgagctgggacccagggtcaggttgccagttcggtctaaatcatcgtcggccttgggttaaggcaggttcgtgtgggttcacggccttgattaataatattgtatagctctaggaccgtatttgcaaaatagctttgagcaactaagtgtcttttaatgctgtttactgcacaccctaaccctttatattgtaactcccttgtactcccttgcattttattctgcacttgtgggtgtgtcttgttgagtacggtggttgtactcagtcttgctcaatttttcccaaacccagaagaggagcctctggaagatgaaggctttggtgtctagctcgtgcctgccgtcaagcgcctgtggtcgtcgccctagtcttccgctgtttcccgtttgtctttgtgtgtgctgggccttcgctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctttgttatttgtgaaaatcctctagtctctctctgtcctgctgcttcatttatcgccaaaatctgacctttaaaatgttgcatttctttttgtttttgtttgtagatggccagcagcatcaaccgtcgtggtctggacctgactggctttgttttggagctgcggggcatgtgtgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgctgtcacgtcctgataaattcatcccgaaattaaaaatcattctctaaaaggaataatagaattaattaaaattcgaaaagaaattggcaaacactaaaatacgtacaagaaaaattcgaatgtggcccggagaatttttgttaaattctccttggtctaaaatgagccctcaaattttacttgaattttcagagcaccggaaataattattaagcaacaaaaacaattatcaaagtttaataaaaagaaaaacctaaaaataaccctccttcctcctttgggccaattttggcccaaagtcctccctttttcccctcggcccgcggccgaagtctccctctcctccctctccttctctccctcctcctcttgggcctcctcccctcccggcccagctccctcccctcccctctctctcccgggcctcctctccctcctctcctcctgggccgcctcggcttcgcccggcccaagccgagccgcgcctcccgcccgtgccgcgcgcgtgcgcgcgctgacgccgcgcgcccgaccgcatggggcccacgcgccaggccggtcgtccccttcctcccgcccggcccccttcctctctctccctcccgtgcgaaccctagcgccattcctccctcaaatccgcgcgattcaagcatgggattcccaaattgattagggggaattaatcccctttccctcctctctctttcccccttaatttccccttgaatggtgcccccaatcgccgggaacggccgcgccattcccggccgccttccattgccgccggccggcttttccgccgccgttccccgctcctcccgtggccggctccctcccctccgctataaaatgggatcctcatcctccgttctatcgttttaaccccatcccgagactccccgtggtccctagccatctccccgccgtcctcctctctctcccgtgccgccggccgcctccagccgcctctcccacctcgccggagcgccgtccggtcgcgccgtcgcctcctccagcgtcgccgccacctactcttcgccggcctgccctccattttccgcggagacccccggagctgcgttcccgccgtcgcccttccctttcctccgcgtcggccgcctccagccgcctctgtctccctgcctgagcgccggttgacgtcgccaccacctccctcggctccgcgacgccgccctcatccccggcatcacctcctcctcgcccgaatttcgccggaacaccgtcgcccgcgccggcctctccttcctcctcgtcgacgtctcctccggcagccccttccgccgcgcccgtgcatcagccggcgctgccgtcccctccctcggcgtcgccgcatcgccctccaccccggctgctcctcggtttcgccggaacgccgtcgccgcgccggcctctccatcctcttcgtcgcctgcgtcctttcggccgcctcttcctcctccccggctcgtcggcttgccgcaccactaccatcttcggcatcgcagccgcgacgtcgtcctcggcctcgcctcccctccgaccgaacaccgccggtgtccgtcgtcgtcttcaccgttcatcctcgccggctcgccgcctcgcggcgccgccttcgtcgtcggcatcgcagcagtgtgttccacgccatcctcgcctccgtgcagccgctgtcggctgccctcgtcgcctcctcgccggccccggtcgtcgtcgtcgtcgtcctctcgtcgttcccggtcgtcgtggcgttcgtccctccgtcgagccgttctcatccgtcgtccgcatcagtcaagcaagccgctgcagccccgtcctcgtcttcatcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttgtcggccctggtacccatgtaccggtgtcggtagtcgttcacgcgtgcgggtggtgaccgtgtagtgtccgtgttagtgtgcccgctcggtagccgcgtggtttccacgtgtgcaggccgtgtggtgtctagtggagtccgtttgtcgg

SEQ ID NO: 10594 - DNA, 4956 bp, Oryza sativa
tgcaaagttttattataataatccgcaaatcgccatataccagcattaaacttcggatgatcatatcttggtcatacgaactccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttcttatgaccttattattattgctattgttattattaccttgttcaccctaggataaataaaaccccaactagtgggcactctatttatggttccactagtatgaacttaggtagatgcttcgctaattaattaggcaacattaggtggttttataactttagactttgggaaatctcatatcatttggaccctatggaattgttggcttatggtggaattggacatacatctctcttcctctttcaaaacccttaaaacctattttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctccagggcaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataattttgtgtagctctaggatcgtctttataaaatggctttgggcaactaagtgacttttaaatgctgtttactgcaaaacttaacccctatattattatccccttgtacccccccttgcattaattatgcatctccggtgtggtttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgcgacagaggacgtccaccttcccgcctctcaggaagtggctccaacagcataaaatcatcatgcaataacccatcccacacaagttaagaatttagagtctagccaagtgtaatacacgtcccggtgctcaataaccgcgagcacggctattcgaatagatttggtttactcacactgcagtggatgtacactttacccgcactccgcgactgcccaacacatgagccacgtcccaacacatgagacgcgtcacggcaaagcttttcgataacctcgcattggcagtacccactccatgaacttgaaatcctcatgcactctaggcgtacacggtttctagcagtgagaggagttctggcgctcccgggaagggaaaaacacacacattcctacgttgcttcttgtcgttgaacccagtccctcatgattgttctcttatgggtatcctcatgcagtattgctaagccagcctctgaccatccggaacgggcatccgccattcacctggccatccgaaccgggcatccgccagcagactgcttgccgcatcacacacctagaagaagaccactacgcagggatactgcctccgctcggctatctaatccgctaggtctatacccattcgagaagtacggttgtacggggggcgtttcatgcttaacttcatggctcggtccttaattgaccggggacggtactagccttttccagataccacccaaatcctccgtccgccccagtcgaaaacagttgtttagttttatttctcctttcacaaatcatgtcatcaatatcagggcaatgtggtgctcatgtctccacatgccgcatctcaattaccttcccaaaggtaattgctcaagcatatagcatttgataaatatgagtatgcatgattctagaatagcatttctatgcattcgtcatagttgactagggactcatacgtaaacatggttacgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgcctgctcaggatagtccttattcttgatacaatcgtgatcaaccttcacctcctggaagctacatacgttgcctcacgactaaccgatatacaaattctataatacgcgagaaaaaccgatattcaaacaacaatcgaatatgtacaaacaaaatatagttgttggggtcgaacctagggttgctcatactactcgtgtttgctaatggattctaatcaagctaagaaataaggtttcttaatctttatgttgtcatcatggtcttttcaggagttaaccaacatagcatttatgggatacatatttggctaatatgtggtttagtctagcaaatggctatatatgcatctatctaaatagaacggttatacactagaggttctgttgccggatggattttggatcggtcaaataattactgtgaatcatttctattattatgaacatattttatttgtcacaataaattatgaaaggttaataattatccatgctctatatgttacacttgtgaggctaataatattatagttacagattatcccatcacataattttacaatgaataatcttaatttacaattgaacttaggttatattaggtcaaggtctataattaggatttatccaccatacatgttcatcatatattctctttaattttaatacgtacaatcaagcaatttaatactacaccgtatagctataatgggttgtgcagtatatatgtgtgcacaatatcttaatattgaatcatttactgaatagttgctatttactataggctatatagtacatgtgattttaagtggatttatgagtgagttaccgtctatcaacttaagggttgatttccaatctaaacatatactattgtataggaaatgccgttaactaacttcatgcgggtgattttagtcacactagctctgttattatctctcataaacatgttattatccctcataaacaagttgaagactcatctacgtgtgttcaaatttagtcacaaagtatgaggctaaacattatttatacaatttggacgtcatgagtataattatattcacatatattaataaatggcactagtatttcctatgctttaattaatttgaaacaatgctcctaattagtttacataggttttatagcgagaaagcatgttaaagacaattatttgacatctactctactgtacaatatcaatcctatttatgagcacatttttaagttaactattatacatcatcttggtattaactatttcctaatttaaatatattttcgtaaatagtgaattatataccattggaaatcttatgaatttagatgaatttaggttcaagtttcactcgaatcggagctaaaacgaataagttacgctagtttaaagattcaaatttgaattaattctaataattgtgaaatggtactgttcctaattcatttatttttaatacaaccttatccacaagctatagtgactgacaggtggggtcttcctagtttcttttcttttattttatttttctttctaaaggaatccatatgggcaaatgacaggtgggcccgactcctttgactagggtcaaaccggccattaaacccggtagggcccgcatgtcatagactcgagaccataaaacttctataattagatttttaaccacccggacccacatgtaatagacacaactaataaagattaagaaggggattactattcaccaattacgtggggcccactctaatctctcttctctattcttctttctctctctctcctctgtttcctctcttctctccctctctcacggccgagcggcacggtgtggctaccagcgacgaagggaggagggagggcttaccggaccggtggcaacggcggcggagacacagcggcgaggtgcggcgcggcggcgacgaggcgccggggcacagcagcggcagcgcggcggcggaatgcggcgtcggtggaggggaagaaaaggggaaaaaggggaggagaggggaaatggcgtgggta

SEQ ID NO: 10595 - DNA, 7618 bp, Oryza sativa
cacgggcttgtcacagcctgattttcgtttaggatttataaattatctaataaattattaatagaatttatattaaatgttctttaatttacaagtgaagttaaatgtgggaaataaaacttcctaaatataaagcatggttggatttaatttttattaaattctccatgattaattatactctctgaaattttctcggattttttcagagctcaattcctaaatgatacaaagaacagtacattaattatttaatcattaatgatctaattataatttttaagagcttttcttgtttaaaaatccttaaattataaattgttgttcaaaaggaattattagaaatgatcttaaaagcctaaaagagaagatctaattttaatttgttaaatctcaatataaaattgggctagataaaattttgttaaatacttctcctgattctttagttcctagatttttctgggatttatttaagccaatcaagtatttttaataaatggaattccatttcatgaataatttaaatagaaaaatgtttttaaatccttcttttggctttgggccgaaaggggcccaaaaccttcctctctctctccccggcccagtcggcccaatcagccagcagccgtccgcacgtgcgctccctttcgctgacaggtggggcccacctgtcggacccgtcgtcaacctcgcgccgtcgcccggccgaaccctagccgagccgcgccaccgtctccttccaaatctgtcacgcccggaaattcactagtaatttccgaacttatttgtgcataaaatcctcgtccaggaatcagccgaggtacacaaactgacaatttaatatacagattcatcaaattaactaatacgataaatacttacttaagaggcacttagtcctcaccatgaagaaaactgcagcggaaaataaaatctagcgaagctccggctccactcccacaggcagctcaactggggtataagccaaacgtctactccttctggatcctttttcttcaactgaggttgattgattattgcaagaatgagcatatgacatactcaacaagccacacagcaaatatgcaagtgcacaaggataccaaatgatggcataatataggctcatttgcaaaagcagcatttagcaaagagttaagagtagtaaaacagtagagtaattaatcagaaattttaatcaacactgaacagcacacccatgctgcacaggcccaaccatcctgaacaaccatacccggctgtacagatctaactacaaaccaggagctaaacaaattattaccagttatagcatcaataattattgtgagaggtgtgagactaatcacgaaaaacattgctcaacccacccataaccgcgggcacggctattcgaatagttttactctggccagaggtgtaccactgtacccacaagacacagcctcaacatcatgtctaccatgcgtcgcgatactggaaagtacccgaatagaggctgtgacaataccctccgcacaacacaactcaccacagtgcaccattcctagatcataatcacccccttataaaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattaatcatattttaattaccaattaattatcataacacgattaaccatcgtgagctaccattaaatataaccataaataataatgtagtacatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaagatctgtgtgacttgccttgcaataatcggtcttcaattaatcttcttgattacttccgacgcactcacgaaccttcacaacgacggaaacgacaagctaacacgccaaaacaaggaaaaagactaataaaaaccaaataaacagtacatataaagtaaacaaacatgtagatcatgattttagatgaatttagagacttgaacggcctcattccgatttcatatgaatttattatgaattttacaagattaaatctaattaaagcccatttaaaaagaattaaataaatttaattcaatttatggataattttaatatgtagatatttattttatataatttttgcaacttgaaccacattaaactaagttacaatgaattagttatgaatttttaaagattaaatcggattaaaacacttatatggattttaattgaattatgacgcaataatgaattattttttaaaaggaaaagaggtttattgcgtcagcggctagggtttgcggtgaaccgggtgcacggcgacggctcacggaaacgaacggccgagatcgatccatccaaaacggacggccgagatcgatcggttcacgacgggtctacgggacagcgacgatgacgtcagcaacgacgtcagcaccggcggcggctcggcaacgcatgctcgccggcgaacggcggctcgacgacgcgaacggagggcaccaacgggtagagggcgacgcggcgaactcaccggtgaccaaaacaacggcggaaaagcaacggacggcgccggcgacgaggaagaaacggcgacggtcttcgggtcgacgacgacggcggtgctccggcggtcttcggcggcggcgaagcggtggacggggacggcgacgacctcgcgaacccgatggtggcgacggcgaccgacgacggctgctgcaacggcagcgcggcgcggctgaaccgatggcaacaacggcgacggctagggctacgcggaggcggcgctagacgcgacggcgggctaaggcaaaggtggcagcagatagaggagagctcgggggtccttttaaaggggcaaggaggcggcggcgaaggcccacggcgaccggcgacgcgaaggaaaggttagggttagaggagagagatgaatccgaatccaactcaaatccaccggtttccaaagaaaattagccgatgtttccaaaagagaaaaagaagaggagatctcaaggatcatttgccctcaatcaatttgaccggaaatagagaggggcgacggaatttggaagggcagcggcggcggctcgggcgcggctcggctagggttcggccgggcgacggcgcgaggttgacgacgggtccgacaggtgggccccacctgtcagcggcaccgagagagagaaggaagcgacggcgggtcgggccgactgggccggggagggagagagaaagagagaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaagcttttaagatcatttctaattattccttttaaacaacaatttataatttaaggattttttaaacaaggaaaagctcttaacaattataattagatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagatcatttaatataaattctattattaatttattaaataggttataaatcctgaaacaaaaatcaggatgtgacaaaatccggctgccccattccttctccggccaaatcatttgatgggaaataatctcctcgatctcctcttccttttctattttaaaaacttcggctaatttcgtttggaaaccgacggatttgagctcgattcggatcgacttttctccctccaaccctagctttccatctcgccgccgatcgccgtgggcctccatcgccgctcgctagcccctttataagcatccccgggacctcctcttttcgccgccaccttcgccctagcttgccgccttctctagcgccgcctctgcgttgctctctgcgtcgccgccgccggcgggtgtctagtcggtcgccgtcgtcgcttcggtcatcgccgtctatcgccgtctccttcatcagcatcatgaggtcgtcgccgtttccgtccaccgcttcgccgccgccgaagaccgtcggagcgccgccgactccgtcgccccgaagctctccaccgtcgccgtcggtccagccgcgccgtgccgctgttgcagccgtcgtcttcggtcaccgtcgccaccatcaggatcgcgaggaggagcagcatctcgtccacctctccgttgccgacgtttctcaccgaagcaccgccgtcaccgccgacccgaaggccgccgccgctcagcctcgccgccgtcgtcatccgtcatcgtccgccgccatccaagccactggtgagttcgccgagtcgagctctacccgctggtaccctccgtttgcgccgtctcgccgccgttcgccgtcgagcacgtgctcccgagtcgccgccggtgatgacgtcaccgctgacgtcatcgtcgccatgtcccgtgaaccgcggtagatcaagttgatctcggccgtttgttttggatagggtagatctcggctgtccgttccgtagaccgccgctgtgcacccggtccaccgtgagccaagcccgctgacgcaataatcctcttttccttttcaaaaataattctttattgcgtcataattcaattaaaatccatataaatgttttaatccggtttaatctttaaaaattcataactaattcatcttagctcgggtttagttggttcaagtctctaaagttgtataaaatgatctacatattaaaattatccataaatagaattaaatttattcaattctttttaaatgggctttaattagattaaatcttgtaaaattcatatttaattcatatgaagtcagaatgaggccgttcaagtctcataatacatctaaaattatgatctacatgtttgtttactttatatttattgtttatttggagtttcttagtgttttccttgttttgcatgttagcttgtcgtttccgtcgtttcgaaggtttgtgagagcgccggtagtgttcaagaagattaattgaagaccgattattgcaaggcaagtcacacagatcccaaacacaattcctttgagcatgttgatcctatatttaaattctctatttatttcaactgtgcatttattttcgaatatcaccgggtggtgtgaacttattccgttgttaaggccagtttgcattgattactttattccttgataccttgggtttttataatttgactagttgagctttatatattggttcagctagatgttagacataattgcttagccatgcttagaaacattagcacacaattgggataactaatgcttcactattatttaattatggcttaatgatagcacacgatggtcaatcgtgattggttgattaattaatgtgtcaactaaaacttgataatggtgggttatgagcacatggttttgatggtagtgctcatgacaattaaggaccggttcacgagtttcggttgtgaaacattaaccgtgcccaccacaagctagaatgggcaacggctggacactttgtataacaaggctcactgcggagcaccagactgagaagtggcggagataagcccacgggggtcactggggagtccattcctctggtttttgagggggtgactacgatccaggaacggtgcactgctttgggttgagttatgcgaggggtcttgtcacaatcactcaacatggtgacatgtctggcctggcacggtaacatgctggtgggttgtgtcttgtgggtatagtggtacacctctggccagagtaaaactattcgaatagccgtgcccgcggttatgggcgggtcgaacaatgtctttcgtgattagtcccacactattcattaataataatgtggtaattgatgctaattaatttagctcctggtttggaatggtatattcctggtttggagatagatctgtgcagccgggtatggttgttcaggatggttgggcctgtgcagcatgggtgtgctgttcagtgttgattaatattgatgattaattactctattgttttacaattcttactgtttgctaaatgcttcttttgcaaatgagccctatattatgccattctttggtatccttgtgcacttgcatatttgttgtgtggcttgctaagtatgtcatatgctcaccttgcaataatcaatcaaacctcagttgaagacaagttgcgaaggagaagacgtttggcttataccccagttgagctgtctgtgggagtggagccggagcttcgctagaccgtaattccgctacagttttcttttcttttgtaagtatgtaacgttattatattgatgaatatgtatattaaattgtcagtttgtgtacctcggctgattcctggacgaggatttaatgcacaaattagttcggaaattactagtgaatttccgggcgtgacagggctcaagggcgacggcgacgcgatggagtgcggcgcggcgataggacggcgcgcggcgcggctgtggagtcgacgggacggcgatggcgacggcacgcggcgcgctgatgatgacgacgtgacgcgcggaggggtggggctcgaggcggcggcggcacgcgcggcgcggcagcgggatggcgacggcgacggcgcggcagcggcggtgcgcggctcggagcgacgatgggacgcgtcggtgacggtgcgtggcggcacgggacatgagacgggacgcgtcggcgacggcgcgtggcgacgcgcgataggcggcagcggcgacgcaacggaatgcggcgcggcgcggggcgtgaggcgatgggacggcggcgcggcgacgcgacggcgacagtggcgcggcagcggcgatgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgggaaacaggggaagactagggcgacgaccacaggcgcttgacgggaggcacgagctagacaccaa

SEQ ID NO: 10596 - DNA, 6148 bp, Oryza sativa
tgtgtcttgttgagtacggtggttgaatcagtcctgcttattttcccaagcccagatggaagttccttaaagatgaaggctttgtgtctagctcgtgccagccgtcaagcgcctgtggtcgtcgccctagtcttccactgtttttcgaagtctctgagtgtgctgggccttcgtcgcccatgtaataattttatttacgcttccgcttgttaaactctgaattgtatcaacttttggtgtaccttgcctcctgggacaaggaataatacacgcacgtcaggaacgcctgttgggtgatttccggtcgtgacactcatgaaggcaactaccctacccatgatttggagttagtcgcggtggttcatgctctaaaaatctggcggcactatctcattgggaatcgctgtgaaaaatatactgatcataagagtttgaaatacatcttcatccagtcggatctgaatcttcggcagagaagatggttagagctcatcaaggattatgatgtgggaatccactatcatcccggtaaggccaacgtggtcgccgacgctctaagtcgaaaaagccattgcaacactcttaacgtccgtggcattccatccgaacttaatcaacagatggaagccctgaacctaagcatagttggtcgcggattcttggctgcgttggaagccaagcctaccttgctcgatcaaatccgcgaggctcagaagaatgatccggacatgcgtggactcctcaagaatatgaaacagggtaaagccgctggtttcacagaggatgaacacggcaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcaaagcaccaacgaccagccggacttctccaacctcttcaagtaccagaatggaaatgggatgaaattgggatggatttcatcaccggacttccaaaaacccaaggtggatatgattctatatgggtagttgtggaccgattaaccaaggtagctcggtttattcctgtgaagaccacctatggagggaacaaactagccgagctctagttcgctaggatcgtgagtctccatggcgttcctaagaaaattgtatccgataggggaagccaattcacctctcacttttggaagaagctccaagaagagctgggtacccgattaaatttcagcaccgcgtatcacccgcagacagatggacagatgtcacatcctgattttcgtttcaggatttataagttatttaataaattattattagaatttatattaaatgttcattaatttacaagtgaagttaaatgtgggaaataaaattttctaaatataaagcatggatggatttaatttgtattaaattctccatagttaattatactctctggaattttctcggatttttcggagctcaattgttaattttaaatcatacaaagaaaagttcagcaattatttaaatattaaattaatcattaaatgacctaattataattgttaagagtttttcttgtttaaaatccttaaattataaattgttgtttaaaaggaattattagaaatgattttaaaagtttaaaagagaagatcttttcttttaatttgctaaatctcaatataaaattgggttagataaaattttattaaatactttacttgttcctctattttctagaatttgctgggaattatttgagcaagggaagtatttttaataaatgaaacatcatttcacgaattattttaattgaaaaagttttaaaaaccttcctttaagtcgttgggccgaattcggcccaactcttcttttcctcgcgcggacgaaccggcccaagccggcccagccgacgccgccctcccctcctcctcgggtcaccgacatgtgggacccacatgtcgggcctttcttcctcctccagccgccggccaggccgagcccgagtcagccgaccgagcccttttccgcctccgattccgccccgatccctcatctccgagtccgattgttatgggggttttgatcctctcgttctcctctatctttcccttcaagaatcgaagcaaatggttgagtatcttgcccgaatcaaactcgttttcgagtttatctccaaaaccgagttttgattttcttggatcgattcctctcgtttggagctcaaactcttcaatccaatgctataaatagcttcacctcgtcgctctctttcgtttgccctctctctcgtggtctcccgtgcctcttagctgccgcgccgcgtcgccctagccgccgccgtcgccggtcgtcgtccagccgctccgcgccgccgtttgcgccgtcgccgccgcttgccgccgtcgcctttaggtgcgctagggtgaagggaaccttggccgcccgtcccccttcgccgccgaccaccggagctcgccgccgacgtccaacccgagctgccgccatcgtccttctcgtcgccggccgtcatccgtcgtcgttcgtcgcgttggagagtaccgttgggttcgcctcgtcatcctctacgcgtaggtgccctccttttccccggccaaggcccctagctccggcgaggtggtcgccttagccggccggccatggatgacgtcatgctgacgtcatcatcctcttttcctttctttttcccttcttcttttaatagtttaaatctttggaaaatcatatctaaataaccgtagatccgttttaggtggttcaagttgctaaatttttctaaaataaagatctacatattaaaattgtccataaattgaattaaatttatttaattctttttaaatgggctttaattagatttaattttgtaaaattcataataaattcgtttgaagtcagattgaggccgttcaagtctcataattcatctaaaattatgatctacatgtttgtttactttttatgtactgttcatttggtttttattagtctttttcttccttttgcgtgttagcttgtcgtttccgtcgttgcaaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggccaatttgcattgaatgccttattccttgatgccttgggtaataaattgattagcttgaaccttatgtattggtttggttcagctaaatgtcatatatatatatataattgcttagcaatgcttagaaacattagctcattaatgggatgaattatatacactacattattattatggttatatttaatggtagttcacgatggttaatcgtgtgatgttaatgaattgataattaaaacctggttaaggtgggttgtgagcatatggttttgatggttgtgctcatgacaattaaggaccggttcgcgagctactgttgtgaaacattaaccgtgccaaccacaagccagcgtgggcaacggctttatctcttgtatagcatgattcattatagtgtgccagactgtgaagtggcgagaagtccatgggggtcgctggggagtccatgcctctggttgtagagggggtgattatgatccaggaatggtgcattgtggtgagttgtgttatgcaggggataatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataatcattgatgattaactggtaataatttgcttagctcctggtttggagttagatatgttcagccgggtatggttgttcaggaaggttgggcctgtgcagcatgggtgtgctgttcagtgttgattaaaatttctgattatttactctgctgttttactcctcttaaatgttttgctaaatgctgctttttgcaaatgagcctatattataccatcttttggaatctttgtgcacttgcatatttgctgtgtggcttgttgagtatgtcatatgctcattcttgcaataatcaatcaacttcagttgaagaaaaagaatccaggaggagaagacgtttggcttacaccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattaatagtgaatttccgggcgtgacaacagaccgagcgtctaaatcagatcctagaagatatgcttcgcgcatgtgtcctagatttcgggaagacctgggataagagtctcccctatgccgagttctcctacaataacaactaccaagccagcatacaaatggcaccttatgaagcgttgtatgggcgcaaatgccggacaccgctattgtgggatcaagttggggaaagccaagtgttcgggactgatatactgagagaagctgaagcgaaggtcagaaccatttgggataatctaaaggtggcacagtcccggcagaaaagttatgcagataaccgtcgccgtaacctggaattcgcagtggacgattttgtgtaccttcgggtcacgccattgcgaggtgtacacaggtttcagacgaaaggaaagctcgcacctcggttcgtcggtcctttccgtatcattgctcggcgcggagaagtcgcttaccagttggagctgcccgcctccttgggcaacgtgcatgatgtgttccatgtgtcgcaactcaagaaatgtcttcgagtgctatccgagcaggccgactcagagcaaattgaagttcgcgaagacttgacctacgtggagaggccagtgaaaatcctggacaccatggagcgcaagactaggaaccgggtaatccgtttttgcaaggtccaatggagcaaccacgccgaggaagaagctacctgggagcgtgaagacgagctgaaggcagcccatcccgatcacttcgccagttcttccgaatctcggggtcgagattccgtttaaggggggtaggtttgtcgcgtcccaaaacgactctaaaatacatcctcgaaattatgcctagaataattaaaatccgtgtgaaagcctccaacaattaaaatgtgcaaagttaaaagtcaaaaaaaggcttggaggatttttgtatatttcctaaaagcctaaaatgcataaataaattttagtggaattttcagagcacaaataataattaagaagaaataaacaaagttaaaaaggttttataaaaagaaaaaccctaaaaaaagttccctttccctccccctctccctcttgggccggtccggcccagctccctccccctccctctcctctccccgcggcccatccggcctctccccgcgcgcgcgccgctgacgggcgggcccgcccgccaccctcgctgacgggtggggcccacccgtcatccccttcctcccgccgctcccgccgcctcgcccgtgccctagcgccgccgccgccgcgaatcccgccgcctcccgccgtccacgcgcgcaataaagtggggggaaatattccccgtgattccctccctctttccccccatttttctctccctctctccctcggattcgtttggaaacctctcccctaacctcgccggcgccatcaatggcggccggatcttccgcgcccgttttgtcgcgaccgggaaaattgccttttcccgaacgctagtgtattaatccccgtcccaggaaaagccggggtacaccacacaaa

SEQ ID NO: 10597 - DNA, 8403 bp, Oryza sativa
cttgaggcatcaatgtcctgacttatgaccttattgcctttcttattgtcagccatctgttgcaaagatttggagagggagagagggaaaacaaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgactaacaacactaccctatagggcggcttaggttctgcgacgggttttccaagatcttcactcctgcttcacagctggcttcactacttcctgcacttcgctagcggatcctgcagtcttccggagcttcgggaaacaactgacgacatcttcttcttcgcaaagctgaccatctagtacttagttgaaatccgaagaaagaaaagagtaagccttttgcaaatagcattaggggaaggagaaaaagaggaactttcgcaaataattttacttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctatggctccatcttcacaggcgctcaactggggtataagccaggactccacctaagacttcttctccaaagcttctcttactgaagaggggaaagattgagcaagaatgagtacaaccacagtactcagcaagccacaccggcggatgcatgattaatgcaaggggtgtgcaaggggtaataacatagaggttaagctttgcagtaaacagcatttaaagacatttagttgctcaaagccactttgtaaacgcgatcctagaacgctacaaggttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacaccgggacaggcaggcagaactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcaccccgtgcccagcctaaaaccattttaggggattttgaatagagggggcggtgtgaagccaattccacaataatccaacaattccaaagtgtccaagtgatatgaatatctcccaaagtctatagttgtaaaaccacctaatgttacctaattaaaagcgaagcatctacctaaaatcatactagtgataccacgagtagagtgtccactagttggggttttgtttattctagggtgaacaaggtaataataacaataacaacaatgataaggtcataacaaaggtaaataggcaaggctaaataaaacagtgataacgcgggaatttaaataaagcgataatgcaataatttaaatcaacataattttataaactgggattcaatatgatcaagatgatgtgtcttgccttgctcgctttcccaaacgccggcttcaacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgttctttaaatggatatttgcgaatttcttcatttaaattttaattaaaaatctcatttattgcgtcagccgagggagcggggcgcgcggaccgggtccacgggaagtggggcccacgcgtcagccgctcggtccacggtggaccgggcgcacgcggctggcggcggtcggcgccgtgggtcccgcgcgttagccgcacccgcgggcgcgggcggctgacggccgggcccacttggcagccgcgagggcacgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggtcggagcggaggaagacggcggcgcggctcgggatgacgatggcgacggcgctccgacggtcggcgggcgaagcggagcggcggacggggtcggcaaccactcggcgaagccgatggaggtggcgccgagtcgggaggaggtccggagcggtgcgcccggcggaacggagttcggcggcacggcggagagagaggagcacggcgcgagcacgaatccgacggcgagagcaagcggcgaacggcggaaatggaggagggaggcacggggagcaaatatatagcgccgagagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgtggggagtaattcccccctcattaaggcgcgcggggaaggcgggatgcggcggaatccgcggcggcggcggcgctagggcacgggcgggcggcgggcgcggcgcgaggagggagatgacaggtgggccccacccgtcagcgagagtggcgggcgggcccgcctgtcagcggcgcgcgcgcgcggggggagccgatgggccgcgggagaggagagagagagggagagggagaagtgggccgagccggcccaagaaggaaggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggccatatttgaatttttcttgtacgtattttaatgtttgccaatttcttttcgaattttaattaattctattattccttttagagaatgatttttatttcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatgaaatcttctcttcacccgacttgtccctggttgcacctttaactgactcagactaggctgcggtggttgaggatggggcttcagttctagaacttcttatcattcatatctttggcgtcaacctcatacaagttaccaccttcgtgacatgcgtcaacactagcttgtcattactaggataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccacttgatatactttgacgtcttcccgaatgactttgctgctggacttgttattgtctgatcgtggtcctgccagacctgaagcttcgttgttggaggtgattttaatctgacctctgtagactatcttcgatcatatcacttggttcataactgggaatagctcccacgaacaagcaacgcagatttactttctttatgttcagtttactttccgctattctcttcatgttgtcatcatttagcattcaacgtattcctgtgcaccttccgccttgatgtgttctttcccattagatcatctcccaagacatggcgtcgcctggtaaccggggcttgcacttttcactccgtgtagcatctgataccgagttgaagatttcactccttgccttcatagaaacacttttacctaggtcatcttgcttacttaatgacaaggtgacttgttgtgggggggcaattactatcaggggtcttctttgagcgatgcagagcatgtttatgtttatcaatcacctttcggcctacttctttcatgctagagaacatctttgccaatctcttttatcaatcatctttcggcttatctctaacagggagtattctttaatgtggattgcggacgcttctggggatgatgaggtcctttggcttgctgcctttcggtgaaaccttgatgtggttcgtcaaaaagctgcactgactaccttcagggaaatacattgcttgctatctgtatctatgccactaaggtttaattgccgatggtcatctttagtgctccctcgagatggggagcatccatattgtccttctgccctatcacctttgacccttttctgatacctgatagactaattaccaaccatcgactatcatgttctcaaatattgatgtctcctggatcttcttaactgtttgcaggtatatccgaacttatcaatgtagaggcatggcgggtacccttatgggtttcatccaacaatccttatcttgatttgtaaaagcgtatccaaactcttatccccaactactgtctcattagctttttaacccaacacagtttaattggttttcttttccatcaacaggttggttattaactcgaggttagaatatagttcctctgacacgagaccctaggtctccttcgtcagtaaacaattatacacatgatcacatatccgcatcttccaaacgaatcctcttagaacttgtttttattacaaatttctcccatattacatgaatacaaggcactgccttaaacaaaaagggaaggtgcttaacatcggtacattgcatcctcaacatgaatcttccataatcataacaaactcattgtttataatcatgaatatatttatttattacatgactgctgcaaactcccgattacagtgataagtagcgaactgaaaatcacaaacatggatacctagctggcattgttctagtgactgcatccttgatcggttctgtgatgatgtgataggactgcatattgctatcattcacaggagaagtttccttctgattgctggttgaggcgaataacggtcttctgcttggtatcgccctccggaggtcgattgccctttgcttggcctggagtaggtcggggagagacacaacttcttccatcgacgacaattctttgctggggctgaaagtgagcattgacaccttgtggtaatgcactcgctggagttggagctgttgcaacgcgggccataggactgctttgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaaccgtaatcttggcgaggattggtgttgccttgatgcttctctccgttggaactggcgggttggttagccatcttcttcgtcagcagaaaactgaattgacaatcttttggtacatgatcagtcccttcacaaaagaaacaagtgatcctgctcgttggacacctgtcgggtggatggtcttcctcgcaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattccgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgttggcggcatgctgacttgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaggtcttttgctgttatgatgtatgttaggcttattctgcaagttgattaagcaaacaacctagcatggttacatcacaccccactgatgcaaaccacgcgctacacacacaagcaaggaaacacacgactaatgactctaccctagagggtggcttaggtcctgtgacgggttctcaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccaaacaaacatgatacaaaaggcacatctttattatatcgataatatttacattattacaaaggcgcttcaggcctgacaatcaaaaataaacagcagcgaactagcgggcctacggctccatcttcacaggcgctcaactggggtataagccaggactccacctaagacatcttctccacagcttctcttactgaagaggggaaagattgagcaagaatgagtacaaccacagtactcagcgagccacaccggagatgcataattaatgcaaggggggtacaaggggataataatataggggttaagttttgcagaaagcagcatttaaaagtcacttagttgcccaaagccattttataaagacgatcctagagctacacaaaattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaaatttaaagaataaaacactgacttgggtacattgctcggcttgcccataaccgaaggcgcggctattcgaatagattatactctgatcagaggtgtacatctttacccacaagacacatcttcctcacgtgtaaccacgtgccacataccaccacggtatacggacggaagacgtgacatagtt

SEQ ID NO: 10598 - DNA, 972 bp, Oryza sativa
tccccctcgtccggccgttctctccccctcccaaccctatataaaccctccccgtgcctccctccaccgtttccgccactcgccgccctctcttcccgtcggaatcgagctcgcgccgtcgctctctctctccgccgtcgccgccgagctccggtccaccgccgtcgtcgccccggaccaccttcccccacggcgtcgcctccttcggcttcgccgcatcctcgccgacctcgtccacctctccgtttcggtcgccgaccgccggagcaccgtcaaccccgtccacccgagccgcgccgccgccttcctccgctccggtcgccgtttccgtcgtcgccgtcgacccggggtgagccgtggaccgccgcttcgtttccccctttccctcccctctctcgggcgccgctccgacgtgcctatggccgccgctggcgaccataggggcgcgggcgcgccgcctcccgccggccgcgccgccgtggccgccttcgggcgcaccgagcggctgccgcgtggggcccggctgtcagccgctgtcacgcccagaaattcccgaataggattccaagcagaatgtgcattaaaacccccgtccaggaccggcgggggtacacaaacggctatgttgacattcagatccacgtcttacaaacatcataaagtcttacagaaatgcaccggaaaccaaaaaaaactggagcttaaccttgacttgaattgcagcgggaacacccctccacaggcatccttgatggcacgaagcaagcctactctcggagaacccgccatcggacacatactcaagctcttggatcggggggaaataaaaccaggcttaggactaccccctggactcagcaagtcataccggaataggggtatgatgcagggagttatcaaagaagagctaaagtggttcatttgcataaagcgagcatttataaacagagattgaaagattaaatgatgaag

SEQ ID NO: 10599 - DNA, 1552 bp, Oryza sativa
tgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatataaatattatcgaaataataaagatgtgtcttttatatcatgtttgtgtggtgtaccccggcttttcctgggacggggattaatacactcgcgttcgggaaaaggcaattttcccggtcgcgacagcagcatcagctcaagatcgcccagggagaggtctgtcgccccaagcgccgccgcgtctgccgcagccagaagatcaccgcccgcaagagtacctccaggcccgagcttgttcgccagtccttggcatggacctgcttcgtggagaccccttgtgccgagcccgcgcccgtggttcctcaggagggggaagcctccggcgttggtagcacggaggatgcgctgctgctcaccttccgtcctggcccatcgcagcggtagacgagcagttagtaggcttgcgcgtgtgttctttcttgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtgggtggctagctttaattgtcagctctctctgtttgctggttctgtgtggggttttcagatggtgacgaccaggaaaagtgctgctaccggtgaaggcagccaacccgaaggcagcaaccacaacaaccagggcagcccacctccacctccttcttcgcctccaccaccaccaccagacaccaacgccattctcacccaaatcctcgcccagcaggccaacatgatggctgctttcctccaccacatccaaaatccgccacaacataatgctccaccaccacccccacaacactctaaactcgccgagttcctccgcatccgtccaccaaaattctctaactccaataaccctgtggatgcgttggattggttgcatgccgtggggaaaaagttagacaccgtgcagtgcagcgatgaggagaaagtcgtctttgccgcccaccagctgcaggggcccgcatctctatggtgggaccatttccaggctacgcagccagaggggcagcctattacttgggcccgcttcaccgccgctttccggaggacccatgtgcccgccggagtcatggcccttaagaaaagggaattccgagagttgaagcaaggcaaccgctccgtgatggagtatttgcatgagttcaacaacctggcccggtacgccccggaggatgtacgggaagatgaggaaaagcacgagaagttcttggctggaatggatcctcagctgttcgtccgtctagtcttcggtgactattccgatttccaacgtctggtggacaagagc

SEQ ID NO: 10600 - DNA, 1325 bp, Oryza sativa
gcacaaggccttggggtcgcccaagccccgcttggcgaatttccacattcaccgggaggctaaccaaaggatccgctacccgaatccctttccagaaggatcgtcctcgcagcagcaacagcagcagcaacctcgctccgcgccccgacttcatttcgtggtgcgcgtcccgcagccgcagcacaagcagagccagcaagggacccgtgcgccccgtcctcttacgccagccgcgcagtctggtcaaggccgcagggacgttcaaggtccgcagcgtttgtgcttcacctgcttcgagcctgggcactttgcggataaatgcccaaagcagaggcgccagcaaggccaagcgcctccccgctccaacaatggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctcctcatcaccacccctggaggggttatgacagcaaagtattatagccctgctgttcctatagaaattcagggaattccttttccctcggatctgtgtcacgcccggaatttctatccaaaattccaaacgcttacatgtgtgttaaaccctcgtccaggaatcaaccgaggcacacaatgacaatattgataatagagtacaaataattattaaatattcgcaaaataaaattattacagaggtagatagttcctctcaaacaaaaacaacattctacgcagcggaaaacaaaactaaaacaaactacggaacagcgacggcaactccactccacaggcaacttaaccagaacaagcctattcctccagatcatcaccttcactgaagtactcctcctctgatgaatgaatattgcaagaatgagcatatgacatactcaacaagccacacagcaaatatgcaagtgcacaggatagcaaaggatggcataatatagctcatttgcagaaaacagcatttaacaaatatttaagagagaagtaaaacagttgaataattaatcaatattaaataaacaccatacaacacacccgtgttgcataggcccaaccacatttgatcaaccaaccccagttgaacaaattaaccctccataccaggaattaaccattccaaaccaggaaataaattaattactacattattaccattaatgagaagtgtgagactaatcacgaaaaacattgctcaa

SEQ ID NO: 10601 - DNA, 481 bp, Oryza sativa
gaaagaggaagagaggtgtgtgtccaattccaacataagccaaccattccatagtgtccaaatgacatgagaattcccaaagtctaaagttgtgaaacctcctaatgttacctaattaaattgcgaagcatctacctagaattaaactagcggtgtcatgagaagagtgttcactcgttggggctttgtttgatctagggtgaacaaggtaataataataacaataacaataataatatggtcataaccaaaggtaaataggcatggctaaataaaacaatgataacgcgggaatttaaataaagcgataatgcaataatttaaatcaacataattttataaactgggattcaatatgatcaagatgatgtgtcttgccttgctcgatttgccaatcgacggcttcgacttacacgaacagcggatcttaccaagctgctgtgtttacacgaccaacggaaaaagaacaggctttaacact

SEQ ID NO: 10602 - DNA, 1300 bp, Oryza sativa
ggtggtagtggtgcagcaagccgacgagccggggaggaggaaggggcggccgaaagaacgccggcgacgaagaggatggagaggccggcgcggcgacggcgttccggcgaaaccgaggagcagccggggtggaggacgatgctgcgacgtcaacggaggagacggcgacgtcggtcggcgcacgggaaacgcgacagtggcggccggaggtggaacagtggcggcaacgccactgttttgccggcgaggacgcgtctccggtgcttcccccgcgaaacggagggctgaccgagggggaggaggtggctgcgaggccgagggagaagacggcgcggccggacggcgctcgggcgaggagggggaggcggctggaggcggccggcgcggaggaaagagaggggcgacggcgggaatgtcacgaccggaaataacccaacgggctttcctgacgtgcgtgcattaatccttgtcccaggaggcaaggtacaccaaaagttgatacaaatcagagtttaacaagcggaagcgtatataaaattattacatgggcaacgaaggcccagcacactcagagacaacgaaaaacagcggaagactagggcgacgaccacaggcgcttgacggcaggcacgagctagacaccaaagccttcatcttcaaggaactccccatctgggcttgggaaaattaagcaagactgagtacaaccaccgtactcaacaagacacacccacgaatgcagaataaatgcaagggagtacaagggaattataacataaggggttagagttgcagtaaacagcatttaaagacttttagttgcccaaagctattttgtaaacacgatcttagaactacacaatattattaatcaaggccgtgaacccacacgaacctgccttaacccaaggcctacgatgattcggaccgaactggcaacccgaccctgggttccagctcgtcccaagccaacccaggccaaccattccatattttagttgttgagcaaattttaagaattataacactgacttgggtacattgctaggcttgcccatatccgagggctcggctattcgaatagatttactctgatcagaaggtgtacatcttttacccacaagacacatcttcctcacgtgtaaccacgtgccacataccaccacggtatacggacggaagacgtgacataatttccaacccatcctagacttagacaagagtaccgacccaatttcgcctacggccggaaccccctgtacatgcagaccgaactgggcccctcgcagcaaggcaccaa

SEQ ID NO: 10603 - DNA, 585 bp, Oryza sativa
gccctctctccccgccggaatcgagctcgcgccgtcgctctctctctccgccgttgccgccgagctccggtccgccgccgtcgtcgccccggaccaccttccccctcggcgtcgcctccttcggcttcgccgcatcctcgccgacctcgtccacctctccgtttcggtcgccgaccgccggagcaccgtcgaccccgtccacccgagccgcaccgccgccttcctccgctccggtcgccgtttccgtcgtcgccgtcgacccggggtgagccgtggaccgccgcttcgtttccccctttccctcccctctctcgggcgccgctccgccgtgcctatggccgccgccggcgaccataggggcacgggcgcgccgcctcccgccggccgagcggctgccgcgtggggcccggctgtcagccgcccgcgcccttaggtgcggctgacgcgtgggacccacagcgccggtcggtgtgagcccgggtgcgcccggtccaccgtggaccgtggggctgccgcgtgggccccacccccgtggacccggtccgcgcgcccctcccctcggctgacgcaataaatccatttttt

SEQ ID NO: 10604 - DNA, 5117 bp, Oryza sativa
catttgaatttttcttgtacgtattttaaggtttgccaatttcttttcgaattttaattaattctattattccttttagaagatgatttttattttgggatgaatttatcaggacgtgacaacttggaccattgttattaaggaacatagcttggacaagtggtgtagcgacattggcgacttcatctcttgctccttcaagcctcttaatcttaccaaccaggacgtcaaactgagcttgagatttgactttacggtctacaaaacacatttatgataagaatctgctgcatttaaaagagaggagaccagattgttagctgatagtaccttcaacctctttcaaggccgagtccctttgcgcagctagttctactttgtctcttttcagggcttcaatctgtttctccatttgagccatcctggtagcttgcgctgtttgaaatccaaatgtttgaggatacagctatgacagcataaattaatgggacagatctagaagattaccttttgatgaaccacttagctcgaagtttgaatcctggagctgggcaattcggtcccttaactccttctctgtctttttggcgtactccttggcctcatgcagctggtccctaactgcttcaagagttcccaaatgaggaaccagcctttccaaagttgtagtcttggcctcattgcgaagatggattctctgcatgatggatcatggttcagttctgctaaagagagaacaaagttattaaaggcagtcacccggaagatttacattcacaatgcgagtggcttctccaagtgctttcttcagctggcacacttcctcatcttctttttgacgatttatgacgatgccggcaacttgcgagttctcgtcccaccatttgagcaagataggaggacgggagtcatcagccgcctttatgcgaggaattgcttcttcgtcatcgcctagtgttcctgatgtatttccaaaacattagacgagtaagctgaagttatttaaatcggcatcacttgagaagatgtgttacctgaggatgttcctggctgaacatgaggtgatccttgttctttatttagagacccaatcattgagtctttaccagcctctggtccttgggaaagtttgtcgtttcctttgggcccggggccccccttcaacttcagggatttcttcatcgggacctacattcgactggtttccagtcgggggctcttgtgttgttgcagtttcagctgttgccgactggtctccagttggcggccggtcactcggattggccttatcacccaaagcatgggcgccggttggctggctttcggcagtcggctggctttcggcagttggctcaggatccttggataaatttggttctgtcacagtcggatcagaatctttcccagtgggatctatgtcggatggtttcctgcaaagtgttctttcgatattcagtataatttctatgagagaagcatgtcgaagggaaatggtaccgagaggtttatacctagaaaatgttctaatctttggcatttgacggccagccagttttttcttgggcatggtacgctttgggagtttattaggcgagcccttgtccccagatttatcgtcgtcgccttcatcgttgtcgagcaccagttttctcttgcgagaacctgtctgtccagttggattggaggtttgaggttgcggatctggtctgatttttggccctccacctccctgaacggtgtgctgacgaggcgaccggcgctgagtgattgggggatcagatttcatcaacgcatattcctaaatgagatgcttccacggttaattaattcaacatgaagacaagataatgttttagtcatagattgaagatttcagatgcatacctgcggaggcggattgaatgcattatatggcacaactggcagctgatgcgagtagctgacgacaatagcatttgagaaaattttatacattctctccttcatgattttaaagtccagagagtctggttcttcacgattgggatcatgcttgccgtcgaactcgaacgctgtacgggatctttctttaattggtgccagtcggcatttgatgaaatgccgagtaatctgctctccttgcaagccttgttctttgagttttagcatgcggtccatcaattccaaggcttgagcagctttatctccgataggaagagagttccaagtatcttggtacaccggaggaagacaagagtactcgggaagagcaggctcaggattctgaacataaaaccagttcgcatgccaccctttgtttgaggtcttgaagggcatagagaaatacttctggctcagagttcccctcaactgaaatcctgcccctccgactacacatggcttattcttgttcggttggggcttgagaaaaaagattcggcggaacagagcgaaatggggtttaattcccaagaaggcttcacaaacatggacgaaattggcgatatggactatggaatttgggtttaggtgatgcaaactgattccatagaaacttaatatcccgcggaaaaatttcgaggtcggaagagcgaagccgccatagaagaaatgagagaagaccacaatctcgtgtgtatcgggggtcggaaaaatctcaccgcacgctggccgccacccgatgatctccttggcagggagaacgccgtgcgccaccatctccttcaggttctcttctgttacgtcggacggcgcccactggccttcaaagctttctttctcttccgccatcgattttccccgaatgtactgatttgattcgagggatggcttgggagaggtgaggaattgaggcggtggatcacggggaggattttgatcactttttgaaggtggatttgagtggaatggtgaaccctaatttgccggcgcagttctttactgtagcagggagtggggaaaatggcgagagttccggcggggaagacgaagtgacgcttggatctcggaatttcttgttaagggtatcgaaggtgcaaatgggcctaggcctgaacagtacctcagcccaatacttttaacagcgtggcccattgtgttccttagggacttgggcattttttgctttggcaatttatgcgcacaatagtgttgcccaatgctgacaaaatcctttttatgcggtcatataattctttggaattattgcaatgcaaattaaaaggtgcccgacagaaaggtgttatactgctttttgtcagcttttttaggcgacaaaagctgtctgggttaacttggagtggcttgtttttaccatagtcatttccctggtatgttatatgcctgtttttattatggtaaatagtcatagcctaggctattagacttatttattaccataatttttataatacttggtgggtaatctttagagtttttattcggatgactgtcaagtgtgttcattcgtgaaccttttagagtgtaaaccactcggattccttttattatggctaaaaagcagtcggctaggatgcctctttaggcgccgcgtatgcttttgtcatatgatgcatgattgtgctattattttgttctcaactatatgtttagtttgttaactaatcacatagttgggggctacacctaattaggtgcatctattcgatgcaccgtattctttattgtttcgccctttacagtcttcgtcttcgctactcggcaggccttggcatgaataatttgaagcactcggattactatctttgagaaggctataatggttgactgcaaaggtctcgggggctactgtggagattatggatatcccatatctacacggcgatgatatttgggttgaatataggataccgaatatagatagaatatcttgtgtgtatctcgggtttgtttcttaacttgtacgtaaaggaaataccttgagatctagtcggtcacgactgtattttatctgtatctgcctattccgttagggatatagattatcttttgtaacacggactccttcccatatataaggggggtccgggtgcctctagcggcggatgttgattttctccaaatcatacaatcaataacacactcggcggattcatccccggacaggagtagggtattacttcttttataagaaggcctgaacctgtataaatcctttgtctccaaacccatacacttttccagcttgatagccacccccttttattattgccgaaatctagtttcgacacttttggtacatatataggagtatcggctttgtttgggttgctctacaaatgtgctgaggctatagcttgtggttcctgcaggatcgctaattacctaagttaatcagtatgatggccgccgacgggcgacggcagcgctgtccaggagcaccggatacaggtatcggagtcgggacaagctgatcataaggcggtcgccgcggcaccggagaagtggctgaactacttcgtccgcttgctcgcggtgatcgaaagcgtgggcaacgccttcggcacggtggccttcacctgggccaccgtcgtcctgctgggtggctatccgtccgttctcaagagcgattttcgttatgcgactgcgatatttttcctagaagccacgaggtatgtatacatgcaaagtctcctggtcttgcaatgtttggctgacaagaatttggatagatggaattccatttctataatacattgataatcttctgcaattagcgttttttttcctgtttggatgccacctgactttgcaagcttgcactagatagagaagcactccaacctagcaatcatatcaacggcctcatcgtttcgcttattcggtaaataagtcaaacaacatatttacaaatgaaaaataatttgtgaataaaatttttatatacatgttcttaacgatctaaaagactaaaaaataaactttgatgaaaaaccccaaaatcaactttaaatttaagattaaatatttaaatttcggctgataagcatgagcgtaagcgaaaagataaggctgcaaagctgttcaataaggtagtgtttggttgctgggataggatgggatgggatgggatgacccatttttaggggtgtttggttcaaggttgagtgggatgggtt

SEQ ID NO: 10605 - DNA, 2681 bp, Oryza sativa
tcatcccaatcttaaaatcagggatggtttcatcccatcccacctagtcccagaaccaaacacacgctaagatttcaagcgtttcaaacttgtagtgtgaaactaacttttgataatcaaataattggctcctatgcgcctttttgtttttatggtatggtaccttctactaccatgtgtagtagtgtagtaaattttaaatctaactatatattttcataagtatataaaatattttatttgaagctttagtaaaatatatttaccaattcatctattttaatatggtatatgatacacgaatttattgtaatgttatatatattatttctaattttacccctatataatttctactacactactaccgggtgtagtacaataaaatcaaatccattgaatctgaagcgattaaaggctcataatcatttgagggtaccttaaaattccgtctttaaggccctcattagatcccacctcaaaattttacactctgccacatcgaatgtttgaacacctgcatgaagtattaaatataggctaaaaataactaattgcacagattgcgactaatttgcgagacgactcttttaagcctaattgctccatgatttgacaatgtgatgctacagtaaacatttgctaatgacggatataatatctgatgtgacacgcccaaactttacaatatctaaacaccccctcaattcccttctgtttaatgattaaacaatatgactactttcaggatattcacccgcaacaataggctggattatcaactgttcttccggacgagaggtgcctttagacgactgggctggaacgggctgatggtaatcgtgtgcttctccatttctgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcacatattgtcgcgaccgggaaaattgccttttcccgaacgctaatgtattaatccccgtcccaggaaaagccggggtacaccatacaaacatgatataaaagacacatcttcattatatcgataatattacattattacaaaggcgcttcaggcctgacaaacaaaaataaacagcagcggactagcgggcctacggctccatcttcacaggcgctcaactggggtataagccaggactccacctaagacttcttttccaaagcttctcttactgaaggggggagaaagatagagcaagaatgagtacaaccacagtactcagcaagccacaccggagatgcacaattaatgcaaggggatacaagggggataataacataaaggttaagttttggcagtaacagcatttaaaaagtaacttaagttgccaaaggccattttttaaagacgaatcctaaagctcacagtattatttatcaaagccgtgaaaccctcacgaacctgccttaccccaagcctacgatgattcagaccgaactggcaacccgaccctggggttccagctcgttccaagccaaaccaggccgaccattccatattttagttgttgagcaaattttaagaattataacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcctgcctacgggcggaacccccgggacaggcaggcaagactgagcccctagcagcagggcaccaaccctctgccaatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatatccaattccaccataaaccaacaattccatagtgtccaaatgatatgagaatttcccaaagtctatagttataaaaccacctaatgttgcctaattaatcagcgaagcatctacctaaattcatactagtggaaccacgaatagagtgtccactagatggggttttgtttaatctagggtgaacaaggtattaatatcaataacaataataataaggtcataacaaaggtaaataggcatggctaaataaaacagtgataacgcgggaatttaaataaagcgataatgcattaatttaaatcaaaataattttataaactgggattcaatatgctcaaggatgatgtgactt

SEQ ID NO: 10606 - DNA, 1938 bp, Oryza sativa
acggcgcggccggccggtgcgcgggcgagacggcacagtcggctggaggccggccggcaacgtgggagagagagggcgacggtgggtaggtggctagagaccacgggagaccgcgggagggggctaaagcgatagaacggagcgagggggttgcattttatagcggagggaagcgagccgagcacgggagagggcggaacggcgacgggaatggtggccggcggcaaaggaaggcggccggacttggcgcggccgttcccggcgattgggggcaccattcaaggggaaattaagggggaaagagagaggagggaaaggggattattcccctcaatcaatttgggaatcccatgcttgaatcgcgcggatttgagggaggaatggcgctagggttcacgggagagggagagaggacagctgggcgggaggaggaccatgactcgcctgacgcgtgggccccacgcggtcaggcgggggctcgggcaggggggggggctcggctgggccgggacaccgcccacgtgggataggagggggaggcggcttgggcccatcatgccgggaggggagaggggggggaaaggcagcccgggagagagagggaggagggagtgggccgggaggggaggaggcccaagaggaggagggagagaaggagagggagagaaagagagggaggaaaggaaaacttcggccgcgggccgaggggagagagggaggactttgggccagacttggcccaaagggaggaggattatttttagattttctttttattaaactttgataattgttgttgttgtttaataattatttccggtgttctgaaaattcaagtaaaatttgagggctccttttagaccaaggagaatttaacaaaaattctccgggccacatttgaatttttcttgcacgtattttagggtttgccaatttcttttcgaattttaattaattctattattccttttagaaaatgatttttatttcgggatgaatttatcaggacgtgacacatatgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccaggttttttccttttcaacttattgttgtttattagattgatctctaaatgtcagattaatctctcttggtattttctgctgtttgcatgtaacgccgcggcactactcttgccgactggtgtttccgtctgcacggctggcctatttgccgccgctgttgggcgtatacgacttagccgccggcctgcttccgtcgccgccgagtggtgcctccgcctacacggctggcctattatgccgccgctgttg

SEQ ID NO: 10607 - DNA, 1606 bp, Oryza sativa
tgagtgcacatcatgtgcattttataaaactaatgagactaaataattagtgcagaaaattttgacataaattttgaaaataaaataaatgtaaaaattaaaatttttatttgaaattttaataggacaatggattttttatcaggagcattcataaaaaaaatgttgtgaacattggtatacctatctttatatgaatgctcctcatttttatgaccttttttaaaaaaaataaatacgtatttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacagtcaactgacgggaggggtatgcaagggatcaaaatcaaattttggggtatacaaggaagtaagcaaaattcaggggtatagaagggattaggaaaattttcaggggtatataagggattttctcttgaaacaattggcatagtgagaattgcactccatcatgtatatgcattgctcaagtatcaccctccggatcccagggcaatgagaacttaagctcatgtttgcattcagtgcatccactagcctcttaatgaatcttcgcttgatctacccgtgctctagctcttgggaaaattcttcaggaatgagtttgcatatctatgaaaggccattgaggatttctagttctgccccttcagcatccattattctttccaacacctgtagtggaaccagcaatgtcatgtagcatgataaatatagttgtacaaactatagttatataattcattggtaaataaatgtgccttctttttaccaaaaatgacaaaaaataatagacagtgaatgcacaaatgatacggcatactatacacctctatattgcacttgtagtatgtattagcagggcttacctctcgcaaggtgtgagatagttcctttaggtctgattctgtcagctcatgttgaacgtgcaggcacatattatgcaacagactcgctgccacatatatgtatttatcatcatggattagaatcataatgaagcagttatgcgggttttctgatgacagcattaccagtgcttgcccgtcgacctttggcagcaagcaatcaacatctgaactaaaatgatccatgagaatcgaggaatgccttcatcagcctggtaatgagcattttcatttgtccaatctcctgccttgtgtctctgtcaattgcaaggtttctgaggatttctgccacgagcctccttagttctttttgggaatacgcaagaagcgcatctttgtattaagagaaataaagtttatttacagagatttgaaaatgaaaataaagaaggggatagggtaccggatggacaacaaaatgtaaggcttaatctcgtacaaaattttgcgaccgccaccccgtggtcagtagaggtaactccagcattgccgcgttcgctaagcgccaaagcacggcctcagccgccatcactttgccacttcgacccaggtcttttgctgttg

SEQ ID NO: 10608 - DNA, 1767 bp, Oryza sativa
ggatggacaacaaaatgtaaggcctaatctcgtacaaaattttgcgaccgccactccgtggtcagtataggtaactccagcattgccgcgttcgctaagcgccaaagcacggcctcagccgccatcactttgccacttcgacccaggtcttttgctgttggttgaagaccctgttgttccactccttccagatagtccaagctatcaaggctggaacggtgtcgaatcctcgtcgctgagctttggcaaccttcattctcttgtcacaaagccatgagaggaaggagggttcattgaatggcagtatgtccgacaaaccaattgctcggagtgcgaaccagcacagttgacgtgactccgggcatgcgactaggagatgatcaatcgtctcgtcatcttgatcgcataggacgcaccgatcaggatgtggtaaaccctgtctccgcaaacgatcggccgtccaacatctgtttagtgccactaaccacaggaaatagcagcatcggggcggtgctaacgacccccagataggcttgtcctggaattggaccctccccacaaacatggactgataagctgagtgagctgagtattctcctgatgactcccatctccagatgattgaatctggctcttccgtgagggcatccaaggattgcaaagatgtccacaagctgaggtactctaggattgcttggatttcgaaagccccagatatatcccggatccatgttctaccttggagtgctttgcgaaccgtcctgcgattccgggttcttgctgcaaccgcggcatgcacagccggcgcaagggtgcggatcgacgacccctggatctagttgtcttcccagaagagcacgttcattccattgccgactcgacatgtcaaagagacttggagtaggttcctctccttttgcgagatcggaacattgagtccatgccatggcttttctggcgatgtcctcagttgccaagcccagcggcaccagagcgcaagtcccatgcgctcaagatcagggacacccaatccaccatacgatttgggtgcgcaaacacgtgcccaagcgacccggcaacttccaccgctagcacttgctttcccggcctagaggaagccgcgacggaccttatcgattccctttatcacccactttggcacattgatggccatcagcaaatagatcggtatagagctcaataccgcatttaccatagtgacccgaccaatgagcgccatctgctctgccttccataccggcaaccgacgggctatcttgtccacaaacggctacaggtcttctttgcgaagacggaagatggaaacgggcagccctaaataagtgcaagggaatgttgcgacctgacatggtagttcgtcctggatcagtgcaatgttgttgtcgttgcactgaattgggagagctgcacacttagcgaaattcatcccaagccctgtggcttccccaaagatgtgtagaatttcctttgctgtgctgatttcctcaggatccgaccgaatgaaaacgaccgtgtcgtccgcgtagagggaagttcggtagggcaggtgcagcggctgtaacagcccttcattctctgctttagagaaaagagagcttaatgagtccatagcgaggatgaacagcatgggagagattggatccccttggcacacccctcgccggtgcaagatagggttccccggtatgccattgatcaggacccgcgtacttgctattaggaaaagcatggcaattcaagcacacc

SEQ ID NO: 10609 - DNA, 3229 bp, Oryza sativa
cctgagaatctagcttgggagctaggtggcgtgagaggatcttcgtgaaaagcttaacgaagctgtgaaccaagctaattgggcgaaaatcccgcaagttcctggcatctgggcgctttggcagtagcataatgaatgccttgttcaccttctccaaactcgaaccatccatacgatggagctgttggagagcagctagaacatccactttgatgatgtcccagcagcaatggtagaactgcccggtgaacccgtctggtcccggcgctttgtcgcaaggaatttccttgaccgcttgccacaccttttcgtcagtgaaagggtcctccaaatcggataacggctgccccggctgctcaagaaagctcaattcgagcgagaactcacgcggactgactgagctaagaacttcggagaagaaggactgtgcaagttacgccttctcttccggggcagttgcgacctctgagtcgaattccaattgctgaacaaagtttcaccgacgacgccaagctgcttgctgatgaaagaacttcgtgttcgcatctccttcttgcaaccaagtgatgcacgatctgtgcttagccattgtccgttctaaggaagagtacgccaaatacctcttctttagtcctcggtgcaggaatctttcttgtgccgagagaccgcgcacttcctccgctcgatcaagtttcccaatgagttctctaatcatttctagctgtagcttaacattccccaccttccgatcactccagctttttagggcacaaccaaccgacttgagcttggagtcaagcctggaaatgggatcgatgatggtacacgattccgaccaagattgctgcaccacatcagagaatccattcaatttgcaccaaaaattttcgaagtgaaatctccccttcgacggatgggccggcaaggttgaaaggagtagagggcaatgatccgagatcaaggaaggcagagccttgaggaagcattgagggaagagtttttcccagtcggcttcaagtcactccagggttgggttctcccacccattcgaccaggtaaaagcacgtccattcaggtggagcttgtggagagctagatcgttgatagtccgacggaaacgactcatcatccgatggttgaggttggcgttgtttttgtccctatcttggtagattagattaaaatcgccaacaactacccatggcccattacgcatacttctgatatcgcacagctcctgaaggaatagcaccttgtccgcatcggactggggaccgtagacgaccgtaatccaacaggaggacccattgtaaaaggatcctccttagttctttgattgctgctgctatctcccaagatctctgcaaggtttctcaataagaaggaatgttttgatatcttgtacctcagtgttatgccaatttccccttcaatgcttgtgagcctctgcagcaccttcaacgatgacattaacagaaccttctgttgtgcttcggaatttaccattgcacttttgaagcttgtgaatccaatgattttggggatcaggtcagttactctgtctatttccacgcagttattttgatcacaaccagcaaggctataaatgattgacatgcctagtgcagggaggagatcattgtctgtcaatggctgctcctttggaatcgaccagtacgccggtatcctctaccaaattctaggtatgtatctttggtcgttgatgtgcattgatcgggttggtgtttccagcaggttattgatgtttctctaaaaaagggttaaataattatatttatcttgaactatatatttttaaagaagccagtgtatttcttaactactttaaaagacaatcattttccttttttcgtcaaaaaccgctccctctcataaaaaaacatcatagaaaaccactcttccttgagaaaacagtccttaaaaaaatctcatgatcccaatataaaatacgtaagtagttttatataaaaatgatcaagtatgtccgtttgaaatgttggagtcttcatccgttactttgcattcccaaatttcaaccggcccaaatatggagtatatttcttttctacggaaaaaaaaaccgatttagcccatctatatctattatccatcacaaaaactacctaacggcatcatgtggtggtgcgacggtcacgggacaaacttaatgtgcccgaaccgttaccatctcacccccatcagctctctcatgaaagtatatagacccatgcgcgtcttttacatatgcgtcagtagggccaggtgataggttgatagctggtgactatgtgcatgcgtgcataatggttggcccaaggagcagttaactcctcttgcctactgtcacgcccggaatttctatccaaaattccaagcgcttacatgtgtgttaaaccctcgtccaggaatcaaccgaggcacacaataacaaattgataatatgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcacacacaactaagatgaaagaacttaagacttacaacaacttaataattacataggccgaccggccaaatagacttaatagagaacagcggaagcttgactacccaatcacaagcacaccgactaggggtttaccccattaagttctcatcctagaagaagcaatcggaacccgcatcactcaaagactaagactaaacctgcaaacaaagggttatatcaacagcaagagtcagtacattaaacaagttaatgtactggcaagcacaagtcaatcctaccatactacatgtaaggcatatattcaaaggaaggcaatatgtagttcattttcagcataaagcaagttttgtttcgcaattcttttgtaaaagagttgatgcttcaattaacaaagacaagttttaagtttcattattaacttcttcataattccat

SEQ ID NO: 10610 - DNA, 14407 bp, Oryza sativa
cctccatcctaggcatacttggaatatacctagaaccgttaagtggcgggcccacgccttaaacttaacgccgtggtggcggacacgacgggaacccaccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaataccatatgcacaccacttgccgcccaagtataaaatcacattttacacattttagttcgtaaatacccatcatattcattttattccagcaagggttcatgtataaaaattcacattttaattatagatggaatgagcatttgcatatttctaagcatggctgagcaagtagttgcacatagagcatatataaacccatttgagcacaaagagtgtactctaaccatttctaggggttcaaacagcaagaggatcaattattcaaggtggaatatgcagcaaataagtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttatagtagtatagtcttaggtagtgttatgaaatacttttgtaaagtgatttttactagattagacttcataggagtgtgaagttgtgttttctaagactaacacatttggtttcacaatttttggagttataatgattttcttatagattttacaagttacaacatgttttaggcatatagtgttttatatgttcatgacttttgagtgataggttcagaacatgctacttcctgtttaagttgaataaaaggaataatttggttaactaaaacatttttagttcacatgtttatgatctttactagtatggttcatattttataaactagagatgctctaatctaaactagcaatatattatattaacctagaaattgttatatgagctaagttcttctaattttagtggatgaggatggaactatggcttcactggtcaatcaagtttttatttacgtttaattagacctaaagtgtatatatatacttatacatgtttatgtattacttaaacaacactatgtgtttaaattcttatttcactaagttaaggttttgatcaatgttctctacagaaggtgccaaattttattttactatgttgaagataactatttgctggttctatagaaactttgttcatttcatttggactaaaaatgaattttctacaagtttttacaaattaatggctgctctatgttagtaaatccttatatgaatatttagagacttttactacacagtaagtatataatattatttcataacttggaaatacatgttttaatgatcctacagaacttaagtttactcaaattgaagctaaattgggttctacatcaatttctaaagtttagcttatctaaaatttaatcattatagagattatagtttagaggccatttgatgcaaagtaagtattacttttatttcaccctaacaagagcctgtatgatgatgaatctgtagaatttgattttgttcaaaaatgagttgaaatgaattttctatgcattttataagtttggacatgttttatgtatgacttatcttagataaatcttagagacattatttgtacagtaagtgtcaagttttatattcctggaataaatttcataacttcaagaatctacagcaactggaatcacttcaaaatgagctatatttgattttatatagattttacaactttgtgcatttttctgctaaacatataattgtttgggcattttcctaatttttcttcagattttaaaggatgggtccacatggctgtgagggaccaatatgcacaaaggcccttgaggtttctaggaatcaacccgcagtcctaggcccatatgtcagttactaacatttttcgcaaaaacccctggtttctcgggaaatagatcccgcagtcccctagttttaggtttgtatgcaaaacgatgcttgagttttagtttatttacagattattactggtcctacttgtaagtgactgttccagttgttaatacatccctgggagtctttaaatttcaaaagccatgcccttgctctggacagagcagagcagcagcacagccgcgagcttcacagcatcaccagtggcgaacaacggcgattcagcttaagctcccaaaacaaaaagtgtagagaacaaccgtgcgaacctattggtggctttctggcaagatttggtgctctatagcggctgttagggtgttagaggcggtggctaagctcggcttgcacatgcacgtgggttttgaggctcgatttaatcgtgcatgcgtatgataaggactctagggactactaggaggctcaccaagaatcaaacgcggctcggcgaagtcttagcgacggtgtactggttcggcgacggcgcaactgctacggtcgtcgtcgacggtgtactcccgggcttctactgcatatagagggtgcatgcttcggtttagatcagcacaaggtagctctaggcgaaaaagattgcgccgaagctcaccagagaaggagaaagaaaggaatggcgtcggcggccagagcgcgacggtgttccgagttgacgcggtcgcgttcccggagattggctgcactaaaagaggcgttcttggtggcgttagagacggcattgagagggaattacagaatgcttattgaacggaaatggagctcaccggattgcgacggcgtcgaggacttctctcaccggcgccggagttggcacccccgttcccggcgaatccgaggcggggtacctcggttcttccgcgaaacgagacaggggcgagagagagtgagagttggtcggccggtcgggttaagtacggtcgccggcggagatggggaggaggagctcgccctcttccgcgctcaacgcgtgctcacacgcgtggcgcgcggggtctgagtcgtgggcccgtgtggagagggatgtgaggctgacaatggggtcccactaggcaagagagaggtgtagaaggaggaagtgttggacagggctgaacctagcctaaggcactgacaagtggggccaactcgatggaaactaggccagggagagagatatgggtagaagactggtaaacttgatttttagattaattttcggaattattttctcctctaactttgtagcttcataacttaatgtgtggaccaaattatctagtgttgaatttactggaggtaaatgattacacctagattccattttctttggttgcactcaaaaataatgggtagactgctcacagaaattaaacaaagatgggctattagaaagctagattgaatttttaggaggcttaaacagaggaggaaaattctagaaaaattacatttattcatgataactaatctagtgtttgaataaatcatttcccatgttcacttatgtgcagttcaatgtacttttggatgaaatatggttttagccaattaaatttaatttgatttcttttagttgtctgcttcaaccgattaatttgagatatcaacttgagtgttaacatgttaccaaattacagaggataagtttgtgctaatcattgtccacataaatttttccatgattttatcttgcacaaaatattttagagaattaagttgacctttgtttgtatatgtgttcccacttcataattgcatctaatattattatagggattacattaaacttgttttagactgagaagatgatatttgagtttaatattaagtccacatgttatcactcaagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttggtcatcacctaaattaaaacggaaattttggctctcaaaattggagaagttaacctctaactattttgacaagaaattttaagtcctaaaatttcgggtatgttacataatagagtacaaataaataactatttaatattcgcaaacaaattattacagaggtagatagttcctctcaaagaataaccttctacgcagcggaaaaaaaaataaaactataacaaactacggaacagctatggcgactccactccacaggcatcttaaccagaacaagctcaatccttcagatcatcaccttcgctgaaatactcctcttctgatgattaaatattgcaagaatgagcatatgacatactcaacaagccacacagcaagtatgcaagtgcacaaggataccaagggatggcataatataggctcatttgcaaaaacagcatttagcaaagatttaagagtagtaaaataatagagtaattaatcatcaatattaatcaacactgaacagcacacccatgccactcaggcccaaccaaacctgaacaaccaaccccggtcgtacagatcaaacctccaaaccaggaattatccattccaaaccaggagtcaaattaattatcacattattaacattgatgagtagtgtgaaactaatcacgaaaaacattgctcaactcacccataaccgcgggtacggctattcgaatagttttactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggactccccagcgacccccgtggacttctcgccgcttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaatcaattaacatcacacgattaaccatcgtgagctaccatttaatgtaaccataattaaaacaataaagtaacataatttataattaatccctttagttagctaatgtttctaaacatggctaagcaaacttacatatagcatttagctgaaccaatccaacatataaggttcatgctaatcaaattataacccataggaaaataagatcatcttcggccattaattaattgggaaaggttcaccacccgatgacattcgaaaataatgcatagttgaaattaaataatagctttaaacgggttcaacatgctcaaagggttgtttgggatctgtgtgacttgtcttgggcttccgcaaactcttcggaaccttcctcaacggaaacgctctcctccggaacgtcggaaactaaagcaattaaacaaaaaatcaacaaaacagtacaaaaacaagcataaacagtacatgtgaatatttttaacatgtagatcttgattttaaaaaaatttagcaacttgaaccacctgaaacggatctacggttatttagttacgattttctgaagatttaatctattagaaaaaaggaaaagaataagatgatgatgtcatgatgacgtcatcaatggtggccggctcggatggcaacctcgccggagctagggtggtcggccgggattttggaggacacctacgcgtagaggacgtcggcgcgaacccgatggtactcaccaatgcgtccaacaacgagggacggcggccggcgacaacgcaagaggcggcggcggctcggttgaacggcggtgatggcgctacgacggccggcgacggcggagagggggcggccgagcttcctcgctcccgtgcgcacctaacggcggcaacgagaggcggcaacgacggcggacgcggcggtgcggcgtggccggaggatggccggcggcggcggcgggttgggtggtgtggcgacggcgctacaaggcacgggaaagcacgggagagggggcaaacgaaagagaaggactagggggtcctatataaagccttggattgaagagatcggactcctcccgcaagaaatcgatccgagaaaaacaaaactcggttttggagataaactcgaaaacgagttcgattcgggcaagatactcaacgatttgcttcgatttttgggggtaaagatagaggaggatgagaggataaaaacccccctaacaatcggactcggggcggctggattggggcggatttgagggcgcaaggcggcggctcgggcttggcatggccggccggccggaggtaggagaagggcccgacatgtgggccccacatgtcggtgtcccacgtgaggcagggcgggcggtgtcggctgggccgaatgggccggctcggccgctcgggcggggagggggcatgttgggccaaactcagcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatctcaatataaaaaggggcctgataaaatttcattaaatactttgctcaattctataattcctagatttttctgggatttatttgagctaaggaagtatttttaataaatggaattgcatttaagaaataatttaattgaaaaaggttttaaaaagtcttcttttggctttgggccgaaagccggcccaaaacccctctctctctctttccctcggcccagccggcccagttcgccgagccgccgctctcctctctctctcagccgctgacaggtgggccccacttgtcggtttcgtcttcctccttcggccgccgccgcccgcaaaccctagtgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgctgccgttcgtccagccgtgcgccgccgtcgctacggtcgtcgtcgtcactcgggaaggccaccgtcgggatcgccaagtcgccgccgtccccgtccgccgcttcgccgccgccgaagaccgccggagcgccgtcgccgtcgtcgacccgaagagcttcgccgcttcctcctcgtcgctgccgccgtccgttggtcttccgccgttcctttggtcaccggtgagttcgccgcgtcgccctctacccattggtgccctccgttcgcgtcgtcgcgccgccgttcgccggcgagcatgtgagcccgagtcgccgagccgccgccgccggggtgacgtcatcgctgacgtcatcggggtcgtccgccgtgagccggtcgtggaccgatcaatctcggccgtccgttttggatagggttgatctcggtcgtccgttcgcgtgaaccgccgcccgtgcgcccggtccaccgaaaccctagccgctgacgcaataatccttcttttccttttcaaaaataattcattattgcgtcataattcgattaaaatccatataaaggttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatatgaaatcagaatgaggccgttcaagtctctaaattcatctaaaatcatgatctacatgtttgtttactttttatgtattgtttatttggtttttattagtctttttccttgttttgcgtgatagtttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattttagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttcccttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctagacgaggattttatgcacaaataagttcggaaattactagtgaatttccgggcgtgacaatctgtttgagggtgataagcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtgtaggttgttttgaccggtatgaagtgagcgacttttgtcaacctatcaactactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaggtcttggtacatcttagtgcttccagggtgaatggaatacaaagtttcatgagcttctttcatgatagtatccttcaactccttattatctgggacgcaaattctttctcctaaccacacagttccttgctcatctactacataaccgatggcttttcctcttctcatgttcttttttatttcttggatatcaggatcattcacttgagcttctctaacttgatcaaacagagtaggttgagcttctaaagtagccacaaaacctttgctgactatatccaagtttaacttctcaaattcttggcataactcccaaggtaaatgtcgaccttctgacatattacagtagcttttcctgctaagagcatcggctacaacatttgctttccctgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaactctaggtcatgcgttgggtagttattctcatgaggacgtaattgcctagatgcataggctaccacctttccttcttgcatcaacacacaacccaaaccgagttgggatgcatcacaatgcacttgggaacctttccttgaatcatgcaaaattaacaccggcgcagtcactaaccttttcttcagttcttggaaactttgttcacaatcctctgtccacttgtacttcacttccttctgaagaagacgagtcattggtctggcgatctttgaaaagttctcaataaacctgcggtaataccccgcaagtccaaggaaactacgaatttctgaaaccgtcttgggttgctttccaacttaacactgactccacattgcttggatctactgccactcctccagatgagatgacatgaccaagaaacttcacttcggacaaccaaaattcacatttactgaacttggcataaagctgatgctcacgtagtttctctaaagctagacgaagatgctcttcatgttcttctttcgtcttggagtaaataagaatgtcatcaataaacaccacgacaaacttatctagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttccagttgatcaaacaggtcatcaattctgggtagagggtacttattcttgatagtaacctcattcaacgctcgataatccacgcacattctctgagtatgatctttcttctccacaaagatgactggtgctccccatggcgaggtactgggtctgatgtatcctttctgaagcaaatcatccacctgtctcttcacctcagctaactcattagctgccattctgtatggtctcttatggatagggttggttccaggtaccaagtctatccgaaactctatgtctctcttaggtggcatacctagcaaatcctcgggaaacacgtctgggtagtcttgtactatggggatctcttgtagagcaacttggtttaaaaacacaccatgatatttaggagaggacacaaagaaagaaacggtttccccattgctactggttaaagtcaccttacggttagcacaatctataactcctctgtgacgagataaccagtccatccctaagataacatctagatctttggattctagcaagataagcgaggatgggaaaggaacttcttctatttctatagtagcggaaggacaatactgtgtcgaagatacttgattgcctggggtattaactagtaaaggtctcccaagactaataacttccatcccatgattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggagcgttcttcacgcgccgaggcttaggacacttatcagcataatgtcctggatcaccataattgaagcacacccctggcttgcttccctgttccttcctgacgggctggttctgagctggagttgctgcaggacgagcaaccatgttgcggttgtcattggcacgattaccagtattgttgtcgtagaactggcgttgggggcggacaactgatgaaatcctccttgagggtacgatggagcttgaggtcccg

SEQ ID NO: 10611 - DNA, 1670 bp, Oryza sativa
agtgtgtaactatactaggtggcttgcttaatcaacttgaacaatataatggtctacacacatcagatcagtgttaacctggttaaggtcttaactttagcgtaacccctctcctcctatcttctctaatctgcaacagatggtgaacactcgtgctaatggaagtggaaacaataccaatgaagggaacccaactcttgctcaagttctggctcaacagactcagttaatgaacatgatgatacagcagatgcagaaccagctcaaccaagggaacaacaatgctccaccgccgcagaacaagttaactgattttcttcgtgtgaggccacctaccttttctagcactaccaacccagtggaagcaggtgattggttgcacactattgagaagaagttggaactgctccagtgcacggatcaggagaaagttgttttcgcttcacatcagttgcaaggacctgcatcagaatggtgggatcatttccggatgaacaaagcagaaggacaaccaatcacttgggcggagttcacggaagcattcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggagaatgactgtattccaggaggcacaaggtagtagccagagccagtgtatcaagccactccaaattggtgaatcttcttccgctggtcaaggacagtcgcaacagttgaacatcggtggtgagatcaaatcagagactaatgaaagcaatgaagttaacatcgagcaagctaatcagccggtgccagttcagcaggatcagtctcaggagaataacagtagtggaaggaagcagcaggtatgtttcaactgttacaagccaggccactttgctagagagtgtccgaagccaaagcatcagcagccgcaaggtcaggtcaacaacattgttgtcacaggagccaatgcagtgccagttgcgtcttcaagagttgtgtcttcaagtgttacaactcagccaccagtttcaaggcagcagtagttttcttcaaagccttagaataattatcggagttatggaataagatagactgcagtttacctattccctttttctttctagccgttccgaatctcgggacgagattctttgtaaggggggtagtttgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgtaagagcttttcttgttta

SEQ ID NO: 10612 - DNA, 4432 bp, Oryza sativa
tttttccggttcgggccaagttggtatcagaagccatctccgattgtaggaataagccaagtggataaaacccagggacatattttataaataaaaattatttgcgaaagttccttttcccccttcccctaatgctatttgcaaaaggtttactccgttctccttcttcggattttcaactagtactagatggtcaggtcagtgaagaagaggacatcgtcagttgtttgccgaagctccagaagactgcaggatctgctagtgaagtggagaaagcagtgaagccagctgtgaagatcttggagaacctgtcgcagaacttaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcaaaaaagaaaagcaccaatgcgaaccgaagatgaagtccgtaagatgatcattaccagcacagaatggcctccaccaggaatgacaaaccatcagagaagaaattcctttcgaggtgcacaacagttgacagagcatcttttagctaatggaggtagagtgtctggtagtgaagattcagatcaagtctcctcagatgatgaagatgagaagtctccccaaggttttaaccagaataaaatagaacttaaggcatgctctcggtgtggagaaatcggtcatgttgccagctcgtgtgcctctacatgcgttcattgtaaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaccggagagaagcatcaaggcaatacaaatccccgccaagatcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacaactccaattccaatgagtgcactaacacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcagtatgcagtcctatcacatcatcacagaaccaatcgaggatgcagtcactggaacaatgccagctatatctttccagaatcaaaatgagcagccatgtttgtggttttcagtccgctacttatcatggtgtaatagaaagtttgcagcaatcatattcatgtctataaacagtgagcttgctatgcttatggatgattcatattgagaatacaatgtaccgatgttaagcaccgtccctttttgtttaaggtagtgcctcgtattcatgtaatgagggagaaatgtgtaatacagacaagttccatgaggattcgtttgaaagatgcggatatgtgatcatgtgtataattgtttactgacaaaggagacctagggtctcgtgttagaggaactatattctaacctcgagttaatagccaacctgtggatggaaaagaaaaacaattaaactgtgttgggttaaaaagccaacgagacagtagttgaggataggagttcggatacgccttttacagatcaagataaggattgttggaggaaaccccgaagggtacccgccatgcctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggaaattaaaccctagtggtatagatacagatagcaggcaatgtatttccctgaaggtagtcagtgcagcttttgacgcaccacatcaaggtttcactgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaatagaaacatgctctgcatcgctcaagaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcaagcaccggttaccaggcaacgccatgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagataatctacagaggtcagattaaaagcacatctaacaacgaagcctcagattcgacagggtaatgattagacaataacaaatccagcaataaagccattgaagaagacgtcaaagtatgtcaagtgggatgaattggttctcttgggaagcataacttatagttagagtggttgacccttgcatcaaatagcagaagtagctatcacccggagaccagggaagctaatatgaggcagttggtggcgagttagaagcaaataacaagcatggtatcctagtaatgacaagcaggttacgacgcatgacatgaagttgataacttgtccgaggttgactccgaagatatgaatcatgagaagttctggaacggaagcatcacagaactaccgcaacctagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagcccgcccaacctatcttcttgctagcctcctcgaatctcggggacgagattcttgtaaggggggtggatttgtcacgtcctgataaattcatcccaaaataaaaatcatcttttaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagc

SEQ ID NO: 10613 - DNA, 1123 bp, Oryza sativa
ggctgggccgaggcaggccgggaggaaggagggggggaagggagctgggccgagaggggaggaggcccaagaggagggagagaaggagagggagagaaagagagggaggagggaaggacttcgggctgggcttggcccaaaggaggaagaggagggatttttagtttttctttttaataaactttgatcaaggttgttgttgcttaataattatttccggtgctctgaaaattcaagtaaaatttgagggctctttttagaccaaggagaatttaacaaaaattctccgggccacattggaatttttcttgcacgtattttagtgtttgccaatttcttttcgaattttaattaattctattattccttttagcgaatgaattttatttcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctagcaaaacttctccactctggactgcttggctcaatctcctgttgcagatggaatcttctcttcacctgacttttccctggttgtacctctagttgacttcgactggattatggcacttgaagatgggactttcgttccagaacttctcataattcatatctttggcgtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttcttggttcgataataaacacctttgctggtatcttctatcaatcacctcttaaactttgtccaccaggtactcttcactccgagagttgtggatgcttctggtgacgatgaggtcctttggcttgctgcctttcagtgaaaccttgaagtgttttgccgaaagctatactaactgtcggtgcctttgatccgaaaagactcatctgtaacccttagtccaaacaaatgtctctttggttaatcacttgattttt

SEQ ID NO: 10614 - DNA, 19509 bp, Oryza sativa
tgtcttaaacaaaaagggaaggtgcttaacatcggtacattgtttcctctatgggttagaattaatatgaggcctcacaggtacggcgtttgctccagtgaccacaagacgagtgacctgtcttcttcttgcataatggccggagtgatggcgcaggttacgcttcggctgtggacaatctctagagaaatgacctggttctttgcagttgtaacaaatcaacgtcttctttgctaagttgtccgtctgggaacgatcgttctgattaggagttggaattggtggttggaaatccttgctaacatcggcatcagcggtgccattattgctatcaccattggagtctttctcagtgtcgaaattgctaaggttgtcattctgggtgccttcattgatactatcgtcgatatcttggtgaatgatgttgacattgcacgcttgatctaagtggtcatgaatggggcaagaaccatggttgttggtggtatcatcagcattagtattgctattgttgttgtctgcattgcgttcatcttcttggggcaggaactctggatacacaacagaagatccggtgatctgaagtggctcagtgcgctgtctttggttaccacctggaaatactgggttgttaaccatccttctcttgcaattcgtcatccgattatgctcactttcgagttgcatggctttgtccacaagtttctcaaaatcttcataatcctctagaagtagttgcactgcgagctcatcttttaacccctggagaaacttctcttgtttgtcttcgcccgtttccacatcttctggtgcatagtgagccaaacgatagaacccgtgcaggtactctgcgacggtcaaatctccttgcttcaggtagcgaaactctcgttttcttagtgtgatcattcccgagggaacatgtgatctcctgaatacagatgaaaactcgttccaggtggtggtatgtccttctggctgtgatgcttcgtagttatcccaccactctgaagccggtccaaccagctgatgagttgcgaagccaacccgctcctggtcggtgcactgaatcaaccctagcttcttctcgatggtgcgcaaccactcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggttgcgttggtgcttctctcattcccattggcttgggttcttgagtcatcggatccatcattcccatagccttggttaccaggattatccatctgtcacaaggtagaggttgagaggggaagcatacaaggaaagaatagaccagaactagggacaagaccttaaaggaactaactcttttcaatgatgtgttgtttgtttcacttattctgcaagttgattaagcaaacaacctagcatggttacatcacaacccactgatgcaaaccacgcgctacacacacaagcaaggaaacacacgacaaacgaaacactagagggtggcttaggttctgcgacgggttctcgaagatcttcactcctgcttcacatctggcttcactgcttcctccacttcgctagcggatcctgcagtcttccggagcttcggcaaacaactggcgatgtcctcttcttcactgacctgaccatctagtactagttgaaatccgaagaaggaagaagggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttcaggcctgacaagcaaaaataaacagcagcggactagcggcctacggctccatcttcacaggcgctcaactggggtataagccaagactccacctaagacttcttctccaaagcttctcttactgaaggggggagaaagatagagcaagaatgagtacaaccacagtactcagcaagccacaccggaggtgcatgattaatgcaagggaagtacaagggaataataatatagggattaagttttgcagtaaaccgcatttaaaaatcacttagttgcccaaagccattttgtaaagacgatcctagagctacacagtgttattaaacaaggccgtgaaccctcacgaacctgccttaacccaaggcctacgatgatttggaccgaactggcaacccgaccctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccctaactggcatgcacccaaaccccaccgaaaacaggttttaggggttttgaaagagaaagagaggtgtatgtccaattccaccataatccaacaattccatagtgtccaaatgatatgagaattcccaaagtctaaaattataaaaccacctaatgttgcctaattaaacagcgaagcatctacctaaatttatactagtggaaccatgaatagagtacccactagttagggttttatttattctagggtgaacaaggtaataataataacaataacaataataaggtcataacaaaggtaattgggcatggctagataaaacagtgataacgcgggaatttaaataaagcggtaatgcaataatttaaatcaacataattttacaaactgggattcaatatgttcaaggatgatgtgacttgccttgctcagagagaacggctttccgaaccttcggcgacgaccacgaaccacgcttcgggaacctccggaacgacgaaagctacgcgaagcacacaagcaaagctacaagcctataaagaagcaataacaacacataaaaagaaagcacagggttctttaggttataacaaacattaggagacttgaacgggtcgattcagagttcgtatgaccaagatatgatcatccgaagtttaatgctgttatatggagatttgcggattattgtaattaggttttgcaactataaaacatgtgtaagcgctagcctggaaaagacaggaaggctgcgccgttgacatgcggaccccacatgtcaacctaaaggaccgcggtagaccgagtgcacagagacggtccacgggtcgacggaagcggatcccgtgtgtcaaccgaggcgagtggccaacaaacggactccactagacaccacacggcctgcacacgtggaaaccacgcggctaccgagcgggcacactaacacggacactacacggtcaccacccgcacacgtgaacgactaccgacaccggtacacgggtaccggggccgacaaccgcacaacgggcacgggcgacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttgggcgaaggcgagctgcggccggcacgaggcttgacgacgcggagccgaggacgaacacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacgacgaggaccacgccgctacgatgccgacgacggaggcggcgccgcgagacgacgagccgggcgagagggaacgggatgatgacgacgaacaccggcggggttcggtcgaaggggaggcgaggccgaggacgacgtcgcgactgcgatgccgaagatggtggtggaggtggccgaccggtacacggcgaggagggacgggcggccgaacaactccggcgaggcggacggagaggttcgcggcgacgttccggcgaaaccgagggcaggccggggtggagggcgatgcggcgtcgccgagggaggagacggcgacgtcggccgacgctctggcgcggcgaccggggcagccggaggagatgtcgacgaggaggaaggtgaggccggcgcgggcgacggcgttccggcgaaattcgggcgaggaggaggtgatgccggggaagaaggcgatgccgcggtgtcgaaggagaagacggcggcgtcgatcggcgcaccggcgatgaacagcagccggctggagggagtacagtggcaccaatgccactggttgccggcgggggcaccgttccggcgagtttccggcgaggagacggtaaggccggtgaaggggacggtgttgcagagccgagggaggcgacggcacggccggacgatgctccggtgaggagggagaggtggctggaggccggccggcgtcggagagggagaaggagaaggcggggagaggtgatacgaccacggggaggctcgggaaggggctaaaacgatagaacgaaggatgaggatcccattttataggatgggggagagagccggccacgggaggagcgggaacggcgacgggaatggcggccggcggcaaaggaaggcggccggacttggcgcggccgttcccggcgattgggggcaccattcaaggggaaattaagggggaattgaagaggagggaaaggggattaattccccctaattaattttggaattaaccgagtgaatcaagcggatttgagggaggattggcgctagggttcgcacggggagagggaagccgggcggcggctggaggaagaaggcgacggctgactgacgcgtgggccccacgcggggcgcgcggtcagcgcgcgcacgtgcgcgctcgggcggactggtgtttccgtctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctatacggctggcctattatgccgccgctgttgggcgtctacgacttcaccgccggcctgcctccgtcgccgacgagtggtgcctccgcctacacggatggcctattatgccgccgttgttggatgtctacatcctcaccgttggctcacctttggtgccgtcgactggtgtttccgcttacgcgggtgacctattatgccgccattagtgggcattttggttttcaccgtcgaccgcattcgtcgccgccgactggtgtcttcattgttattgatggacgactttgttcccacattggccacttctgccatcaccaaggggaatattacaaagctaagtcatcatttattttattctttatatgatattttgccttttcctctgcctcactacaccaattggtcttccattgagtagtgagtcgggggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgcttggggaaatcaaaattaacaagagaagaaatacgtatttataaactgcttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccaccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttggtcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctgacttattatgccgccgttgttgggcgtctacgtcttcaccgaccggctgcctcgaccgccgccgactggtgtttccgcctgcacggctggcctattatgctgccgttgttaggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaatacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcgtcttccgccgccaactcgtgttatgccgccgccgactagtgcttttatcttcacaactgcgcgtcttcactaccggtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttggacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgttgtcaactacacaactttatcgctgagcgccttcatattcattgctggctgacctgactgccgccgactggtttcttcgccttcatggctatgcgacttcagtacttttgattggtatcactatcttcactaccaccaatatttttgccacctctggtgggcaatattctctctatattggttatcttgtctctatgccaactgcgtcagctaccatcaatagacaattgtgactacgacataaggacaagctatatgctcaggggcttactagttcaaacacaagtattatgtctccaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggccaaggcctaatatgtctgcagcccatattttcaggtgtggcctgtcatgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttcaaggtccttaagcacatctgttcaaccagtgtgcgcatggggtatgcccaacactttggaaatttctttattcacaacatacaagctttttatagctgttttgctatgtgaattttcaataatgtagccaactttaggttacactcatcatattttacaaagcagtcggtatatcactcggatcatgttattcagggatttacaccgcatatgctacatattaatatcaagtcgcttagttaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccctatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcacatatgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacaatttctatggtgtctacggttgtttgggaagtacgccggccacgtatagtgattgaaattatggtagtattgtttgctgctggccagtttctatgtgctgaagttctaggaatgcgcctacgcatcaacagtcggctacgccgtcagatatcgctgtggagcctagtggttgcactctttattacttgctttctgtgtttacagagagcacaggagctcatagctggccatgtggatattgtacggtttgctccttgtggttgtgctcctagtgactattagcaggctgcagttcccaattataatcagccgagtacagggtgatttgggtcgcaaatacatattttggcgcccatttatcctactagcagctcggaaagttccaagaaaaaggtatgagcaaaccagtggcaaatccaaaaaagacaaaggaactggtacaattttcaatgatgccagcagtgatggctctgatgatgaattgggcatcggaagtgaaaaggctgccattgaaacttcttcagatgatgcatcctcatcagctgactcaggtgggaacctcattgaaatagtatcactgaacatgctacttaccagtattctctccgattgcatttgcactttgttttgcatatgtttaaccgtggaataaaaaactatgccctctttgtttatctcttatacttcttctggaaaataccctgttctatgcaaaatgcaaaagcgatgaattaaaagaaagttaacgaagacttgattattgagagaactgatcatacaacagctagtgttgcaatttattttcgtacgttcacttggaattcctgtgttgatatttctttggctagtattatgttctatgtatcttcagaatatcatttaatatttgtaatgctggtttagtgctatggtgattacgatatggaatgtcaggagcaatgtactctttgtttagagcagacttttcatgatatatgccttgggattctgattcagtgtgattaattatgaaatattttctaacagtgcatctgatatgctacctagcttgcttatgaaagtgatctaattgatgtgacaggtatttcatctgcagcccatgatagtggcgagcctgatgacgatggcaatgcatcactgtaagttctctaatttacaaagagaatggtctggtgtaggaattacgtttccttcgattttgtttatgtactccctccgtcccaaaaaaagtgaatctaggactagatgtgatatattatagtacaacgaatctggacaaatgtatggattcatagtactaggatgtgtcacatccagtactatgttggttttttatgtgacagagggagtaatgtagatgagcaggtacagatattgtatggtactgaatgttgatgatcgtcaacaaattgaaactttaggatttgctgctccaatgaggtgcacactggtttaggatctttcgctattgtctcagtgacatgtgggcctacattgagtggcaaatcgttctttggtgatgcaaatttcaaaacgtttttcacattatcaatagcgatttccaaaatttattagaatcacctaatatatctgtcatgagaatcacttagaagaacaaggctacccttctggtcttttggtctagttgaagaccgctgacacgttttctttttatttcttaccatttgttcagatcacagaaatctcgcaaaggggggcttggctccatcctcagaggctcttgtagttacaagaaggcaaagcagaaacaagccgtgcaattggatgacaccgaggttcctgatagccagccaatggacattttctgagactgaacttgatacttgaaagaagaaacacggacagctttggttttccattattttcatccacctgatagcatgccctggagtttgagcattgcatattagtatcccaaccagccttgataccatgtagtgggaagaaaaatgcacttggctgattctcatgttaccacatggcttttctgctccttgaactaaacaagcgctgcgatctcagctggaatgtaatcactatctggtggattgtcctcaatcagagattccactgatttttttatgaggcggtgtgcaactcttccaaaaaggataaatgtagcattggagctggcatcaccgccgatgagcactactttatatctacatgggtaatatacatgtgtatattaatgtgtgcagcacaattagaagcatggaaaaatctggaatgaggtgtggtatgaaccttggatctggtattcctatgttagaacagcttgagcatttgtagctagaaccgtatggcttataagttctatagcataatcggcatgaattgtaccaccaggaattttcgctgcatatcctcctaacagtgacattgacaatgaaacgtgtactctgaaaaagcaaagaacagaaatgatatcactattattgaaagtgagaaaatgtgcagcgatgtattgaacaaaaaactggcaaggaggtaccctgttcttgtgaggattgagggcaagtatttcttgaatagttttttcctctgcagtgtcctggttgtaacctgttgctgggttatcaacccagctcactggacgaaagtttgcactgaagctacatagttatatcacgttgaaagttaactaactgtttcacaaggagtgagaacacatcatggcaatggattataaacatgagttcaagtaggcagcctcacctctctttgagttctagcacttcaggaatatcaaggtttagataccatttgcacggcgaactaccagtcactgtaagacctgtatagcatgaaccaaataaaagcatagcgttagatggctagaataaacaacatagaagtgaaaatgcgtagtgaaaacgaacctaatcctgtgtaatctttgacaagtgtcccaacaaagacaataacttgggcctgagtttggccagcattgtatacactattagcgtcaaaagcatcagccctttctccccagagtgtaacaggcattgttgaattgctattgtttttccatgaatagaaaaaaggaaacagtgtgagtgtaatttaagaaagcagcggcgcactaagaatctatgcatgcataaaaggaaaaggtaaaaattgcaattaaacatagggatattcagtctgagcaaagacaccttgcatcacatatctgtattgttctttttaagctatcagcattccttgacttcggccgcacaacggttggcgaaccaacctcagtgatgacacccatgacatctggttgcatgccatataagcctaattaatgatgagatagtatggattattgatacaacaaatatagctgtgtagaagaatctcattaccaacatagaagatggtcttgtccactaaattggggatatcactgaatggtgtcaatgaaaaagttatgccagggaaatcagcagcgggctcaatgtattcttcaaatgttgtccatttactgaacacaatcattaggctattgtcgactggcctgtatgtcctattcgcatacctcacagtaaaggagtcaatatagtaaaccttttgttccttaagcaaaggcctcaggctgtcaattgcaggtggataaatctgagcgtgaatgctgtttccctgcatttttaaagtaaataatgttatcaagagagttggcactatagcctaataggcatcgatgaataaatgtcatagtcacatcattaccatctgatcgagcagcacaagatcagtgtggaaaatattgccactgccgttgagatcgcagaaatcccataacctagaaactcttgcaaggatccttgtgtttaagtctccacaggacagctgtgaaatgagcacatgtgccatcttggacctgcaatgagcatagaactattttagaatgggtaaaatggttggataagatataacagtcaaaagattgcttggcaggatactatacatgacaaaaggcaatatactatgtaccatacacatagtctatagtacttgaggctgaaagacatttattccaaaatatatgtacaaatttgggtattactgtggtcaaaaatttcaagcatcaagcggcggagccaatagtgcaatagtaacacatgcacattactctgctgaaaatacaacgaagtgatgaaaagcaaaaaaaaaagatataacgtgcgggaaatcaccgcttggactgtagcgctgagcacttcagagtaaactatattttttgtctgtgtaccacatgatccatcatcattttcaattaatatttttagccctgatcggcttgttactcttgaaatagcaacgtataattgcccatgtgtaaagacaggcttcttaagatatacgccaacccgctggagtgtttgaccttggcttttattgatggtcattgaatagcaaactcgaacagggaactgccttctctgcagtgtaaaaggccatttcatctttgtggtgccaagtgtgattcgaggtatgtaaacagtttcaccaatgtttgatccagtcagtattatacactgtaaaattctgtctcctaaaactgtgactaatagccttgttccattgcataacccaattgattgattaagatttcgtagcaacattacgacaacaccttctttaagaacaagtttatgcgttggaaagttagtagcatttattgaattcagaaactctggggggtataacagatcgaaatctggaatttgctcagagctttttgatatggtatcacagcttaggtatactctagaatctcctggcactaaaccaataatataatcgtttatttcatcaaccgttgtattagtaggacaaacaattgcacgagaagccagatattcaatgtctctgtagcacgtaaggaaatctgagtaaacctcatgaacaatagcagctattttgtcaccgctagtcataacaagtaagtcatcgggaattgtgatccatgcaggataattctcaccttcctttgctgtcataggtaaagtgccattgcctatagctaaaacccattgactaaaatcatgcaattcttttttttgattgtctggtaacattggattgagtaatctcatgtttatattcaggctgagtagcgctacatgtttccatagttctgagtttgtgatagatgcattgattatagcctgacgggatcctttaggaataactgggagtatttgtttgaaatcaccacctaggacaataggctttcctccaaaaggtacaatagaatttgaagggcatgtctctgataaaatatctcgtaacgttcgatctaatgcttcaaagcatcgcctatgtgtcattggagcctcatcccatatgatcaatgcagtttcagctaaaagctcagcaagcattgtgcctcgttttatattacagatgcttgtttcatcaatgtcaattggtattttaaaccgagaatgagctgtcctacctctaggcaataggagagatgctacccctgatgaagcgacagcaagaacaatcttgttttgtgatctaagtttcgcaattattgtattccagagaaatgtcttgccagttccaccatgaccagacacaaaaaagaaaccaggttcattagcgatagcacgagaacaaatagtgctaaaaacagttatctggtcattattcaactgctgtacgaaagagtctgcatgcatagcaagcataagtgggtcaattgtgatttcttcatcgattaatctattagtaccaagaacatgtggaacagatgatggatgtggcaggttaaaatctttgatattaccaccgctatttgcaaatacagcaataagctcatgtagtagcatgttaagcaagtggtcatgtggaatcacacagtgtggattgtcaagggccttttttagcctgttatgtatgtcatcagtcatgtatagccagtatttatcaaacaatgaacgaacataccaacagaacagttaaagaaggactgtcacaaaaagttgtctaaagctgcgctgaagacgcagtcactatggcctcatcaaaaaggagatgccattcattatctccttcaaaaaggcctcgtgcctcacatgcctctctatacgtgccataaacaacaccatcgtatgtgcgaacatcagcatagctttgagcacctttgacaatcattaacaacattctaagatagtaaagctcgcccgcagttggatgcacataatatattctgccaattttaggagcaggtgttcgctcgtgccaagttttagatgatggctcccatgtccattccttaggaaactcacagtatgtcaatgaatgggccttagaattttttttgttagtttcaaaccattcagtaagcatagaccgttttgcaccaggactctcaaggactgcccgtaggtcagctcccttctcgtatctcacaaagtttttcccaggcagatggacaaccaatcgctcaacaggtggcactctataatgtatatcaaattcaaataatcgatgaagtgcctcataggttgagagaaatcttgcatccatgtattctaatatttcattgcgtggagcaaggtcatgatttggtgatgcattttgtgtttttcctgttgtttcaaaatagatcctagctcggtcatggccttttgtaatatatttaaataaatactttatcaaatttgatttgttacaccactcaacatttatgtgtgcctcatattttttcagtaaagccatgttgtagggtacaactgatctattgtctaaaaggatcccattcttcatgatagatcgtccatcatttcttcgtctatagattgtaaacccagattcatcaacaatggtttcatcttggaaatctttaggataatgttttgaacatttatcgtttttcatacaaggacacttcttgttcgcatcactgcaaggaccatgcatcataaactcgctaaccaattcatatcctagccggtcggtgtcatagtcaggtatctcagcacagataaacccatctattatagaggctgagacatcggcagtggcagcagcaagccaaactaagcaatgtatgtgtggaaggccacgcttctggaattcaacagtgtacaacactgtaatcattaagaacaaaggttgatgagtgccacaccaatggccttaatacgctataaactaacaaaattgtgaccatacctgcaagaactttaccaaaagttctgccttccctaatatcagttataaattcattaactttcatgttaaacacacgcacaataatatcagctctatcagatggttgttggccaggctcaaatcgaatcgcatctgcaatttcttgccatttggaatgacatgtgtatgtgacaaaaaggtcaggaggcccatagacacgacatattgccattgcatcttgataattcatgaccatatatcttcttcctccagtgaagctagcaggaagtatgacacgcttgccaactgaatctccatcagtgacacctttatcaatcgcatcaacaattccatctacagactcagagcgcaactctttttgatgatcgatgaagtattgtagcctatttgtttcaatagtagaaaatatatcaacatcgatttgatcgctcaagcgaccatagcatgtgaaaggatttggttcatttagtctgtaatgcatttcatatctataatattccggcatcgtgacatactttttgccaattccatcatagttactgtatttaatgcctaaatggaatccgcgttcaccatatggaaacaacaaaggatattgcaatgccatataagatggatgcaagggagaaatctggcacaggccacgacctttatcgtagacaagcacatcaaatttgtattctttcgcagaaaaatcacctactataatagcagctatttcactgttcgttggtaaattgtattgcacatcgtcttttgcattgcaacctaaaaggcgaagtgtcacttgctgattgccatgctgaataacacgttctctagcatacctaaagctctggacaagagtattttcagcatcaagcatcgatgatagggcacgaattatctcaggatctgctttatctgaattatcaccgtcgttttcaaatatatttaatcggttttgtaattcattttctggatcatacacatataattgcgcaaatttgggaggtgagccacaggatggcacaagagtaccaatcctatggtgcacaactccattgatcttgaatacataaggtgcatttccagtgttaatcgatttatcaatagctgcacccattgagctgaaagcaaacatcgaattatacgatcgtatttgcctcaaaaaatttttcgaacgtgcatcaccattatagttcaataatgatgctagtggctcaggaggggcacgcagttttggcaattgtatgcgtcctcctttgcaacatagattgtaaattatttttctttttgaaatagcagatgcactcttgaccctctcctggtaccagaacatggcaccacaatacgggcattcatacgtcggagggccatagtatgatctgtctgggtatgatgctgccacaaaagcgctggacaatgtcaaaaatagtctcgtgtaaaaaaacaatgca

SEQ ID NO: 10615 - DNA, 3005 bp, Oryza sativa
ctggccctaggcagcccgggaggaagtagggggggaagggagctgggccgagaggggaggaggcccaagaggagggagagaaggagagggagagaaagagagggaggagggaaggacttcgggctgggcttggcccaaaggaggaagaggagggatttttagtttttctttttaataaactttgatcaaggttgttgttgcttaataattatttccggtgctctgaaaattcaagtaaaatttgagggctctttttagaccaaggagaatttaacaaaaattctccgggccacattggaatttttcttgcacgtattttagtgtttgccaatttcttttcgaattttaattaattctattattccttttagcgaatgaattttatttcgggatgaatttatcaggacgtgacaatctgaaggattgagcttgttctggttaagatgcctgtggagtggagtcgccatagctgttccgtagtttgttatagttttatttttttttccgctgcgtagaaggttattctttgagaggaactatctacctctgtaataatttgtttgcaaatattaaatagttatttatttgtactctattatcaatttgttattgtgtgcctcggttgattcctggacgagggtttaacacacatgtaagcgcttggaattttggatagaaattccgggcgtgacaagttggtatcagagccaccttgaccttaggataagccaaatggtaaaccttaagtagccttcaaaatattttgaaaaaaatagaactgttcttctctattctcttataaattaattaagttggcagcacatgcaaggttatgcacaaaattaatttaattcattttcttttcttttaaaagcaaaaagttgttcttttcaaaatgtttcttatttcactttattaaatttcgttgattagtcggcactgtacatctattatggtattgatacaatcatgatagcactagtactactcatcctttttatggtgacactgtaccgtgcttataatagatcataagtattttagttttactttagttatttgtcaaaaaaaaaattatttgtctctgtccaaaaagttaaatgctaaaaatatatttatataatggcttagtacgtgtcttttcttttatttttcttcctctttggtcaaatcagttaagtctagatggtgcagctaacttaaaaaaaaatatgcattaattcctctcttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagaccttccgtccattaagttcgaagctggaggaagatcgtacagccatgcttgtcaagaagcagctttggtggccattggagagttgcgtcaacgttttgaagaagagttggattcatcagctttctagtatcatcctcacaagcctcatggtcaagactatggaacctatacctgtcctgatggtgaagagagtgccactctgatgcatgcggtgcatatgcttagtgctatggatgcagtaagtgtggagcgagacaaagcagctcatgacagggaaaactggaatcgaggcaagatttgcaagttggagagcaaggtgtaccgtctccagaaggaattagctgaacttaaaggagaaacgccgccgccaacccccaagcttcgcctcaccgcaagaaagagaacctgtccgccacctcgtctctagttagcttcgaagattcgcgtgatgggtgaagttgtgcccgatcgtgctgaacctgtcatcgacatcgtaagtgatgaggaagaagaggaagaccctgaagaaagagagccagctactccagaggaagaagatccatcgcttcgttccgacgcaaggcgggattagtcgcttagttaggtcgttgccgtagttcgctgtgttagattgcttgtttaagtttgcttgtgagtgtgtgggttttagttgttgcttacatcattggtgggatgtaacagcatgagtctagttcttttgcttgtcagagtgtaagatagttggtgagatagtgttaatgcaacttaaatgtaagcatacacagttaagagcaatataaaatttaaattaattaaataactccgttctgagggtgtctctctgtcgttctttcctgttgtctctgcttatcgtcagatggtgaacacgcgcaccggaagtggaagtggagctgctaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctaccttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagggctgaaggagagcctattacttggcaggaattcacggccgctttcaagaagacacacataccaacgggtgttgtagctctaaagaagagagaatttagagcactcaaccagggatctcgttcggtcaccgagtacctccccgatttcacccgtttagctcgttatgctccggaagatattcgcaccgatgaagagcgtcaggagaagttcttagagggactaaatgatgggttgtcttatgccttgatgtctacggatttccgggattcccagcagctggtgcacaaggcgattcgtcaggaagacaagtataaccggatggagcagaagaagcgcaggctt

SEQ ID NO: 10616 - DNA, 619 bp, Oryza sativa
tggccgtcccgcactacacttacatgatgctgaagatgcctggtccccgaggagtcctatccctacggagcgacatcaagcccgccggggcatgcgacaaggagagctgggacttggcccaaacccgcgagatgacttttggccgagaggaaattctactggctgtaaccacagccagcgaacgtgaagtgcccactaccaaaacttcaaaaagtggataaagcgatgccttgacttataaaatttccctagagacttgtgatcctactaaaactgctgtgatttgcgccctgttatactgtctataagaaagcgcgctcatcacctttattcccaacaataaagatatatttgcgtggaaaccatctgatatgcccggtattactagagaggtgattgagcacttcttacatgtcaaagaagacgccatgtctatcaaacagctgactacggcgattcgcacaccacaggaaggacgccatcaaagaggaattaaccaagctggtagcagcaagcgtcatcaaaaaaatacttcatgccgactggatagcagacccgggtctacatctgaagaaaacagggcactggcgcatgtgtgatgattatactgaccttaaca

SEQ ID NO: 10617 - DNA, 1884 bp, Oryza sativa
ttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtgtggagtttattagagtaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaacattaggtggttttataactttagactttgggaattctcatatcatttggacactatggaattgttggattatggtggaattggacatacacctctctttctctttcaaaacccccaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggcctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagcttggacccaagtcgggttgccagttcggtccaaatcatcgtatgccttgggttaaggcaggttcgtgagggttcacggccttgtttaataatactgtgtagctctaggatcggctttacaaaatggctttgggcaactaagtgacttttaaatgctgtttactgcaaaacctaacccctattattatccccttgtacccccttgcattaatcatgcatatgccggtgtggcttgctgagtactgtggatgtactcattcttgatcaatcctttccctcttcagcaagagaagctttggagaatatgtcttatgtggagttctggcttataccccagttgagcgcctgttaagatggagccgtacgcccgctagtgcgctgctgcttattttcgattgacaagccctaagtgacttttgtgataatgtaatattatcgatatcataaagatgtgtcttttatatcatgattgtatggcgtaccaccgggttttcttggacagtgattaatacactagcgttcgggaaaagg

SEQ ID NO: 10618 - DNA, 12481 bp, Oryza sativa
  unsure (1)..(12481): unsure at all n locations
acccgagaattgaaattgacaccattgatggctttgcagacgggacaagcgaagaggctgctcttgatcttatcagtaatgctcaaagtgcggctgacaagattgcaagtgatgttgtagatcaattccgcaacaacgaccttcagccgagcaacaataactctgatgatgaaagaactgattctgactgagtataaatgtagcaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaaccaaacaaggcaatgataaaccgagcaagcaaattgaattgataaaaaatcacactccattattatgatgatagcccccgactgacaacggcaagaagaaaacttgatgttgacagtcaagatagggaagtacaatgataaacttaagcgtaaaaacgacgaagatgctcaatgttccaagagttgtcgacgagagtaccgtcttcgcgcttgagtcgataagaacctggtcgggtaacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaatcggtgtaagtcatccactcggtcctcttcgtagcgttcttcacggaaatttcgaaagcgcaaagactcgaattcaacttcactcggcaacattgcctctgccccatagacaaggaaaaaaggtgactggcctgtggcccgactgggtgtagttcgcaaagaccaaagtactgatggcagctgttgcacccatttgccggcatagggttttagccggtcaaaaacacgtgctttaatcccttggagtatcatgccattggctcgctccacctgtccattgctcatggggtgtgccactgaagcatagcaaatcttaattccgaagtcttcacaaaagtctttaaaaactccaccagtgaattgtgtgccattatcagttgatgattcgattgggcactccaaatctatgcacaatgttgatgaagaaatctcgagcgttatcagctgtgattgtgacaaccggtttagcttcaatccacttggagaatttgtcaatggccacaaagagatgcgtgtaaccgccgactgcctttttaaacgggccaaccatgtcgagcccccaaaccgcaaacggccaagacagcgggatagtctgcaactcttgagctggtagatgaatttgtctggcgaaaaattggcaaccttcgcatgtgcgcacaattttgtcggcgtcggacactgcagtaggccagaaaaaaccctgccggtaagctttgccaacaatggtgcgtgcagcagcatggtttccgcatatcccagaatgtatgtctttcagcaattgtctcccttcctctaaagatacgcagcgttgcagaattcccgaagggcttttcttgtataactcagcttcatgcataacataaagtttgctccgccttgaaatccgctcggcttcatctttgtcttggggaagttcttgagaagtcaaaaatcgtataaggggctctcgccagtcggtttcaaccatagcaacgtcacgagtgcccgcaacttgagtagtatctttctgaggtactgtcggcgtataaaggtgttcgacgaaaacatcagagggtgccgtctcgcgcttggatccaaagttggcaagtctatcggcggcttcattattgtgtcgaagaacatgactgagctcgagtccatcgaacttatcttccaatttgcgtacctcttgtcgatatgccatcatattgtcgtcaaggcaggaccactctttcataacctggttgacaaccagctgtgaatcacctcgaactattagacgctttatccctagggaaattgcaatccgtagtccatgaaggagtgcttcatactcggcgacgttgtgggatgccgaaaaatgtatccaaagcacatagcttaatctttctccagttggggaaatcaaaaccactcctgctccagtgcccgaaagtcgttttgatccgtcaaaatgcatggtccagtgctccatcttctccgcgggggtatcctcctggcactcggtccattcggcgacaaaatcggctaacgcctgggacttgatcgaaattcgggccttgaatgatatgtccaaagacatcaactccaaagcccactttgcaatccgtccgtttgcttcgcggttgtgcaatatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcgggcgctggactttctggacatggccttcttcctcgcgctcaacaaccaagactgtgctcacaacctgggaggtggctgatacatacagcaacaacggctcttgcgggtgtggtgaggctaagactggtggctcagtgaggagtttcttgaaatcttcgaaggccttctgtgcttcgggtccccacatggaagtcgtctgtttttttcagcagcttaaagaagggcatcccccgctcgccaagtcttgaaacaaatcggctgagcgccgccatgcacccagtcagcttctgaacatctttctgggtacttggcggtttctccgggttggcttggatgcccctatgagacaccatataaccaagcagcttccctgacggtactccgaaggtgcacttttcagggtttaatttcatcctgaaagcgcggatgctcgcgaaggtttcttccagatccgaaatcaaatcatccttttgcttggtcttgacaactacatcatccacataggcttcaacgttgcggccgatctgtgttgagaagcatctctggatcatacgttgataagttgctcctgcattttttagtccgaacggcatggtgacgtagcagtatgccccgaagggcgtgatgaatgaagtcttcaagcagtcggattccttcagtcggatctgatgataccccgagtagcaatccaaaaaaactgagaagctcacagccggcggtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgctgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagaaggatctaggggaattttcttagtcttggcttcgctttctccactttttgaagtcttggtagcgggcacttctccttcgctcgccgtggctgcaagccagtcggatttcctctcgggcagacgtcatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaatttggctaacgccgggcgtccgagtatggcatggtatgctgtctcgaaatcggcgacttcaaagctgatattctctgtgcgaaagttttcccgagtgccaaaagtgatcgggagagtgatctggccgagtggagttgcggataatcctggaattactccgtgaaaaggcgcattgcttggttttagctcagagcgaggaatctgcatatcatccaaggtcttggcgaagaggatattgagtgcgctgccaccgtcgatgagggttctgcgaagcttgacattacggaccactgggtctagtaccagggggtaccgccccgggtggaccactcggtcaggatgatccgagcggtcaaacttgattgcaatctctgaccatcgaagaaattggggcgtgtcgggatgaacagcattgatctcccgttcggtcaacttttgcttccgtttagactcataagccagggggccgccgaagatatggttgagctccttgcggtggtcttgaaatccagtcggggcgtcgccgtcgtccttcttcctcgacgtgctttgttcttcgtcggagttctttcgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactagcagttgcaacaagttccgcaggcttacgcttgcggtccttatgattgttacttccacctcctcccggagccggcgtatccttttttggtttccaactcgggcccgactgctttgatgcggtgacagcgtcttcagctttggcgtactcgttggctttttcaaacatgagcttgactgtcctgggaggcttgcgcccgaacttgccgaccaattcttcgtggcgaatccctttggtgaaagcggcgatgatgacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcggcccaagatccaattgtaccacggggcaatccatggagccaagaccgggcggaatccgctaaagccactggtaaatagttcgccatggccttgctgtctcctcctgctgcgcggattgcgagaccgtagacggtaagccactattctgggttagtggtaccatcgtacttctctattccagtcggcttgaagccggctggccaatccactcgacgcaggtcgtcggtgaaggctgctactccatcaaggtcgtcgtcgtggcggtccggcgagtgaagatagcctcgtgctgctcggcgctgtatgattgtgtcgcgaagatcgacggggcggcgactaggtggtgagcgaggccgttccactcggcgctccctatggtgatcgggaggtgagtgaacagaccgctcgtcgtggcccctgctcctgcgattggatcctgcgccggtgatgctgaggcttggatgacggtagtcatgagatcggaagtgggggactcggctaccagtcggcgtgtggacgctttcggagttaactgggaccgaagccgcaatcatggtcttcgtctggttcaagatgttgacgacgtgatcagattgattgagctcgttttccctgaggagggtgtcgaggagggtgatcgcggcaaccgcattctgttgaggggtgcggaaaaccggtgtcccttcaacatcttgttggccgatgagatcacgcgctcggcgccctgcttccaaagctcgctgccgtcgatcctcagcctccttcgcggtccgctcacggtcctgctgctcacgccgtagccgttcttgttcttgtgcttgatgctcctcctccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagaactaaactcgtcgtactccacgatgtcggtggggcgcgagtcgacggtgggagagctgtagtcgccatctagctgatccgtcgaaatcgtgccgagtggttggaggatgacgccaacttccctgaagctaggcgaaatcggtgtcgaagccgacttccgcctaggcctacgggaaggagacgctgtcgtgatggagacggccgtcaaatcgtcggggagcttcatcaggatcggtgggtaagccccatcatcttgatctggtgacattggagaagatgcgatctcagccgagtggtttgaagccgactcggttgagatggtattgaagtaactctcagccgcgtttgggaatccaaacgggactgagatccggctctctcccgactggtccgactccgagtcaaggagagagatcttgccgaagttgttggtgacgaagtcgaggctgccgaaccgaaacgtctgcccgggtggtaagacgaggtcgtcgatgccggtgacgggacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtgttattgattgtatgatttggagaaaatcaacatccgccgctagaggcacccggaccccccttatatatgggaaggagtccgtgttacaaaagataatctatatccctaacggaataggcagatacagataaaatacagtcgtgaccgactagatctcaaggtatttcctttacgtacaagttaagaaacaaacccgagatacacacaagatattctatctatattcggtatcctatattcaacccaaatatcatcgccgtgtagatatgggatatccataatctccacaaaaagcatgacgcctagagaagacgtttgtaggcccagttgagaatagcacaatcaatcggtgtatggaaacagaagatggacgcggtaaaccacatccacagctcacaaatgtcaagtggtcgttgtctactgcactgtagcagtgccgcagcaagattggtctgtcggtttccacagctcaggaagccgacgtacgagaaggatgtatggtagactcgctcacagttaaaagcgcgggagtagttaacaagctcgctagctcaatgccggccggcctgctccaccacaggcgcaaccggagccacaactttaggtcctgagcgtacacaacccaaaagactagtctgatgggtgaggaccgcccccaccttttaagtcatgctcccctaccatcaattaccgatgtgggactaaacccaacaatctcccccgtcatacatcgggcctaacaatctccctcgtcacatcaacccatgtgaccccgaagacttgttacttgggcctcgggcctaacaatctcccccgtcacatcaacccatgtgaccccgaagacttgttatctggcctaccaaccatatgacccatggaaattattccggttccaaaccttgggctctgataccacttgttataaaagttagtcgatatagcggaatgacgactaactgtcacaccccaatccggcaccgccgcacaacggcacctgataggagcgtgtcgtaggaaaaacagcgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcagacagcccgagaatgcaaccgacgacacggacgaggcgaacaccaacaacagcagcagcagcagcagaaccaacggtctaacacccgacaccacaggcgacggctgggaaccaggacgaaaccctaatcttcacttccctttatcttctcttcaggacggaggaactatatatatttatatagagcaagggtgagtactttcgtactcagcaagtcacgggaacctaggtgtttaatgcaagcttggaagagaggcaaggttgttttgcaaatcttttatttgaagacattttgaaatcactaagtgatttatttctttctatgtttgggcgaaaagagacttgcgtctcgattcgactttatgagatgcttttcaacagctcatttagtaacgtaccgacctcccgggtcagatcattacttctcggctcccagagcttttttcattttctcggactcccagagtccagctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagtttgttaacctctgcagaggggtacactttacccacaagacacgaacttactccagacactggccggtgtcagaggttcgcgacaaagcctttctcaagccgacccagggatacctcatgccacatagaaggatcaaatcctcacataaacataggccattttaggcgtgcacaaatcaaactccaaccacctcgatcggtaatctggcaagcttcgcgttcttgccttaccaggagaccggtttggctccaaccgaccccgccccggcgttcccaactattggcatgcgaggtttccctgaaccgactagctacttatccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtaatacgacctacggaaattagtgcgactactgggtaggtccgtcggtttggcacgcaaaccgaggccaagcaagttaagtgtgtgattctaataatgcaagttacaaacaaaataataatgattttccaattagaggagcaattggtcaaagggtgacttgccttgctcaaagtcttcacgaagcttcacgaatcttcaagaaaacccgcgatcgacgaaaatccggtaaccgcaactgtacgcaaacaactgaaaacctaagcaaaagaccaaaagagggatcctatttagactaattagtagtgccattaaatagatctcaattttacggaattactggaagtggaacggaggcaatcggacgaacggatcgagggatatgaattttggaagtttaaaggaatttttctggacaaagagacgatttgtcggaattttctggaatacgagaaatagtttatggaatttatagaaataatattctcaagaatattattgacatccactgacatacgggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaataagaaggtgagagagagaggagcaattggagggagtaattgtggacttttagctcttgggtgatggacactgggcttggacaaagggagtgtatgtggactttgttttcttacttatcaggccgaggaggagggtggctactgggccaagcccaagagcaagagagagggggcggctgctgactgggcgtcggctgacttggtcaagtggggccgacggctgaggtggcgccaacgtggacgtcacgtcggatggggaagggagaggaggccgggcggctcatcggacggctcacggcgtgcggcgggatccggcgaacggcggcaagccggaggggcggctagcactggcggcaggaggaggagaaggggaactcattccacggctcggatcgggaagacgacgcgcgacgacggccggcggcggcggccaatctcgccgacacgccaacgtggccgcacgcgagaagagcgaagggcacgcgggctcgggcttcgccgaaccggtatggggttgcgacgcgcacgcggtgacgcgggacccgatggtcaccggcgacgcacgcgcggtggcgttatgcggcggcggaaggggcgacacggcgcggaggcaaaggagaaggccggcggcctagggacagtcagggggagctcaaggggatctccgggagcgtggcggcgagaggaatcggctcgagaggtgccgacggcggtcgattgcggcggcggcaatcaccggcgagcaaaaggggaaaacacaacgagacgacgaggattcgattcaaaggggtgggagcatctccggggttcaaggaatccgtttccggtgtcggatggggcggagaagcactgaggagggccggcgacgagcagcggcctccgggagcggacggtaatggcggtgaggccatgccgggcgacggcggtgctagggaatggtttggggaggtcctagggagctcaaggacggtgttggcgagggtggtcgacgagctggggcccgacgacggcgcgcgactgcgcgcggcggcggaaacagagcaacggcgaggcgcgcggcgcatcgtccggcaggctatggcgtgcggcggcgggcacggcatagcgaacggtaggaggaaagggttcggcggggagctcaccgacaagaggaagcggcgtcggcggatcgaagggagtcgtggttaggtggtcgcgacggtgggacggaacggcaccgggtgggcgcggccggggagnaagagaggaaaggtggcgcccggagctcctcgtcacgcgcccacgcacgcaccggttcctccggtgctcggcggcggacggcgacgacgagatcgagtcgagcggcaacagggcggcgatggttgttcggctacaatggcgcggtggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggcggcgaaggcggtggatcgagcggcggaaaatcgaaccgcgggagcgggaggattagcgcgggctggcgcggtcaaggtgggggtggcgagctggcgctggcgtctgcgtctctgcctccgagcgctagcggccaaggagtggaggcatggcgtcgttgcttgggagggaaaaagagagggaggacggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcgggttttgggcggcgacggcgggaatcggcgccgggaggggagagagcagagagagagagagcgaagacgggagagagaaagaacgagagagcgagagagctctctctcggctcacatgcgtgcaacgcacgtgcgaggggggttaagatgatgggctgggaggggagatgggccgggggagaaaacggcccacaaaaatccgagggaggcaaaatagactttttcggaggggattgattcgaagagaatttgaacttggaatttgacttagattttggaattgggatctcgatgagaggaaggagtagacggaggattcaagatggggttttgaatattttggatctggggaagtatttggcgatgattcaaagagagggatagaatttcagagtttgattgggacacttgagtcggaagaggaatttcaagggggcaaatttgtgatggttacaagagggatcaaggacggatttgaattgagatcttggcacaacttagactcgcacacaaa

SEQ ID NO: 10619 - DNA, 798 bp, Oryza sativa
ccgcgtttccctctcccgtttccccctcttttccctctctctctccctcggattcgtccgctttcatcccccgaagttcgccggcgtcttcaatggcgcccgcgatctccgcgcgcggtttcctctctccccggccgcgctctccccctcccgttgctttatattcgttccccgtgcttcgctcttccgtttccgccgctcgccgctcgctctcgccgtcggattcgtgctcgcgccgtgctcctctctctccgccgtcgccgtcgaccttcggttcgccgccgacgtcgctccggacgtccttccgactcggcgtcatttccatcggcttccccgcgttcccgtcgaccccgtctgcatctccgtttcgcccgccgaccgccggagcaccgtcgtcatcgtcatcccgaaccgcgccgccgccttcttccgcttcggccgccgttcccgtcgtcgccgtcgaccggggtgagccgaagaccgtccccctcgcttcccccttccctcctctctctcgggtgccgttccgccgcgccgttggtcgccggcggcgaccatcggggcgcgggtgcgccgctcccgtcggccgtgccggcgaggccgccttcggcgcgccctcgcggctgccaagtgggcccggccgtcagccgcccgcgcccgcgggtgcggctgacgcgtgggacccacagcgccggccgccgccagccgcgtgctcccggtccaccgtggaccgaggggctgacgcgtgggccccactcccgtggacccggtccgcgcgccctctccctcggctgacgc

SEQ ID NO: 10620 - DNA, 1303 bp, Oryza sativa
cgggcaaaacaaaacctgacccccagtcgcctgcgccaaaaaccctagcttcttctcttctctctcatgcgaccgccgaaaccctagcacagcgccggcggcggcacggccccggcggcggcttaccgcgcggcggcggaacggcgacacggcagcgccgtcgcactccccctcgccggtgcgcgcactcactcaagggtgagtgcgctaccgtcgagcggctgtgccgcggcgccccctccttttctcttcgctttctctctcgggcgggctcggccgcgccgagcggtgtcgtcgacgcctcttttctcttctcccccatcgcgccaccagccccaccgagtgagagagagtagcggcgacgaaggagatggcggcgccgccgcgggccccctcgccggcgcgcgcgtgcacccgcgggtgcgcgcgcagccgtcgaggggctccttgggggtgcctctttgcccctcccccctacgttgtcggcgtcaacgacggccggcgacgaggtaagattagggttagggtttctcttttcaatccgatgggatcgttagcttttctttcttttgcttttctctttggatttccatccccgaaaacaagatccaaacgctagggttgctctgataccatttgttagcattgctttgggatcacctaggttagatctagtcgggtagaacactttggatagacgaacaacaatagatggattaacaaagagggagtgagagggtttagggatgtgaccggtcgatgttgaggaggaggaagtgcggccggccatcgtcgttgtcgtcgcgggcttgacgtggacggcggcgatggtgtgcttgacggcgacggtggtcgtagcagtgggagtcgtggtcgacgatgaggcgtggcgcggcggtggggcgttcccatcactggctgcgccccctctcgatctgattagggtttgtgggggtggagttgccggcggtgacaaacttcgtgtcttgtgccgctccgcctccacccctctttatatggcgcagggtgacgggggcccaccagccattgggctgggtgcccccgatcagggcgcgggtcaaggcctccttgagctgttgggctcaaggggagggagatctatctaacattctcccccttgatctcactatttcttttagcctttttctattccatcatagatttgcatatagagcatgtttcatcgtcacggttaatcaccgatggattcgacagccactatacacatctctattcagaaacagatactttaacttttgggccctatagtccaggattcata

SEQ ID NO: 10621 - DNA, 760 bp, Oryza sativa
gcggctaccgagcgggcacactaacacagacactacacggtcaccacccgcacacgtgaacgactaccgacaccggtacacgggttccggggtcgacgaccgcacaaggggtacggggcgacaccgaaaggacgagggcgggaaatcgagaggacggatccttaccaccacgcggcgaggcgtgggaacaccaacgacgaacgggcgcggcggagacagacgggcacaacggagacgaacggcgaggggacggcttcggcggcgatccttggacgaaggcgagacgcggccggcacgaggcttgacgacgcggagccgaggacgaacacgaggacggggctgcagcgatcttgacgaagcgaggacgacgaacgagaacggcttgacggagggacgaacgccacgacgaccgggaacgacgagaggacaacgacgacgacgacgaccgggaccggcgaggaggcgacgaggacagccggcagcggctgcacggggacgaggatgacgtggaacacgccgctacgatgacgatgacggaggcggcgccgcgaggcgacgagccgggcgaccgacgggacgtcgacgacgagaacgatcggagacgacgatgatggaccgcggaggggtttggatggaggggaaacgatgccgaggacggccttgccgctgcgatgccggaggtggtggaggtgtggccgaccggtgcacgggcgaggagggacgggcggccgaacaactccggcgaggcggctggagaggt

SEQ ID NO: 10622 - DNA, 668 bp, Oryza sativa
gcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgaaaactgtgttagtcat

SEQ ID NO: 10623 - DNA, 840 bp, Oryza sativa
taaatgcggcttttgcaaatgagccggatattatgccatcctttggtatccttgtgcacttgcatatttgctgtgtggcttgctgagtatgtcatatgctcaccttgcaataatcaatcaacctcagttgaagaaaaaggatctcgaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttaagtggttctgaaactagttgttgaaacttgaagacgccaatgtggtcaacttatggaggttaagtcaagtggatcgataaataagaaggtgatggtcgatctgaagggccaagtggtcaagatggaatgaagtttggatcctaccttagaacctatgccgccaaagtgtctttgaagaatagttagtaggatagaacgtttgttgttcgcttgtgtgtaggtatggttgcattcccgtcattggtgtggttcaatgatgagtgtgtaactatactaggt

SEQ ID NO: 10624 - DNA, 822 bp, Oryza sativa
taatccatgatgataaatacatatatgttgcagcaagtctgttgcgtaatatgtgcttgcacgctcaacatgagctcacagaatcagacctaaaggaactatcttacaccttacgagaggtgagccctgcttatacaaactacgagtgcaacatagatgtgtatagcatgccatatcatttttgcattctctgtctattaatttttgtcatttttggtaaaaagaaggggggatttatttaccaatgaactatataagtataactatagtttgtacagctatatttatcatgctacatgacattgctggttccactacaggtgttggaaagaataatagacgctgaaggggcagaactagaaatcctcattggccttagttcacagatatgcaaactcattcctgaagaatttgcccaagagctagaacacgggcagattaagcggagattcattaagaggctagtggacgcactgaatgcaaacatgaaacaaaatgctcattgccctgggatcaggagggtgatacttgagcaatccatatacatgatggagtgcaattctcgcaatgccaagtgtttcaatgaattccggatgatggattcagtgtcgatggtcgaagagacaccctcaagggctgagaagtacatgtttttcttgggtgacatgggcttcatggaatgcaagacagctctctctgctctcgtggacagagcaaaagaactgatcagtcgccagtggctgcatgacatcaacagtgccaactgaagaaagttgtaagatgattttgcatttcagtcaaacgatcatgtcatcatgtata

SEQ ID NO: 10625 - DNA, 1016 bp, Oryza sativa
ctttcgtgagcggatcctcaagtatcctttctgttctaatgtgctcgagactgattgtttgatcctggactttgtctttcacaacatagtactttatgtcaatgtgtttggcagcaccacttgactgattgttgtgagagtacattactgtgggttcgctatcgcagtataactttagtggtttctcaatactgtcaaccacctttaaaaccgggtatgaatttctttagccagttcacctgccccgttgcctcatagcatgctataaactcggcatacatagtagaccctgcagtgatagtctgttttgagcttttccatgaaatagctcctcctgccagggtgaacacatatcccgatgttgactttgtattatcttttgcaaagtcagaatcagaatacctcactatctggagcgattctgattttctgtaagacagcatgaggccttttgttccttgcaaataacgcaagactttctataccaatttccagtgctctgggcctggattactctgaaatctgccaagtaacccggtaacaaatgccaagtcaggtcgtgtgtacatttgcgcatcctgttggcttcctacaactgacgcatatggctttgtttttcatttcattgagctcatactgatttctaggacattgcgatgccccatacttttcgcctttgactataggagcaggtgtagcactgcatctgtacatgttgaatttcttcaacacattttctatatatgccttttgagaaagtcctaatgcatactttgttctatctcggtgaatctctatgcccaaaacatatgaagcctcaccgagatctttcatgtcaaagtttgaggacaagaatttctttgtttcttgcagtagactgacatcactactagccagtagaatgtcatccacatacagaattaggaaaatgaatctcccattcttaaactttgaataaatacagttgtcctcgatattctcttgaaacccaaatttctttattgtcccatcatgat

SEQ ID NO: 10626 - DNA, 2103 bp, Oryza sativa
ctttcatggcttccaaccattcagatgagcgggcgcttcttatggcctcttcatatgaggtgggatcattctgcatatgcgactcttctatattataaacttcatagtcatcatggatagccgatcttctgactctttcagaccttctaggggcctcctgttttggcacattatctgtttgaggctattgtagctcctcctctggtgtggcaataatttctgttgaatcctgtagaacaggttcctcactttctttcattgttgccacaggagagataacaataggtgttggtaccgcaacgtcatgcattgcaagcacaacatcagcaggtagagaggagaaggctcttgaatcgactgagcgggctcagacacccgcctctcgtcaagatcaatttctcgaactaccgagctccccctaatcatttcgtcttccaagaaaacggcatgtccagtttctacaaactttgtacaactgtttggacagtagaaccaatgaccctttgatctttcagaatagccaataaaatgacagcttactgttttgggatccaatttcccaagatttgggttaaatactttggcctctgtaggactcccccacacacggaggatccatagctcatacggtgttttgggcgctgatgcattctatgcattgtatgcattgttctaaaactgagaactccaatggaggaagaattacattcttaaccagtctctcaattctccccctcgaaatatggcctaaacgacagtgccataatttcgatgagacatcaggagttcgctttcttttcttgttttcttttgtcaacgaggacacaacattcacattctcaaaaagagataacaaataaagctaatcttgcaacacagcaagaccaatacatgcattattataccatagttcacatttgccatttccaaaatgacaatcatatccatcaaaatacaatttggatacacttatttctttgcaaagaagggacataaaaaacatctcgaagtaaaagtgtgaagccattcgtgagctctaggcgaagatctctaacagcttcaacttttgcttcaactccattggcaactctaatggatctttcgcttctttgcatagtcctcatcgaacggaatccctttaaacaattacacacatgaatagttgctccagaatcaatccaccatgtggatctagaataaccaatcataatgagattcatttacaaatgtaataatgttctcacctttctttgccatgatcactgtcacgaagtcaggacgatctttcttggaatgtcttgtcttcttgcagtggagacactgatcctgtctcaactgtgaactgttgttgctgaggcagatgctgaggctgttttgcttttgaggagggtgacctgtggctcttttccttgttatctttaacaaggttaattgagccaccaatggtctctttgattctttcctcctcttgcacacaattagagatgagctcttcaatattccatttctctggacttattttgtagttgacaacaaggttgacaaagtgctttggcaatgaggtcataaccagatgaaccagaaagtcatctgagatgcccaaatctttttgcttcaacttggaagccatgttgctcatcctaagaatgtggtcttttacaccacctctatggtacctttctgtcacaagctgctttatcagttgtgtcgcataaaactttgaagaaccagcaaactggctctttatactttcgaggtacttagagacggtgtcatactctgggattaagcccaatatggttggctcaatcgtgttctttaccgcagccaaacattccttgttggctaaggtccatttcgtatgcccaatgtcatacgacatgatgagggaagcattttccctctctctcttttgccattcagcatctgactctttttcacctctgaaaagttcagcaggttctataggacatggggtagtcaacacccagtccacctctcccaagataaaagcaaggtcgagttctcttttccattctttgtagttatctcctttcagggtcggaatatctttaatgtaacccatcaaggagtagtcacctg

SEQ ID NO: 10627 - DNA, 217 bp, Oryza sativa
actatggttgctttgacgagcacgtataacgtgctttcctcgttagaatcagagcgggagctaaacaggaggccgattaaagggattttagacaggaacggtacgccagaatcctgagaagtgtttttataatcagtgaggccaccgagtaaaagagtctgtccatcacgcaaattaaccgttgtagcaatacttctttgattagtaataacatcac

SEQ ID NO: 10628 - DNA, 635 bp, Oryza sativa
aaaatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctttccccacagggctacccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgactggaacttgcctgtcttcctcctttgcttccttcaggtctctgctcacatgtcatgctattatcaaggacgtccctgacaccctgtatgacagcactgtcctgcagaaccatctatgatatggaaatg

SEQ ID NO: 10629 - DNA, 7033 bp, Oryza sativa
cgagaccaaagctgcggtgcattgggtttctgcaactcaccttgcaattaaccagtaataaactagtaatcgattccctaagcagaatagtcgattccagaataaccatgattctctccctttttttagtgcgactacaaccatgactaggactagaactggatcgggagggatgcaagcagggtgggcaagcgggctttttttgcccgcttatcccacttctagttcatttattcttctaaattttgaactaccatgcaagaaatacactagcaagcggatttttatgtgggtagcgggactacccacttgcatccctagatcgagttagcaaagcaacgaaaacaagggtttccttgccaagcaaagaggatccaagaaggattcggagggggataaggggggagagagcacccgtagaggaatggcctggatgggattctccctcgcctcgtcggttgctcttggtccggtcgtagagcctcgcctgccgtcaagccggcaccctagcgcttagctgatcgcctcgccgccatcgccggtcacctcgcgattactcggtcgagttgactagtcgagggcacccctcagttttctcggatcgtgcgaagtgaagttaggagatctcgggaagtagatgggctgatatgtaattggggcggttggtttatttctgaacagaaacagaaatatgtactttctctgtctcaaaatattactactacctagtatcttctgttcttaggtattgctatccaaaatattaaaagcttagcgataaacaaatcatgttgttacctaaaaattctatcttagatagcaatattttgagatagaggtggtagttggtgtggaggagccgaggaggtagttaagagtttccttcgctggctcgagctactctccgccaaacagccggatcagctgtttcgcatagccttcggatgttaccggctcccggccgctccggcacgtgccaagccaaacactccgagtccacgacattcgccctctgaccagtgacgaagctacatgtaatctgtatagtcagctaaccccataggtttttgcaaaatagataaaaaaaattgatatttgtgttgtaacaatagaaaacttaaaaaaatttatagctttgaccccgcaggtttttgctgctggcttcctcatgcatcaggctgtgaccttgccagttggcacccatcggtcgggctagggctgtcaacgagccgagctcgagcgagcttgcttgcctaggctcgagcttgtgtgacacaggctcgagccaagctcgaatcgagcctagtcctccttcgagcttttaagcaggctcagctcgagctcggttaggctcgcgagctcgatcaagtataagacaatgtatattttgatggcaaaattttgcaaaaaaaaataattttaattaacaatattgaaggaaaaaaaatgagaatctaagattaatatatgatgccaaaatacaattttcacacgaatatatactaatttatcctcgagctactaacttatcatataaaaagataaatatttcacacacagttaggctcgtgagaagctcgagctcggctcgacaaagctcgcgagcttgcagctaggctcgggttcggctcgttaagatctcgagctgagctcgaatcgagtctgagacgagccgagctcgagcaactcgcgagcctcgtgctttttttgacagccctacgtcaggcctcccacagggccgacatcacgtcaggtccatgtcgcgctcctcgtgttgctgagtttcccggcccaactgccaaacccgtgtgtcgcgatgaacgcacgttcacctcacgtcctacctccaagcattccatcccgagttcggatgcctccgacagacaagctgtgtttagattcaggggtgaaaagttttggcatgtcacatcggatatacggatatatatttgaagtattaaacgtagattaataataaaacaaattatagattccgtctataaactgcgagacgaatttattaagcctaattaatccgtcattagcaaatgtttactgtaacaccatattatcaaatcatggagcaattaggtttaaaagattcgtctctcaattcacacgcaatctgtataattagttattttttcgtttatatttaatactccatgcatatgtccaaacattcgatatgacagggtaaaaaattttgccgggggatgtaaacagggccaagaattcctgtcttttcggagacattgcctgattgactatgacacatgtgagtcgcgatgcgccggtgacaacctggccaaaaacaacaataaggggaatgagaaagaaggtgaaaccacatctgcacctgataaaaataacaggggagatgaggtcatgtcacccacatctacccaattgatctcactaatgtgccaataagccaattattaattagaaacttcgcactcgtgtcgattgtagctgaattgaccagcttcgtagagtcaatgttgcagctttgaattttttgtcaggccggcaatggagcaccgcccaggtttttctttttctttggacttcccagtgcccaccattgtttaaaattttggaacacagattgagttgcatcaccggcggtgcccaaggtctcttgttgaagcgcgtggtccggaaatgggggacatcgccggcgaagagcatcgagtccagatagcagccagagccagctctgaccggcaagacaaggtcgcggcgccggaaaaatgggtgaattgcttcgttcgcgtggtgacactgatggagaggacgagcaatgcactcggcacgctggctttcacttgggctaccgttgtcctgctaggtggctaccctgtggtgctcgactcgcatggcgatttttggttcgcgacagccatcgtattcctagaagccgcaaggtatatacagctacttatgtactgcccatctacacctgtttttgattttttgttctgcagtctaagttttcacttttctttgattacacaggatgttcggtcgcaacaatagatttgattaccaattgttcttccggacaagaggtgctttcagtttcagatcacttggcgggaacggactgatcgcgatcgtatacttttctgctgctaaggtggccattgttgttcgggaggtgcaggacggggcatttatgttgattataatcatggtattagtagtaatactacttacggttggcccattagtatctcgaggagctcgaagaccacgcacctgtagtctgctgctccgtgtgatatcgctatggagccccgtggttgcaatcctattgatgggttcctccatattccatatgtacggagacagttttgtcatgtggatagtgtacatagtgctccttgcggttgtgctcttggtgacggtcagcaggctgcggttctcaattattgtcaaccaagtgcgtcctgctttgggcagtaaacacgtattttggcgtcggctcactccttttttttttttttttttttttttggcaaccgtcggtttattcttaactcgtgcatgcttgctgcgatagtgatgatgcttttcatggttgatccagtccttcaactgttcaacacgtgatgatcttgctcgatttatgtggttttgccatactgtcatctggcaacttgcagattcctgcagctatcgtgcgcgaagagctcgcgaggatgcgccttacgcgacatgactacatcggtgttggtgagaagacaaatcttggccaatctcttaccatcctctacagcatggtgcttggccaaggcatactttacatcgttgccggcacgctggaggtcttctcgttcatcccactgagatccctcgtttgccgtgctggatttacaggtcagtggggagttgaatctatcaatctgtactacgaatatgccttcgacaaatacatggaaggaggtgtgtttgctccaaagaggatcaacctcagcaactttgcgatagattctataaactctgacttgtccaagaatcaactgtacgggatccagatgatgcacacttttctgcaaagagatccgacaagagcacaactcctggagaaactcaccacttcaatgcagacgaaggccaggttgatcaacatgttggactggactaatggaaaccaacatacaactattagattatatgctgcgaaggtcatggccgagttcgcaaagagcctccgaattgtaactgtccctgaggcaatgcagcttgtatcaacgcttctggataccgagggaagaccaaaaagaggacacccacttctaaatgcagatgatgatcaagatccttttgttgatccaacagaagaaagactagatgcagctggtgatcaagagcaaagacaagaattagttgcggacactgacaactagctggaaacgccaacccaatcagcacacagcaacgaccaagtatccatactcagaagttggcagaggatatcagagtattggtcaattcccaaggagcagccgctgacaaaggacgatcttctcccagcattgggcatgtcaattgtctacagtcttgctagttgtgatcaaaataactgtgtggaaatagacaaagtaactgacctgatccccaaaatcataggattcacaagcttcagaagtgcaatggtgaattccgtagcacaacagaaggttctcgtaaagtcatcactgagggtgctgtagaggctcacaagcattgaaggggaaattggcatagcattgcggtacaagatatcaaaacatcccttcctgttgggaaaccttgcggagatcttgggagacaacactagcatgcaagaattaaggaagctcgtcgcaggaatcctcagaaaccttgccattgaccgagacacaaggcaggagattgggcaaatgcaggtgctcattaccaggctgatgaaggcgtccctcaattctgatggaccatctagtacagatggtgattgcttgcttccgaaggttgctgggcaagcattggcaatgctggcatcagaaaatgtgcataactgcttggttatgttgaaggaaccagaattcattaataaactaaaaaatatgatcctaatccatgatgggaaatgtatatatgtggctgcgagcctgttgcgtaatctgtacctgcatgctcaagctcaacccgacctcacagaatcaaaccaaaatgacctatctgatgcctttcaaaaggtgagccctgctaatccatacttcaagtgtaatattagatatgtatagtatgttgtatcatttgtacatttgttgtctattaatgtttgtcaagacataattattttataatcaaaatggacatttatttaccactaaattgtataagtataattatagtttacaactatgttcatcatgctacatgacattgctggttccactacacaggtcttggaaacaataacggatgttgaaggggcagaattagaaatcctcattggtcttagttcacagatatgcaaagtcaaacctgaagaatttgtgcaagagctagagcacggacagattaagcgaagattcgtgaagaagctagtggatgcactgaatgcgaatatgaaaccaagtgttgattaccctgggatccggaggatgatacttgagcaaaccatatatatgatggagagcagttcttgctatgccaattgtttcaatgaatttcagatgatgaatgcactgctgatggtagaagagacgccctcaagggttgagaactacatgattttcttgggtgatacaggcttcatggaatgcaacacacctttctctgctatcgtggacagagcaaaacaattgattggacattagtggctgcagggcatcagcagcgacaaataaataaattgtaagagatgaattcccattgacagttgcagtgaattattgaactgttattgcagttgaaatgctatgaatttataatttacgcatgttgtggcgatgacataaggaacagagaaaaaaaatggtggcattagaatcagaataccattcatattgttacttgtttttttttttttgccggaatgaccgaaggaggtcattcaatgcaattaagataggaagaaaatattacaagaaaagttttacatcgacagctggctgtcgaggaaggatgtgcactagagcacacgccccgaaccatgtgccaaccgtccaaacacacgctacagagagggaagccaagcaccgaaccggccatcgctatgcgagaccgatcgccaccgggccaacaacaccattatgacacgaagactctaaaacgacgccctcacaagggtcgcgacgccgaaagacgccgtcgtcatccgtccaaaaactggacaaggttttcacccagagttccttgccgagggaggaggggtatctcaacaatgccctcaggatggttaccatgcctgaaggcgtagtcaccgttggcccaaagaaattaggctaagctttcgctcgaaaccccttaccgccgtggtccatcgcccaatccgaatccaccatctaaacatcggcggcacatggcttccaccacacccgaccgatgcccctccgcgattagcttccagtcctgccaacgacaagactgccaccacaccgcaccgacgccccaccgtcggccgacttcatcgaaccaccatccctgagagctggcctaggacccctccatgccaccacccgccggcctcctcgccagatctggctgaaggagaacctgggactgggtggcattgcttcggcatcctgagcttcccccgctgacaagtgacaacctgccgtctcaatccaacctagaaactccctgcaaagaaggggggagctccagaaagggcgagggtgccgaccagcaacgaagaagacgacccacagccggcagcttcctttggactaccatctgagcctacgccgatgccggaaatgctgccgctccggcttcggagcccccccacggtcgacgagtcttgggctgccggccactaggcggccaagccgagcgg

SEQ ID NO: 10630 - DNA, 10307 bp, Oryza sativa
aaattggatttccttttcgtgccatatgtcgcttagactttactttttcccctttctgtcctttcctctatttgttcgatagggtcttcaatctggacccaggcatgttaattacatctctgtttggctctgccttctagctgtgctatactttcaacacaaatcaagttcaattaggtgtatttcatatatatctacaagcataaaatttgtcctatttagtaaccagaaccaggtcaacgatgtaaatgcaaaaaataataagctgaatacacaaagacacaaatgatatcatagaagtatcggaaaaaacatgtatatatgtctattattgtctgaaatatgacaaatagtctattatatgattatccttgttggtgagttttttatgcaactagagcagcctatcttttgtcaatggtcatagctttgttgtaagaaagattatactctttggttcttcctatgatagcccagagagtatcttgacctgccaagtttatgtcatcaaactaatttagttcagtataggtcctatcagttaaagctactcgcaggcattattcctgttgttgtcagttcacttgtatagttatagctttgacctagctttgacctatccaactagctttgacctagttggataggttaagaaatagaatattggcaatacaatatatcatgcaattttctaaacatagcttcacaaaaatatggttcattttattcctcacagaagaaaagtgttcttcattttacagtgaatattccttgaggcattgaagttagttgttattgtgccaatgttgaaatgttcagtatatttggtgaattgatgctctatttctttgcaaaccatgatttctgaattcttctcagttgctactttggtcatgacaggttaaatgtgttataggagtacttcagcttttactgtttcatgagttcaaaatataaattgatctttgaggaatgaaaagcaaatgttctcttcagctatcttttctgaagttcaaatgtgtcctttgattgaattaatcttctgtaacattttgaaacctccagactagcatcatcatctctcaatactatcgacattaattcagtatccattttattaatccagtttcacattttactttgatgttcttaataatcttcagcggaaagagatgttctacagctctgcactttatctctgcctgttagtagcactctgaagaacagcctaagcttatcacccatcatttcctctctctccttttctactgtcttcattgatgctgctatattgaaattgcattttgatattggttctttgacaactgtggagcagcttgccaagacaaaggcagctcatctgctgaagtatcctgatgcgaagatactgtggatcggttgccctacatatctttgcattgttgctcttaatataacaaacgccagtcgtgtagcttcagattatttatattgcagtatatcaagaacatagctatacgatgtttggttagagatatcaactagctttatgataagcagctttcaatccatttgtcatagatgggctagcaggcagccagtcactgtgtctgtgcacatacacaaagtgagaacattgagattcttagctcaaatgcaaagaatctgatattgtcctcctcttatccacatgataaaagctagagctaaagtgtactaattcaagtcaaaggtcacattgactgtgaagtgaaataatatacatgtttgtaaccaggaaaaatagtatggacaagaccaagtaaagacgagaaattatttccctctgtttggaactcgtcttgctttgatccaagctccatatactttatcttgacacaccaaatataacctcaatttgtcacctttcctcctcctctcttagtcttaaaaagagcgaaaacttagctttacactgcactgcaaccatgttacacatatatatgcatgtatataactttagggtcacagatagcgttaccacatcaaccgaaaaaaaaatatttctttcaatatttggttaacaacttcttataaaagaaaacactagtatcagcaaagaacatggatcatgtgatctgatcatctgagtaactgatacaattatcttgatgtagtatttgctaaaaaaacattaggtatgcataatcaagaagcatcgtctgacttttgcccccccttttttttcatagatttgctctttcattgtgagactaatggtatatcaagtcctaccgttttactttatttttctctcattttgctttgtctgtgaacataacaatatatcaagttataactgctttactcaatttgttttctagaaaaagttcgtttatttactgtgagcatcgagacataaagattatgcatctacatggcaggctgtatcaggggtgctgcaagaaaatattttgagggaacgttactacgaacatatcatgtacactaaagtccgtatcaatgcatacaattgctatgccgttatgatgtgcactctatatcaggaatggatttattttgatcccaaaatggacgctaagattgctgagatgaatccgatgaatgagaatgaggttgattgggctatggtttattggttttatcaaagttggtacgacaagatatggtgcaattcttctatgtgcctcaacgatgacttgtatagttatacttattgtcttttgttataagcttttttttttttaaaatggaagcatcatacacatgtgagctgtgtaatttaatattttcaaacattttaatgaacatcagatattggagtattttcggaaacgaaatgcattaccatgtaactgtgtatgcacataatttcctgatttaaggccactctgcaagaacactaggccaatcactgtgagggcgcggcaaagctgcgccaagttttctagtttgagctgaaagaaatgctcaagttataactcaacttcctatatttcattttgctatttctgctgtaaaactgctggatgctactatgtactaaaattagtctcatcaccaggagtttcaaagaacacaagtagcccctgtgacgtttatcgtctcaatttgttttccttatacaagggacgaggaaattactgctatttgtagtaggtaacaattgtgtatgaccatatcctatttcccgagctagaagaacttatttctatatgaattatcctgcttttcccctttaacaaataagcaataagctctgtgcattttatcctattgagagaaaacagctgcctgaatccagtgtagttgcctgaacttttgcagtggcacaggtatttagtttgatcatagtccataccgctttgtctcttgcttctttgtttttagcccttataaatatcacagttggatgcttaggttgaggtgtcagatatcaaattgccaacttgtgaagctctcttatatgcttgacaaaagttaactcttaggccatccacaacaaagaaataaacatacaaaccctttggttggcaaaagtcacgtgtgtgtatgagaacttaaccccaacgtcatacgagaccctccattgaccagcaagtgtatattcagcaagtcctaatgacatcctactcactagtagtgatgttgattggagacgaaaaagttttgtcctcgaatttcgatatgaaagatcttagtaaagtctcatttgttctaggaatagagattcaccgagatagaagaaaaggggttaggattatcgcaaaaggcatgtctatgcatgcaagtaagcctacatctgctcccatagtcaagggcgatagttttgggaaatttcaatgtcccaggaaccagtatgagttcgatcaaaagaaagcggttccatatgcttcagctgtcggaagcttacagtatgctcaagtatgtatgtgccctgacttagcatttgttaccgggatacttagcagatataaaggaaattcaggattaggtcactgaagaatggtaaagaaagcttgtgcaaggcacaaaaggcctcatgctaacgtacagaagatctgattccctagagatagaagggtattcagatgcagattttgcaggagatgtagatgataaaaagttcacatcatgctacatattcactctcgcaaaaggggctatttcgtggaaaagctccaagcaaaccgtcgtagcatcatcgacgatgtatgccgagtttgtagctagttatgaggccacggggcaggcaaaaaatggttaaagaagtttgttcccgagttgaaagtggtcgacagcattcaaaggccattcaagatgtactcacaacaataagtcaagtggtgctgccaaacacattgacagtaagttttatgttgtgaaagtgaaaatccaggatcagacaattagtctcgagcatataagaacaaaggaaatgttagcagatctgcatgcaaaaggcttaccgcccagtgtgttcagagaacacttggcaggcatgggtttttacaggaaagcctattatccttggattacaaaagaaagggcctagtgtttatttcgagatggagaggtgcattgtagtcgttgcgtctgatggttcaatggtgactgtcatgatgaagcgtactctatgcgtcaatccattgagaagtaaatgttgagtaagagaagtaagaaaggcggagatcgaatgggagaatattagttgcgatcctggggggaatcgggaaaacgattccccactccgcctacgctccctgatcgggggcgccagccgatctattggcagtgggcccctctcacgcagcgctaatatataaagagagggagctggcgggcgcgcgaaccaaggttggtcgccgcacacacggactccccacaaaccctagaagtccctccgatctgggaagcgctgaagtgaggggaagcccgccgccgggtgtcgccaccaccatcactgacaccgacaccgtcgtcctcaccgacgccctcacatcaccgcaccatcgccatggctgtgtcaagctctaagaccggcaaaggtatgggttctctctctctctttctctaccgttcactctccaaggcaatcacccattattcctataagctagagttgaacccctagatctcacatagcaatcctaagaatctaacacatgcctcagtcagatttgagtggtagcagaggagcgccggcgagctccatctctccccggtggctgccatcctcggcgccgtgaggtggccgccactgaggtggaggccgaagctgcggtccgccggcgcgcgccggccgtcgttggccaaagacaaccctcgtcggtcgacttcctccacgacgccgaccccatgcgccggccgtcgttggccaaagacaaccctcgtcggtcgacttcctccacgacgccgaccccatctcaccgagcgctgcctcgccattgtcgactcctccactccggggaccgccgctccagctagctcctacgtcagctcccgccgccgcccgccaccaccactccggcctatgcccgccgccggctgaaggggacagtgagaaagaaagagagaagggaggaagaggggaggaaaaagaaagagagaggatgacatgtggggcccacaagtcagtgggacccacaattttttatgtgtgtgaatgactaacgggtcccgcatatatggctttaattcaaatgccacctaagcgccatgtcaaccccatagactggtcaacaccgctacgtcagcgccacgtcagcaaaacctctctaaaaatcaccaagggaatcaaattgtaccgatttaaatagttcgggggtcaagatatccggttttagggttagggttatggattagattcgggtcacttatcaggaagtcaaagtggacttattccaccaaatttgtaccggcactccactctctggtccgtgtggtggcccatggcatatggccgcccaacccattcgcaagaagaagaagtgccactggcactgggccgaacactggtttacaggcctgggcctacaaggcgaacagcagcgacagcaatctttagcgaccaaaccgcgacatcatccccatccaaccccgccgcggattgggatcaggtgcagtctctatatcgactgtaactttggcagtcgcgtcatccatagcgtccaaattgaatcaaacggtgttcactgaaaagaggttcgtcatggctccacttgagcacaaaggggctgatctggccggcagtagcgcgccagcgaacggcggtcggggaaaggctggtgaactaaaaaatgagttgcccagctcttgaggatcccgtgcatggtgaaatgaaagaggaatgtaatatatatgttccttaatccgggcagcactgggttcttactacggatccgtccgctctcaatcgagatagtaatgcatctgtgaggttggagatcgatcgatcgatggagatgcatgacgaagatgaaggcgaatttaataagctgctaattaattgaggctgtgttctgcttcaattttatttttaaggaatggtgagcttctacttcacgcacgcatatcagcatatgttcaaggtctgcttgatggggagatgaatatatagttgatgacggaagcgggcaagcgggtgcttggggttggcatgttgaggagcgagagcggcggtaaggcgccgggcaaggagcggctagctagcagcatgctcaggcgcgcgccggccgcaaggtccggtagcacagcgccgtcgtgtcgacatgctctggcctcttggctttggtgtgttggtgttgggctgaggtagatgacgatgtgcagggttgccttaacgtttggccgttacattaattttgtacgtggtggatcacgcgactgctaaagttgcagtcaatatacaacttcacctgatctgaatccccccggcgctggccgctgccgcccacagagcactcgcagccgcagcgggcaacagaaaaatcgacgtcgactcgtcgtcggcgccgtcaccatcgtcgcgcgcggagaccccatcgacccctagccagaacggcagaaacgatgtgtaacacaacgagagcgagaggaggccgaggccccgcagctaaggtgatgttcggatctgggactaaattttattctatatcacatcggatgtttgacactaattagaagtattaaacgtaaactaataataaagctaattgcataaataaaagctaattcacaagacaaattttctaagcctaattaattcataattagtacatgtgtactgtagcatcacataggttaattatggattaattaggctcaatagatttgtctcgtaaattagtctaagattatagattgtattttatcattagtctatatttaatacttttaattagtgtccaaatatcaaatatccgatctaacgtagagcagatgccttttttatacaccacgtcgccaacgcggcgtacgtacgtacgtcgagctggaaagcgatgggaggaagcagccacgatgatactcgcgctccgcgcgcgccggcgttgctgctgccgccgctcgcggagtgcacggctcctccggaatccggtgctctccaggcatcgaatcatccaacacttttttttactggctaagcacgcataatattaataaaataaggtaataatccatattaatttgcatgggggtagaggcgaatcgtactcacacacggccgtccatggcttctgccgcacgtgcgtgtgattaattaactaactatatccatggaattggataacaagatagccttacatacatccacagttctgcccaccactatggacggaaccatatgatatgaagaaatcggaggattaattaataagagcaaaacgaggaaatcgtgcagaaattgacatggatattagtcttctccagtgcgtagcggtgtgtggtttcgtcgtttcgatgtggaagtcgcaggggaatctagtctttgtgtcaaagtcgggcgatcgatcgccgcccatcgacaagccagacagcggcggttttgtacgcgcgcacgcttgctgctgcatgcgctcgcgccggcgagcggtggcccgtgacacgcgtactgtgcgtgcgtaactatcgtgacaaaacattgtactgtacccacttaatgataggggttccaatagtggggtaactgttcttaattagccattagtttccattgtcacggattgttgaatcgacgttggtttcgaattttggaaatttttgttgaacgaacagtatcaatccaccgcgggaggcaataatcaaggaggggaaaaaaagcaccattgtgtgctaacaactcctatacactctcacagggaaaggaatggacaccaatcaagtcgatgctatgcgaggctggataccgctagcccaataaaagatacatatgggctctcggccatcaccatgtagaaagaattgtcgagggaggggacgagagatgagaagttctgcttctctctcgaatagatccgatggtaacatccaagatgtcgccgaaaattgaattgatcgaagatggaacaggcaagaaaagcaggatctcctagatgacgtctccaaggaggtcccgctgcttgtcaaacttggactcataccgccagagagagaaggaggcatcacaacaacgtacgccctcaagagggatcgcattgcctagagcaccaccgttatcagcccgaacatgaaatgtcatcaaggcgcctataacatacctctcattgttgttgtaacctcgacgttgcaccacaaaccgaattctgccatatgcccttctctgccacaccgatgctactccacctgctatttctcatcggacaaggagctccactgcatcgatgacccttcgtcggctcctttgcagcacccctcctcccgcggccccctcaccccaaaagtctacgccaccctttctgtagacacgaagcaacgagcaccactgtctcctacattaatattgctatgccaccacagggtcacatccaccatgtctccgagccaccgcaaggcccctctcctctcatgccgtgtcaccacgccgtcgcaggcccttgctcaccgcatccacccttcccctgctgcggatacaacgacccttgctcggcggcaccccgttgcctcgtttctggtcccaatgcacatcatctccatcgtcggtccacgttcgcaacagcccgggaggctttagatccagacagcgggagggcattggaactgcccaagaggcatcagatctagtggctctggccctctccggctctccctcattgcctcctccgtgtctgaactctaccgtgtgccactccatcgcacaccgccaccacgtcctctactacgccggcctcctgatgtccatcagtctcctcatcagtaccggtcgaggagaggccggatctaggcaacaccaactcccgagccgcctcggtgccctagctgttgtggcatagttgggggaggaacagagtgccatgaaaccgtcgtggttgcggaaactgcatatgtggacatcacatccatgagtaaaattattacttcggataacgtgaacaaatctcaaaagttcattatttttttaatctaataataattttaggtattcactgtataagtgatttatcgtacataattttccatggttgcctggcaccagttgccacccgcggtgtcatactgagatgatgcatgagactgcaaccggccggaagtgttccttcctggcttcctcttctaccgggacgcgtcagatgaagcactggccacgtcactttcgttgcagccattgttgttgtcagcgtactagcgatcatttattcctcggcgcatataggggtacaaacaaagtcaaagggctccatcgaaactgcgtaatgcgtgccggtaagagcctctcctgcaattgcccgctgctagcaaatgttgtgcggattcttcctcatccaaatgcagcaaatggattctatatagcaacgaaatgctaaatctcagccacctcttaacggcaagacctgtttcagaatagaaaaatgctaaagcaatcttacttgaattcagctgcgttcgcttctaaaactaaaactttagacgataactttcttgtttttcgttagtttttctaaaccgtaaaatgatgtgtttttttaaaaggttttttctaaaccgtataacaattaatacttgattaattatatgttattggattattttattttacatgtcactgaaaagctaaaccgaattacatattcaaaatatgtactccctccgttttttaatagatgacgccgttg

SEQ ID NO: 10631 - DNA, 8146 bp, Oryza sativa
atctattaaaaaacggaggtagtaattcgaaatatgtctgaatcactcttgtaaatttactactccctccgtcccaaaaaaagacaaaccctgcttcccgtgtccaatgtttgaccatccgtcttatttgaaaaaattatgaaaaaaataaaaagacaagtcacgcataaaatattaatcatgttttatcatctaacaataatgaaaatacgaattataaaaaaatttcatataagacggatagtcaaagttgaacacggaaacccagggtttgactttgtttgagacggagggagtacattcgaaaggaacctctagaattgctttgagattgagtaaaagaatatgatccctcggtcttctaactccgttccctcttccttgttgctatctctattatcacatctatcttacccattgatttttcggtttcaaaaggtgtctaaaacactagaaaacatttttttcgtctattataaatttttattttttgcttcattaattttttttcacttaattgtagagcaaacaatggaagcacataggattttggaaagacataacacattctagtgttatgaatctggataggctctctatccaaatccgttgtattaggatatgttatatccctctaaagttactcatattatgggattgagggagtacctcttaaaacatgcccctgtgttgtggcatccgaggggaatatctcaacaggttatttccagaaattaaacaacaatattactagttcgagaaaacggcagacgcatatgcagcgtgaggttagtcagagggagcaatgattatagtacaccaatgatcgacgcagcgttaatcagtgtgctaactgattggagtggccgtagtcgcagtagcagtgatcagcttgggatcgcgacgagattatatattttcctttaaacactcactcatcacttgattttgaattgaatcgttcgacacgacggtctcgacagtgagaggaggaagaagcttccaatatctgattaaccgattaattaatcctgtattatattgacatcccaacgtgatgtgctcatgtgcatatgcatgtcgacaaaatcactgattaattaatttactagtttacttactatactactgctgcaaagaggaggcccaagctagcaaaagctttacagtcttcatccctgaatattttctcaattcgatctgcagttgtaacttgctagctatctgctctctactaattacaccccaaatcacacatacagcctctcgacttatgtaattagacgctggattaattatgtgaatttgctaatagctagcagggatatgaaactactacaagctgttccagcagcagcagcagcagcagcttcagcttgactgaattcatgctctcccaggacctttgggagggtcatggcggttgttgggtcctgacccggggtagtcgttcacctccacgtccatcctcgccgccggcctcctgccgagccctctcgccgccgccgccgccgccatctcctgcaagaacggtcacaagccatggtcagagttgctgtcactaacactattagtttgattcagaatttggcttcgtttcagaactggtttgagcactgtgctgcccgtattctgaatagtgtttgtgattttgcagcaacaaagtcgacaaacttaaattggagggggaaaaaattcagagattgcaggggatgagaaagattaattacatctggagagaggttcagagacggcgggtgttgctgctgctggctgctcaagtgcaggcttcctgcaaaagcaagaacgaatcaacacacaaatcacaatcaagaaacagttaagcacagagatcaagaactcgagggagaagaatcaagaaacagctacccatcaacgaaagcttactcgacatgggcaccgaggagacgagcagtgggaggaggaggaggaggcaggacagagccaggacggcgacgaggtcacgaggcctcctctccattgcgcggcgcatgcaggagcaaaagcagaagcaaaccgagccagacaaagccaagaacggccgcgagggcgaagagctcgccgctaggtgttcttggtgtgtgtgtgatctgtggtaggatgagacgatggatggatggatggatggtgtactgatggtgtttattgctggctgctgctgccgccttggggttttatagttggaccatgctagctaggcaggcaatggctctttccattttgttcttcttctctctcttaaaaggtcaacttcacatcagtagtactccatctagttatgacttatgaggaggaaaaaaaaaggtgtactccatcctagccgaatggctttaattagaagaaggtggtgacggatgcaatgtgtggtcatgactcgtggactctggtggggctatagagccttcgcaacacgtctatgtggcgagtggctttaaccggccacgttggagctgcaagtttagctcgagtcaagttgtgtccctttagagctacttctgacttgcagagagcacatgtgtcttgtttgacgagggcaatcatgtgtttgaagctacgtctcgccgatcgtgttggatgagcccatggctctaagctacgagaggtggggccttgatttagagctgggaggaggcggtggaggctaaaaagaagacaatggtaaccactgggggtgagggaagagaggacaaggaggatggctaatgactagggagaagaagggcccacctactacggatgatgccactagatgctccactaccccaatccgatctgccgttagggagcctgccgccctattttgctctgtgcaaccccgacatgtgcaactgccgaggagcttgttgaccacatgcgtcgccaaggtgcttgttagttagatgcactgccacaagggaggtgatggccatcttcttcaccggtgaagagatcaatggaggtggcggcgatggcaatggaatagcgaaggttcagatgaggatgaccttcgcatggccaggtccgtttgcgaacgcttgtcctacttgctgggagagaagaggcagtggcggtggtggaagtagggatgaaaatggagcgaatatagacggataatgctcatatcatatttgttttcatttttttttgctagatatgaaaacgaatacgaatagctcggatacgaaaataaatatgaattatcttgaatacaaataacgattgaatatgatcggacacgaatacggaaatattttttttttcttggaacatgaaaaccaccttaacttctaataaaaacaaatatcatcatatataattagcttgttttatataaaatatagtataatttataaaaaatatttaaaagtttaaataatattaatagtgtgtattagtgttaagagatgagctactattaaaatctaaaaaggtagattgaaggtcgtagagttataaagaaatggtgtatgtctcacgacttcagcagatatccgaatagcactggtcatcgaatatccttatctgtcggaaaccccgataccatatctatcggcggaataggtcgtgactacaatatttacatagtatgatgatcgttgggaccaatatatacacgatattgagataaagagatggataaaagaatttttatacaagttcggatctcttaactgataggtaatagctctactcctgttggctgaagccaatgatgctcttatatatctgtatcacatctttactattataaaatttaaagatgtttttgtcgagatttttgttcattatccgtatttgagtgagtttttagtcgcttaaccatttggtccgtttatatcgctgaaaattaattaactatttgtatcaaatacgaatacggtgaggtgtcgtggacgtcgaatttgtttatgccgatgaggtcacatacacgtatatatgtacgacagtttggagtttgagtcttacattttcttggtacgtgccgatcgatcgagctgtccagcagccatggacgtacttcgtttttcagatttgcaacgtgaattatatagtagtatatctctatctcttctctactgatattttcaccgggattttagtatttcatccgtgtttaaattagtttttaagttggttttctaatcttcattttttattatatttattgtctctatgtcttctctacctctacttctctatctctatctctatctctatctatatctcttctctactactacctccgttttttaatagatgacgccgttgactttttctcacatgtttgaccatttatcttattaaaaaattacgtaattataatttattttgttatgagttgttttatcactcatagtattttaagtgtgatttatattttatacatttgcataaaatttttaaataaaacgaatggtcaaatatataagaaaaagtcaacgacgttatatattaaaaaatggagagagtattataaaagatgttctatagctttgatacgtcgggtatcaccgattcaaagattgccgacatgaatccaaacgcttccgttgctttttttttcctgcgctcgcatgcgtttcacttttgcttcgtctgcagcacatttgccccctccgattcggttttactgttgccacgatcaagcgagatggacttggcttgtactccgtggcgatgggagaggtgtgcgcctggttagattggaaggaaatactgatggagatggcctgcctgtgcatcgctgcatcgtttctttttcagcccagtcaagtataattaatagatcccaacgagcaaatatatctgttcacctcctgttatcgtgaaaagaaataaaaactgaaaattactgatgggagacaatagcgtggcatctcttctctactattataaaaatcaaagatgcttttgccagtactttagtgcattattattgtttgagtcggtttttaagttcattcgcttttgaaaatacaaaagaaattgtataagaaactttttataaagaaacttggatgctaacttgagacgaaagttgaactcctaattgcagctcatgattttctttaaaaaaaatccatgcgaatatttgggacacacatgcattttttctagtaagtataatatttgggctaacctatctagccatcgtcaacttgatggcgtggatctccacacatggtcgatgacaggtagtcttcttcctcgaacatgaacttggcgagatcagagataacactagatccctcttgtcagcctctgcggctccagattgggtatatctaggcttatctctgtgtttgtgtctggcggcgtgtattgatgattgggcctccactttctcctcccagggatcttgtatttatacccaaatgttcccttgtccatgtagaactagggaaacaagaatgtatacaatctgagtactccttatagtttccaatattaaaccctgcttcttcttccttatctggaacaccttccgtatgcgaggcatgatttcgtataagacttggggcctgtttggggaagtttctagcagctcaagcttctcatagaatctctagttgccagaagctcccccaacaagtccagtttttacccagattatgaaaatctgtagttataaaatttggaaaatgaactagaagccagaagctgggtttcctagcttctccagattctcaccagctagctaatcagcagctgcttctcagaatcttaagctcccccaaacaggcccttggtatatggtaggtcctgccgagcttaacccaagatcataggatatgccttatctataaccttaacaatatccgtattcttatccggaagaaaatatatgtatccaaactatccgctccggaaggtatctgtattcatttttctctgggggtggcaatttccccattggggccagggaccctatagggccacggtgggttggggggagggatgattttcacccggggttgagcggggacggggccccgcaaatttccggggctggggcagggattgtaaaccacctgcgcggttgcgtgtgacctgatggggcctcgggatatgagatatgtctcaaaatgtagtccattccaacaatacaagcccagttggcctagtaagtgagacatataaaaggtaaatcctaatctcccaatcccccatcccctactcccactcccctcacccatcctccacagctgccgctggctggctgtcaccgcgtcacctccacctccgctcatcgccgttgtttccactccgcctctgctcatcgtcgcgctgcctcttgcctccgcctctgctcgttgccacgctgtcattgttcgtcgccgcgccaccgctgccgccgcctccgcttggcggcgcctcctcctcctgtcacacgacggcgcatccaccagccgcctcctccaagaatcctctcctgcaggtgcagcgggcccccggtcgagtggcggggcctcgggggggccggcggtggggattaatttcgacccatcctccacttcagggcctaggccgggtggacccgcaatggagcgggagcggggccgttacaacccaacccggctctgccccgccccgttgccatccctatttttctttggaatggacggaaactatccgctccattttcatccctaggtggaaggggataggccagggactttgaatgtgccctaggaagaagtgaattaatttgtgccctatgtgacaggaatacaaactttcttttatctcttctttgaatgtgcattcagcaaagaatgttggcttcaggtggttatagtctggcactagaatttcaatttgggagatatgcttcaagcagcaaaagcttcatatacttcatctcattttgtggagaaatttttatatggtgcttggcacatttggaagcagagaaatggttttatacttcatcttattcttggagcctggggcactataatcttattttttaggtaggtttctcggggacatttgaaggaaaccaaacggcattgacaagacggttgaatgacaatgcaaaaaggatgtagaatggtagcaccgtgagcccctccttgtactataatagaaaagggacatgctagaaaaaagggctaacttgtgtctggtttgaaaaaggcaaagtttgtatttctccagatatagataccaacaaaaagaacatgagtagcgtattacacctctgagtggcctgaacctgtataaatatcttgtgttcatatgcttggtggggtgctcgggccccacaaacttgttttctggagcatcgtgcgcaactagctcctggtcggatctttatttttggggaggggtctacacttccccgctgccagagaatcgctccttcgataatgttagtataaaattagttgttgggtcaaggagttacttctccgcaattataagtcatctcttatcttgagccatttgataatgttagtacaaatatatcaaccgttggatcaaggagatacttatccccattcattagtcatccccatccctccttgacgcctttatccaaatacacatcatgaatcatactaagccatttgatcatgctagtataaaatcatcaaccattggataagggagttacttatccacattacattttagtaatttctaccccttctctccacctttaattagatacatatttgattaaccgttggatagaggagttgcatatacatatttactagtcgtctcttatcctaagccattcgattatggtagtataaaacagtcaaccatttgattaaggagttatttattcgtactcattagtcatctctacccctcttatctacctttaactaatacacatcatgagtaacctgtcatttgatcatgttagtataaaataatcaaggagttacttatctgtatttcttagtcatctcatcctctcctctctacctttaataataactatatggtaacacctcctcatgacctatataataccaccttctcgtgaccaatatagttctgaccaaaataatttagacctctttatgggtggtgtcggtgacatggggccgggggtatcgtgactagaggcttgggtagccgcggtcacccacgtggcctgaccccctcggggggggggggggggggg

SEQ ID NO: 10632 - DNA, 19505 bp, Oryza sativa
caggcttcagcgcaagcatggcaaggaagtcgctggccattgaatgaaggttgaaatgggcgtccaccgggaaagctggcaagcggggcaggaggcgtgtgctctgcttgtcagaggtcacttccggctgtagactagccctcattgtaaaaagcatgtttcctttcttagacagctagaggcccatgtggtgacccctgaccagatcaaaaggaggcccaggcctaggaggggaaaaaaagagaaaaaagagaaagaggggttgggactctggcgaaggggttctagagcctgaactctctctcgctctccggctctctgtattccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtagggggtgcgcgtgtctttctaagccctcgtcctctttcgtgtgcgccaagcttctcccgctcagcccaatggccggacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgtgacttcgccgcccgcgggcgacgggggaggacggcgagacggggcgcgtcgctgcctcgtctacggcgatggcggcacgccccagggcgcgctccaggctgcgggtgcgctcctgcgtcacccgcccgtcgtccccgatccagagactccagcccgacgttggctggatgacgtggccgacttggtcatgacggcgcagcagcgcctaggcgccggcgggcggtcctccgccaccgaggcctctggcgctgccgccgccggctccatgtcgtcgaggcggagggcgcggcgagcggcggccgtaacccgccgttcgtccgccattccctcgtcaacgcctccgacccaagaagatgtgcgtggggggccggatgcccgcctcgatatcgagcgccggcgcgacgttcgtcgcgccgcccacgcaacggagggcgcttcctcgtccggagcgccacttcggtccggacacgggggccggccccccgtgtccccggttggcggtgccggctgtcgagccttcggaacgtccgttggcccccaaggttccggcccaccatcaccgaaaaatacgatggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagtagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgtagctttttgagctcgcggaccgtgtggctcgcaaggaggaggcctgggcctggaactcctccggttctggtgtggcagctccggccgcccccgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagagacaggagcgccgtgagggcaagaccccggcggctcccgccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggctgcggcccctacccatgaggcgacacggcgggtgcggtggtcggaggttgccctcacctttgactagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctgggaggcccgcgttggtgaagttcatggcggcggtccactacgcctatctccagatgaagatgtcgggccccggtggccccatcaccgtccatggcgacctcaaagtcgcgcttgcttgtatggagcagcgcgcagaccacctcgccgcggcgtccaagcccgcgggtggcgacgagaggctcagcacctccgtcccggccgccccaaggcagcggatggtcacgtgcgacgaggtcccggtcaaggaggttgccctgggcgatggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagagtcgcatggctagggaggatgaggaaaaaactgcattcattacccccataggaacttattgttatacgacaatgcctttcgggttaaagaatgcaggtcctacttttcaacgtactactcgaatttctttgagtagccagataggacgcaatgttgaggcctatgttgatgacttggttgtgaagtcgcgcaaccaagataccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgccccaccagcaagcttagggatgtgcagtgcatcaccggctgcatggccgccctaagtcggttcatatcgaggctgggagagaaggcactacccttatttaagctcctcaaacgctccgggccgtttacctggacggaggaggctgagcgggccttcactcagttgaaggcgtacatcagttctcccccggtcctggtcgccccgaagccagatgagccgttgctactctacctggcggcaaccccgcaggtggtcagcgcggcattggtcgtggagcgcgacgaggacaaccctcactccgcgcatccccaccctgtatcggctcgacccgggagagagcagggaggagaggcccccgagccaaacggcggcccaaggcccccgacggccggagctggccctccacctgcttgtccgacggtgccaggcacccccgacccccaggatggccccagggccactgcgggaaggccgcgcctgtcgccctctgaccccgaggtcgtcggcacagaagccgagtgcgccccgcgtggcctctcagacgaagagcgccctggagatgcggcccctggcgaagaggatcggccccgccgaaaggtgcagcggcccatctacttcgttagtgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggttccctgtctcttcagggcgcctgtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtacggcgtatggagcgccatttcgacgggatagagctttggcacatgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccacggcccgtcggagtccaagcctcgggacccgaggggagcgctcccagctcccctagattgattgcttggatcactgagatccaggcgtacctcgcagatgagactctacccgaggaccgcgaaaggagtgaacgcgtccggcgcatctccaagcgctacgtgctggtggaagggaccctctatcggcgcgcggctaacggagtcctcctgaagtgcattcctcgggaacaaggcgtcgagcttcttgccgatgtccatgaaggcgagtgcggagcccactccgcctcacgcaccttggttggcaaggcctttcgccagggtttctattggccgacggctctcagcgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgttgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaacacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggaactgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagattagcttcgtcgagacgacctcgactatctggaagagcgaaggcggcgcgcggccctccgagccgcgcgctaccagcagagcctgcggcgctaccatcagcgccacgtccggacccgatcactctgcgttgacgacctcgtcctacgccgcgtccaaacgcgtgctggactagcaagctctcaccaatgtgggagggtccgtatcgagtgatcggcgtcccccggccgggctccgttcggctggccacgggcgacggcacagagctgcctaacccgtggaacatcgagcaccttcgtcgcttctacccctagtgggggtcgggtgtcatgtctcaggctcgggccaaccccgcacccccccgggcgtgcagggttggccgggggctaccacatgcatatacttaccttttttctcttccgtatttcaataaaagcatttttgatttcctgaggactgtgtttgtgccatcgtttccttttgaagaatcttggcttgaattagcacgctcgtgctcgaccctgccctcggtggcccgagccggctaaaatcgccaaccggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacacagaaggaccgcggcacaaaccatcctcgtctcatacacacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcgtcggagtcgagcgcgaatgcgagccgaggggccgtaccctcgaagctgtggacgatgtggtcagcggcgtcccggacctgcgcgcgcgcgccgtcctcggttccaggagggaactcttccagcgctgcccatggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgcccagaggtccgcctgccgcccggcgcggtctagatgggagacggcgtcccgaagcatgccgggccctacctcgctcgccatgcggagggcctcgacctccccggcggacgagtccagcgcgccctgcagctcggcgatggtgtgttcagcggctgcgaggcatgcggctaggtcgccgtggcccgcggccgccccgccgctgtgcgctctcgcgtccagctcctttgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagcttgcccccgctcggtgagcgcgtcctcgcggaggcagagtccggactcctcttcggcgcaggcggcctcgtgcgccgccagtgttgcctcccgggtggcaacggcggcctcgcggtccgccaggtctctctccttcacgtccagggcgtgggcgcgctcctccagtgccgtggcgcgagcctcaagggcctcttcgcgctgccgggacgccgcctcgttctccgccgcccgccgttcccgggcagcggcggcgtcaaggactccccgggcggcgtcgagcttctcctctagctccgccgcccggctcccgtattggaggcggaggtcgtcccgcgcctcgtcaagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacacgcgcccacgccgcgtcgagctccgcccgctccgcctgcagggcctccatctgggcacttaacccgtccagcaccgtgctgttcgcggcggccaaggcctgcaggaggggctccgcgctcagtggggcagcggaaggcagaggggagagccgcctcggtgtgggtgccgcgcggctcggcccgccgatcgacgagctggactcgagggcgtcccccgaagctggcttgtcccaagcgtcgcccgaggggtcgggcccgagcggcgcgcccgcggcctcgtcgtgggtagcctcggaagtcgtcgtcgcctcgggcggagtcgggtcgggggcttggcaggtcgcctggcgcgcgcgggccgcctctgcctcccggacggactccccggcccggcggagtctggcctcctcccgagcggcctcctcagcctggcgaacccggacggcctcttgggcagcctcctcggcttcccggaggcggtccgcggcttctcgctggtcagcttcccgcctccgggcctccgcggtcgccgtctcctcggcctcagaccggctggacttgaaatggcgggggggaagggggggggggcgcgacgggatctcgctgaggcagaagaaaaaccagaagacaaaaagaaacgggtgagtgaaaactcgccttgggagatgggagaatgaatacggccgcggtgggtgcggggacgaacctgcggggaggtcggctaaacgaccacctcgggggcgagatgaggttcccccggcatggctcggtcccccccatcttgcggagccgtttcttctttcgctccccctcgggctgtggcgtcggcagggcaccctccgggcgcctgctgctggcacgcaccgccccgccccctcggggaggagatgggggaggggtaccctcctgcttcctcttcccccgggcgtcggcagggcggctgccccccgggcccccgtcaaggggcccagaagcacgaccccctcccggggtagattgttcccccctgcggctcccgcccgcgccatcgtggcctcggggggcccgctcccccgacgccccgaccacctgcattatggccaggatcttggcgcgctctggatcgcagcagagggggaggaccccttgggggatgagggatgcctccacggagctgagattcagcacccgttggatcaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccaccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagtcggagagatgggcgcaccccgataaacatctcgcacaggtgcgcgaagatggccaacgtcattatcgcgttgggggtgaggtgcgccatctgcagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgcttacgatgcgggaaggcggcagcacgctaccgtcgagcggtgcggagccccgtgccatgacgccggcggaggaggagcttgagagcgagcgagtgcggcaagggtagggcacaggaaacgaagagttagagcgcaagtggcgaaggcaaggggaagagtagcgagaggaaggaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagatcgtgcgcgcattaactacgctcgccaaccgtgaaaagcgccatcatcatgtctccaggcgaaacgagccggctcgttccgattcgcgcgctgctcgagtaatgtagcggtcttaaagaggccgctcattattgtcggtcggttttcccttgccgatgcgcgcgatttgcgaccgctgggtttctgcccacctgtagggaccggccccacctgtcaccgggcctaaggagtggcgtcacgcccgagcgcttccctcgaggggggcgatcaccatggcgtaacgccgggggctactgtcggtgacatggggccgggggtatcgtgactagaggcttgggtagccgcggtcacccacgtggcctgaccccgtcggggggggggggggtcgggcccgagggtgacgtggccacccctccctctgtctccccgaggggtcgggccgctcccgtttcggccccgagggctggggcgcccccgtttcggccccgagggctggggcgccccgaccccctgtggttttggcgccacgtgtgtgggttaggtgagcacagcggggctcacctaaccgcatttatagcaggatggacgagcgcgccacgccgcatttaatgcggcgcagcgcacgcttatccggtccgtgaccggtcgcggtgtgtgaccggtcacagaccagtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagtgcaagcatggcaaggaagtcgctggccattgaatgaaggttgaaatgggcgtccaccgggaaagctggcaagcggggcaggaggcgtgtgctctgcttgtcagaggtcacttccggctgtagactagccctcattgtaaaaagcatgtttcctttcttagacagctagaggcccatgtggtgacccctgaccagatcaaaaggaggcccaggcctaggaggggaaaaaaagagaaaaaagagaaagaggggttgggactctagcgaaggggttctagagcctgaactctctctcgctctctggctctttgtattccttcacacacagatccaccagaacacaggagttgggtgttacgcttctcagcggcccgaacctgtctacgtcgctcgtgtcttgtgcacttcctctctcgctgacgttcctcagatcgagggcgaagaacctcacttagcgcccccggccgaaccggcaaagggggacctgcgcggtctcccggtgaggagccccacgctccgtcaggtggcattcgccctgcctcgccaatgccaatgatggtgtgctgtgtcggcttctccctgaagaagacgctgcagaggatgactccgacgctgggatacgacgacaaagccctttttggaattgcatttgacatgccaaatgttttttaaatttgtgatggtggaattgaactgtgaattttcttattagaggatattcaaatctggattttctttttttttacactagaaattatttttgcatgtgggtgaattaagcatgtcgcctgtgaaaaatcaattttcacaagcggatctcttagggtgcccacctttgaaaaccgtcgattttcacaagccttcaatcgcagacggggcgtctggcaatgtgcaaaattgcattttggccacctcgaaaaatcttgatttgtagtagtgcactcaacttatgtaattagatactttattaattatgagagttgctgacaactagcagagataatgcgaaactacaagctagctagttccagcagcagcttgattgatttcattctctcccaggtggacgtttagggttatggcgggggttggctcctggcgccaggtagtcattcacctccacatcggtcgtcgccgccaccatgccctggacggacatttctctccctggtggacgtttagggttatggcggggattggctcctggcgctgggtagtcattcacctccacgtccgtcgccgctgccaccatgccctggacggacatttctctccctggtggacttttagggttatggcgggggttggctcccggcgccgggtagtcattcacctccacattattcgttgccgccgccaccatgccctggacggacatttctcttcctggtggacgtttagggttatggcggggattggctcctggcgctgggtagtcattcacctccacgtccgtcgtcgtcgccgccaccatgtcctgcacggacatacacaaagccatgttcagaatcactatcaacattactatttgtttcagtatttagcctccagaacgtacatattcattttagaattggtttgtgaaggtagctatgaactgtctatgatattttattaacaggccggcaaatttaaatattaggggaatatagagattggaggacttgagaaagattaactacatctgcagagatgtttggagacgacaggtgttgctgttggctgctcaagtgcaggcttcctgcaagaatgaatcaaggcacaaattataattagcatatagtaaaaacacatatcaagaactccaggagatcaatgacgacgaagcttacccgacatgggcaccgaggagacgagtagtgggagaaggagtaggctggacatagccaagacggcgacgagatcacgagacctcatttccattacgcggcgcatcaggggtagcaaccgaggcagccaagaacggctgcaagaaagaagagctcgtggctacttgttgttctttgtgtagtgtgatctgtgttaggaggagacaatgatggatggattgatggcactgggatgagtagtggactcgcagtgttgctgccgctgccttggggtacttatcaaacgttggatgaagcatttacttatcaacattcatctgtgatctccttagcccctcctctccacctatatttagctacacatcatgagtaatccttatccaattgatcatgttagcataaaactagttgttagatcaaggagttacttatccgtaattataagttgcctcttatgccgaaccatttcattatgttaatacaaatatatcaaccgatggatcaaggagatacttatccccattcattagtcatccttacccctcctcgacaccattatccaaatacacatcatgaatcatactatgccattttatcatgttagtataaaatcatcaatcattggataaggcagttacttatccacattaatttttagtaatttctaccccttctctccaccttcaattagatacacatcacaagtaaatcgaaacatatttgattatgtcagtatgatattatgaaccgttggatagaggagttgcatatctatatttaccggtcgtctcttatctaagccatttgaatatgttagtataaaacagtcaaccatttgattaaggagttacttatatgtgctcattagtcatctcttctactgttctctacctttaacatatacacatcatgagtaacctaagtcatttgatcatgttagtataaaataatcatctgttagatcaaggagttacttgtctgtatttcttagttgtttcttcctctcctctctacctttaataataggaaaaagtccgaattagccccccacgaactattgtggcggtacgaattaccccctcaattcaaaaaccagacattcttcaccctcaacttttcatatcggacgaattaccccctgatcgactccagagtggttttggtcctacgtggcacaaatgtggcagtccagttagcataaaagaataaaaaaatagaggagcccacttgtcaattttgcctcttctcttagtcaccacatgtgggccctatatttttaatttttttatgctgactggactgccacgtgtgcgacacgtaagaccaaaactgttccgaagtttgtcaggggtaattcgtccatataaaaagttgagggtgcagtttttgaattgagggggtaatttcaactgccacaatagtttagggggctaatttgggctttttccttaataataccttgatagtagcatcttctcatgacctttatagttccacctccccgtgacatatattgttttgaccaaaataatgcagacctcattgcggctggcattcgccttccaccgtcaacgccagtgatggtgtgctgcatcggcttctccctgaaaaagacactgcaaaggatgactctgccactgcgcaaaggatgactctgccactgggatgccaccgacgaagttcttggcggaattgcatttgatatgtcaattcttttttaaatttgtgatggtggaattgcattctgattttcaaattggaggatattaaaatctagattttcattttttacactagaaattctttttgtatgtgggtaaattaagtgtgccacctataaaaaattgatttttgcaagtgggtctcttaggatgcttgccttcgaaaactgtagatcttctcaagccttcaatcataggcagggtgtgtggccatgtgcaaatcgcgttttgaccacctcgaaaaaaaatcttgtttcgtaatagtgcacttgacttatgtaattatatactttattaattctgagagtcactgacatctagcagaaataatgcagaactacatgctagctagttccagtagtagcttgattgatttcattctcttcttggtggacgtttagggttatggcggtggttggctcctggcgtcgggtagtcattcacctccgcattcgtcgttgccgccaccatgtcctggacggacatttctctccccagtggacgtttagggttatggcgaggattggctcttagcgctggatagtcattcacctccacgtccgtcgccgctgccaccatatccctgcatggacatacacaaagccatgttcagaatcactatcaccaacattactaattgtttcagaatttagccttcagaaagtacatattcattttagaattggtttgtaaaggtggctatgaactgtctacgagattttgtagtaacatgccaacaaattaatttaaatcttacgggaattcagaaattgaaggacatgagaaagattaactacatctgcatagatgtttcgagatgacgggtgttgttgttggctgctcaagtgcacgattcctgcaagaacgcatcgacacgcaaattataattatcaactagtcaaaacacatatcaagaattccaggagatctatgacgacgaagctttacccgacacgggcaccgaggagacgagtagtgggaggagcaataggcaggacatagccaggacggcggcgagatcacgaggcctcatttccattgcgcggcacatgcaggaggtagcaaccgaggcagccaagaatggccgcgagaaaaaagagctcgtggctactacttcgtttcacaatgtaagactttctagtattgtccatattcatatagatgttagtgaatcgagacacatctatatgaatgtgggtaatgctagaaagtcttccattgtgaaacagagggagtatttgttttttttgggtgtgtgtgatctgtggtcggaggagacgatgatgtatggatggatggcactgggatgggtagttgactcgtagtgttgggagaaagctacccatcggacgtccgatgaaaaaaaaacggatggtcaaatattgcagttggccaacaagtcaaacattaagttatatatggtgaaacaaaaaaatcagcaactgaaacatttaaatattttatgaaacatggtgaagatgcacgttgaaacaggtcgctgtcacatatgaaacagcaagtattaacggatacatgtgtttttctttcaacaaaatataatcatgcaatatcttgttgtaaagatttaattaaaacgaatacaatggtgcgatcggatcatagattggataaataatttaagagaaaaattattttgaagtttgctaaaatacatgcatgtgtgcatggatgagatggagagaaagtagtagcagttagtttcaaaaaatttatgaaaggaaaaggctatacgtactaactttttcttactaaattcttactaatactgatgtgtcatgctatgagtgcatctagatttttttataacttctatctacttaaatcaaacggttgaaatgattgttagtaaaagtttagtcagaaaaatttagtacgtgtagcattgctctttatgaaacacacggaagacgcacattgaaacatatcactatcacgcatgaaacatttagttttaacggtttgaaacacatgtttttcttttgacataatataattatatgatatcttgttgtaaatatttaattgcaacgaatacaatagtgtgattggttcgtagattggataagtaatttagaagaaaaaatatttaaagagaggaggaaagaatgaaaagaaatagctaggcatacatgttacagtgatagggttcgtccgatccatcaggccgctgatttgcagcatttttagtgtggtagatgaggcgtccgatatttctgtttcgtcggacgtgcgatataaagcgttttccatagtgttgctgtcgctaccttggggagggggggtacttatcaaacgttggatgaatcatttacttatccgcgttcatttgtgatctgtacccctcctctccacctatatttagctacacatcacgagtaatccttatccatttgatcatgtttagtataaaattagctattatatcaaggagttacttatctgtaatgataactcttctcttatgctgggccaccattttattatgttaatacaaatatatcaacgttggattaaggagttacttatttgcattcattagtcatctctacccctcctctccacctatgtttaggttgagtaatctttacccatttgatcatgttagtacaaaataaactgttggatcaaagagtatctgcatttatttgtcgtctcttaacctgagccatttgattatcttagtgcaaaaacatcaaccattggatcaaggagtaacttatcctcattcattaggtatccctacccctcttctatgcctttatatagatacacatcatgagtcatactatgtcatttgatagtataaaattatcaaccactggacaaaggagtagcttatcctcatttatttttagtaatttctagcccttctctccacatttaattagatttacatcatgagtgaatcaaaactaatttgattatgctagtatgaaattatcaaccattggataaatgagttgcatgtctgtatttactagccatctcttatcctaagccatttgattatgttagtctgaaacaatcaaccatttgattaatgagttacttacccgtactcattagtcatctctatccctattctccacctttaacaaatatacatcatgattatgctaagtcaatttatcatgtcagtataaaacaatcaatcgtgatcaaggagttacttatctgcattccttattcgtcccttcctctcctctctaccttcaataaaacctgtagagtaacacctcctcatgacctatatagttgtgacgaatataagcacatgcacgaagccatgtcatgaacaatcctaagccatttgattatgttagtatgaaattatcaaatgttagatcaaggagttacttatctgcattcgttattaatctctacccattctctccacctttaattggctacagttattaacaatcctaacccatttgatcatgttagtttcaaattatcaaccccgtccgctgccacgggaacagccgctgacactgccctaccccgctgtcgacgccactgatgtcgtcttgcaccgagaggggaagggggagggggaatcgctcgcctccgcctccaagaggagcagcatcgccttgtcgcccacctccacctcctcggttgggtaatactgtttttttaaaacctgcatgtgtctttttagtagtgttcacatttaaccagatacacataatgggtagtcctaagccatttgattgtgttagtataaaattatcaactgttatatcaaggtattacttatccacatttattagtcacctcttcctctcctctatgcctttaataaatacctatatggcaccgccacctcatgacctatatagttgtgaccaaaaataatgcagacctcgtcgtggccggcctctgccctccctcgccaacaccaatgatggtgtgttgcgttggcttctcccaaaagaagacgctgaagaggacgactccgacgttgggatgtcgatgatgacgtccttggtggaattgcattgtgaatttgtcaaatctttttaaaatttgttatggtggaattgcatcatgaatttgtgaattggaggatattaggatttggaatttcatctttttacactagaaatccttaggtgagtgacttaagtgtgccgcccgcgaaaatcaatttttttaggcaggtcttttagcgtgcccgccttttaaactcgtcgattttcatgagcctttgagggtaggccacagcgaaaaaaacatgtttcgtagacaatttataaattctaggagttgccaatacatagcagagataatatgaaactacaagcaagctaattggagcaacagcttgattgataaagtatttttgagtcatatctatgaaagtatttttcaacg

SEQ ID NO: 10633 - DNA, 31638 bp, Oryza sativa
attctgtaataaccaaatcccagcccagctttatagtataacctggatgtacatgtgattttacttcgtttagtcttattttcttcattctttgttgcctcagcttcatgacgacaacctgtaatacaacctatttcttgtcctaattaacgctggcacgaatggatatacttaaagcaatcaatgattggttttctcgagtggtacaggatttattcacgcactgttagttactccttgaagcaacaacattctctcagtcaagttatgatcgtgattgacatatgtcgttaggcttagttaaggcttaaccaatgcatgacggctttggaagctactaagatctgccttaaaaaaaacaaattctagctacaaacctctatacgtatatatctagattcgaagttaggattataattttttttacaaagaggataagatattgtacttgatgacatgttggcattgcttcaaccgaatatctgctaggagtaccatgttttacaacaatggcttccatcggatggcctattcagccaaagaaaaaggcaaaatttaaattttcaaacttaattttaacattgattttgtgatattttcaacgtagtttctttttcagcattggcttttacgtcaccgagaacacatatataaaagttttacctacaaattcatttttattctctaataagccgttttggcttattacgaaaaaagccaaacgatgaggcccacagacagtgccacagattatgaaacttttttgggtgttggggcaaagagaagttatactgagttgtatgtatcatccagttcaatataaactataaaaacttagctcataaaaaagacaaacaattcacttatactttaatataagggtgcgttcttttctaagtagctagtggtagattttcggctgcactttttcacgaacgtaagataaaccattggcgcatgattaataggtattagttattacaaacttgaaaaattaatttagttacttctatatacaatttttttttacaaaacatatcatttaatcgtttgagaaacatgctaaaaaatttcggtttggggttgatgaaaagaactcagtctaggtacattatcgactttgttgcccatgtcactcttgtttccgtggtcttggctggttgctcccaagtcaaaataatgcagcttaaagaatttgcagatatactttaatctgaagaaaagaaatactttaatttgacaaccggtttcaacgcttcgatgcaaaaactgcgtcatttggctcgtcatcttccaatcttggagatagtactgcacatcaggacattgatcataaagtcaatcacatgacaagttgctcggtaccgggtagtcaatctttttcatgtagaagtatatattacgagaataaaagctatacactttaggaaataaactaaaaatcagaaattaaaaccttcaacctttttagattctcaccagctagctactactcactttatactttgtatgctaagttctagagagcaatttacaatggcaacttactcgttcttcttcgtgaacacacttccagaattactaaacgttgtgtttcatgtaaaagttttctacacaaaaggcttttctaaaatcaaataattctatttttaagtttataggaaccgattaattatgcattaatagattattttattataagtgccgccagttagctgagccaaaatgctcgttcgaacgggcccttggaatctacagctttcaagcaggtccatactccatagtactatgtggctagtgggctatagtggccagtgccaggagcttaaatccaagcgagagcagccattggcaaaggctaatcaaagcttctaatagtctgctgagggaatcatatgaaccatgtcactgtcggactgtcatctacaacgttaaaataagtgcagtcgtgggtattcgtgtctaacgtttgaccgtctatcttatttaaaaaattatgaaaaattaaaaccaaatagtcatgcttagagtattattcatgtttgatcatctaataacaataaaagtaatactcataaaaaaatttcaaataagataaacggttaaaggttggacatgaacagtgtaaaagtgcacttattttgggactgaaggaggaaagagtcctataaaaaccaatctaggattagatgtaatgttttctattacaataaatctggttaaaagcctgtttaaattcattatactagaaaatatctcttattatcttaatttgattttttataggacaaaggaagtatgttgttggagattccattgaaacttcatatgatctcgagctggtctagtgatcttgacctggttagtcacgagtggtcgactgatagttgctgccactgttcatggacagaagaactactgatgagatttctagtactatgttgttttttttctcaaattaattcagtgtgctgctgctgctaaagtctgaaatttattcagttgaccctccacaccgatcactaaacagcacattgatgctgcagtgcagtttggccagtcaccactacagttcaggtcaaaaccacacgcgcacgcacacacaagttctctgcactaacagcagtcatgtcaataatctccatgtgattacaatttacaactcattcctgcattaaatttgactacgtcgactgccagatattttgtcaatggagatatcattcaaattaacaaatgtccaatgctgtcatcgcaagctagtgcagtgtgagttgggcggcacaagcaagcaaacaacgagcagtttagacattctgaagcgtttgcataatgacaagatttgatttcgttgtttgttctcaagtgatgtaagaactagaaaacttttaagattcctctaaagaaaaagagaacttttactatcgctgtgatgattcaacaagatttgacatgcgtaaagttaggtattcctttcgtctcaaaatataaaaaaaattaattgaataggatacgttctagtactacaaatctagagctatttataagatatgtctcatcaaaccaaaatatcttatattttagaacaaagggagtaattagagaaactataagagcatgtacaatagtagactataagccagctataaacatattttaagaagataaaagagaagagataagagcagcgggctacagatttgtagccagctgcagcatggactccaagatacatgtgtgtatgataggtgggatcagacattaattatgtagcacatacttaaagataactatggtatgaattgactattaaattaactatatatgatttggagcccataatcggctatactattaatactattaaacttgctctaatatacagtttaatctggcggtaatgcatgcatgcaagaaaaagtgatgagccatatgtgcgcaggtgattgatttggcgtcggttccaaacacatttaaaagcaagtttaatagtatagctaactactgactcaaaattatctgatatagtcaatttaatagctaattcatataatagttatctataaatatatactatattattaatatttggtctcacatgtcatacacatattgcgttttggagtccatgctgtagctggctataaatttatagctcgctgcttatctctcttctttcatctccttaatatgtgtttatagctagtttataatctgctattgtacctgctctaaaaacatgattgtggggttatgtgtagtataataagcatctgcgtgtgaaagttaaattaaaaaaagtatgatcaatctattggaaattgtgtcgatagccaactattatatgtatgatctcttggtcacctgtaatatgacgtaacgcttttaattgttgacagttatgtattttatacactggacccttttgatttggaggaaaaacatagaaattttaagataacttttatcctatagaaaagatttcaaagatggctttgaatcaaaggattgaatcatatccaatcctttgaaatccctattgaatagataattctacagagatttttgtagaaacttagcaagagctcaaaactcttagaaaatttcctttgagtttatctttctcatatgatttttttcctacggtacaatcacatggtatttcctgtattttaaattatttgtttcacacttctatttctgttagaataatgggtttttcctattaattcgttttcttgttcctactatttaaattggccctaatctctttttttaaaaggaaaattgactctaatctcttactggcgtactactccgtcccagaaaaataaattatagctacgaacctgggcacatatatgttcaagttcgtaactaggattgttttttagactgagagatagttattcaagttcgtagctaggattaggattgtattttttagatagaggggtagtgctgctgctaatagcattattacgttacccagaaaggttaattattactacgtgctttgatcatgattgttttttgtggcagtaagaaaatttcttgtctttgaattcgagtttagtggatgcatgtctgcatattgcggctattgccgtactactcggctactcctgctttcagatcgatttaatgtttggctgagtataaagtttaaattttggttaaaattagagatgatgtgactgaaaagttatgtgtatatgatagattgatttaatgaaaaatgattaaagtttggatctaaactttaaatctaaacagcctgtacagtggccgtggaccaactgaacgtacggcgacaagtggcatggctcactagaaaaagaaaattcgctgtcagcttcactccggatcggacggccacgcctccagtccacgacttttttgatcgcacgtgttagcttttaaaactactctagctcgggtcgcacgtgtgaatggaagctgtttcgttcttttgacctcatcgattttgtggagcaacagtacacgcacgatggaaaacgcacgtcgtttagcgagcgtgtctattgacaacccattttaagagcgagccacggagcaaagagcgtgttcttaatactctggttgagtttatttgttcacgtttttcacttacttctctcgtttttcatgcgtatgttttttaaattgctaaataatacgtatttaaaaaaattatatacaaaagttgtttaaaaaatatattaattcatttttcataaaagttcagctaatacttaattagtgataagttaataaattacttcattttacgtgcgtgagatgttagttcctaacctcgatcaactaaagaactcaacctaattaatgtttttgatttcgccacgtaatatagctctaccttattacttttaagggattttcttattgtgatttaaaagagttgtgcacttcactgatcggtctgagctgactcaattaatctatcaattctaaggttcggtttaagaaatatactctatgaatgaacactactacagatcaagcgatcgaaatcgatcttcgcctacggttaaacggtccgtgatgcacgcaggtgtttgtaaaaatcagtattgtctcgtgcatctcatccttgttcaaacatcgacatttgaattctaaaaccttaacatgtggctatatatgccaccttataattagtgggtggatgtagtgggagaaatcacaccttaattagtggagtggatgtagtgggagaaatcgcactacatggagatgtttgcgtatatattcttcctatttaagatagagaacgtacgtatagaaactcctcgtgtggcatggcacgtcctaccctgttcttaattgttctctactgaagtgttgcgtgctcatcgtgaatttagctagacactgcacttacatgataaaatgaaatgatttgatcagtctcactcgcatttcattctcacggaggccggccatacgttacggcgagttagtggcattgtcaattcgtttgcaaatgcaatgcgtatccttgtcaattaaattgccgtcttgttgaaaaaacgctgataatgtgtggtgtatgcatgtgctaggctagtataacaatacggcgctgaaaaactgaaagttgtcccagtgagagcgaactgaacattgacggtcaaactatgacctttgtctcgaggagattaaaattacgagaaacagtgggtaagaatatggagaagccaacttttagtttatagtttattttataggttctactagggttggcaacggggcgggacggggcgggtgcgggttggataggaacggccccgcctccgcatccttgagggttcacccggccccggccccggagtgaggaacggggcgaaatcaatccccgcccccggcccctccggggccccgcaccatttccgggtccccgcacccagatacaagcggcgactgctagcagccgaaggaaggaaagaatggtctgggaaacttgcagcagccgggtggaggaagggaataatgatgtggggaacctgcagcagccggagggagaggaacggtcggagaaggaggagaacagcacaggcgccggcagctggagaggtaggagaacgacatggggcgtcggcggatggcaagatggggagacggcgtccgtgagagcaacgatacgggcagcgtggaagagcgccgaccgccgctacttgatggtgcgggaccaactcgcgaggcgtgatttgtggaggtgaggaagcgccaaagcggcgtgcggcgtgtgatgtgttgcgtgatttgtgggatagcgtcaaaagtcaaaactactggaacgagaatagagattggtggcggcggcgacaaactcacgggattgattttacggcccgtttggttggagggagtttttaagaggaattgggattagagggatgaggctattaagtattttgtttggttgggagacatgggaattttggtgggattgggatggggaattgaggaagaaactccctccttttcaatacctgggtaggggcaggtaattgggagggaatttctcctttactttgtctaagcaaatctcagccatccgtttttattaatgagctaatctccaactaaactccctatcagtttctatcacatctaccaaacaagacattgggattaaaaatcaaattcccatcttaatctcatcataaattccctcgtgtaaactcctaatccccttccctcaagttaccaaacaagtcttagggttggcttctctttactgatctgtatatatatatattgggctatatgggcctaaatttgattatgggctgtatgccatattttagatccctatattccggggccccgtgggtcacccgcgggtgagcctgtggccccgcccccacccccgcatagttccggtgccccgtccccgcagccccgcgggttgaaatttcgccccgtccccgtccccgtaggggtgggtacccggcgggtccccgcccccaacgggaaaattgccatccctaggttctacagctacagctttttagaatctgaatgaaaatctagattgtttgagggaggatttgataactagtgcttctagaaaaatcttcagctactaaaagcttccccaaacaggctctatgtccgttctttctagtacttcatagaactagtaatttacccgtgctaatgctacggtgtaataatattttgattaataaattatattattaaatttcatgttagtcaaattacatttctagaatcagtctcaaatgttaatttaagacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacgagtgcgcaggtgtggcggtggccggccgtcgacggcgacgcttcatattgaagactactagcaccgtggatgctcgccggccgttttgcccctcagcttgtctgctggcaaagtcgtagactaaacagatggagtagtaaactaaatcacgtctactatttatttttttcctacttaaatattaattaaaattttaagtttgatcgaatctatagaaatgaaatgagtatagctcaactagattacttgtgatggaaacagctcatctgagctcaaatcatagaattgacatatatacttgtatttacggctaattatattttcagtgataggcgacttacccatcgacagataggcactcgtggtgacttcgttaatctcaggatatgccgaccaagtcttctatcgacacccatagtgacttcgtctcatcaacctcaaaatatatcggtctagtcttctattgacgcccgtggtgacttcatcgatctagagatatgctggtccagtcttctggaggtgctcataggagtgggtgtgtgcacgttttgagcgcatgcatttattctgtgtttctcaaaaaatatagtacacgaaacaaatatattatcaaaatatattaaatgttaatgtgtttctagaaaagttatagaaaaatataaaaaaaaattttgacacaaaataaatatattataaaaatatattaaatgttagttttaataaaactaatttggcgttattgaccttgctaacttttttttaataaatttggtcaaagtgaaaacaatttgactacgaaaaaaaagttagtaccaaatatacgcacttcaactcaaatataaacagaccctagtaggaagatgctctctcagatgatgtaataaaaacgaagagctattacaaaatggggaaaaaagatggttaagcatctcgcagaagaaaatgaaaaaaaaaagcctaagcaaagcagattaggatgggccacgggcccacggaccatacgcataggattcaacctgacggcccacatgccgatggatcgggcccatataggcctgttcctaacttccccaatcttaagcccggcccactcgtgagctctcccccgtctcataagaaaccctcgcggagcacacgctgctcccccctctccctcccgcgccgccgccgccgccgccaccgccgcatcgccgctgccgacggctgcgctccgaaggtatcgcgtcgaaatgctcttcgtctcgcctctaccaccgccgcagatagttcttgcagcgtctatgcctctgctgccctttacatttccctcgagcgactagaagaattagggcgggttggtcgttgcggcggtcctaggctagattcgagaagaagaagaagaaatgccggagatccttgagcttgtaaatggggatggtttcttcttcctctctcttatagttgatcttgacacggtgtagtgcggtgtatatacatctgttgctactcctttggaggcaggattccggttttcttgagtatgtgacaccgtggtgattccgtttgatttgatttaccatggctagctgcgcttctttgatagattctggattatttgcctagatgcgtgtgaaagcaccggtactgaggcgctatggccattgtgatggccgtagcagcctattcttttgtgtgctatatgaaccagggaacccgctttgcaggggagatttgtcccatgtttcttctgccagtagtcgcccgacagttcacccctttctggggttctggattacctgtagtgtagtgcgatgtatatacatcggttgctactcctttggaggaaggattccagttttgtggagtatgtagttattctgtttggtctgatttatcatgactagctgcgcttctttgatagattctagatttgttagatgcgagggaaagcaccggtactgaggcgatatagctattgtgatggcgtagtagcctattcttgtgtgtgctatatgaaccagggaacccgctttgcagggaaggtttgtctcatgtttcttctgccagtagtcacccgacagttcacccctttctgggtttctggattcctagtcatggatggtaatccgatgcgcgtatgaactgcaatgtttctggttctcttgagtgctttgagcatttgaggaaccttgtgtgtgtcgcacagtcgcactcaggtgctatggcctttgtgattgcatagtagcctagttgattaatgtgcaagatggaccagggtagtatccttgcagcaggagctaagctaagttgattatgcttctactgcctgtagaatccctacatttttaatagttaaaatttgagatgattaccctgtctgtgtattgtcgatatcttgatgtaggtttttaatgttccatgattacctctgcacaattttgttttctggattctagtcctgattcctttttcttttgatgttggaaatttggcagaattctgtgaggatttaagctgagaagatggtgctgaagtaagttcctgtgtatattttgttgtttcaatatgattgtagattgttttagtgcccttttatcctgtgcatgctctaggctatgtagttttttggttaatggtagtaaaaggttaatagcaatgatttaccaatgagtactatttcatatttggaaggtatttcaactattacttttatttttatcctacaggacagagctttgccgttttagtggccagaagatatatccagggaagggcattcgctttattcgtgctgattcacaggtcaggctgttcatcgaatgattgctttaatgtcaggatatttctctgcttagaaggttgttgtaaacgtattggtatattgtacaggtcttcctttttgcaaactcaaaatgcaagcgctacttccacaaccgcctgaagcctgcaaagcttacctggacagccatgtacaggaagcagcacaagaaggtattgtatctagatttaggcgggcgttttctcacctatatgcacatactctaactggatgacctttaacccttttttttttgttcactgaccgttgctttcttaaatttgttgggttgagccgaatgcttaaaatttgtaatgttgtattgtgcttgaaatgctaagttaattgtttcttaagctatcaaacctggattccagtaaatgtctgtttgtatgattaagtgtgaccgtctacattcaagattgcggttttttttactgtgcaaacatcatgttgattcttcaaataagcgccttgcagtgtttgcgtgcagataaaaatattgtatgtttgggtactttggatatgtctgtgccatgtagttctctttgtcagcttatgctcaattccttgtatatatgtacagttagtcatgctatgtattgcttccgatcagataaattctgtttacaccctttcccaattttctgttttttaggatatccatgctgaagctgtcaagaagaggcgccgcaccaccaagaagccatactctaggtcaattgttggtgcttcgttggaagtcatccaaaagaagagagctgaaaagcctgaagttcgtgatgctgctagagaagctgctcttcggtatgctctttccctgaatgattgccatttagactggttactggttccaacaaagtatccacccatggaatagaacattgccactctatatgggttacattttgccttcattttcactgcattagcccttacctcatgcggtgcctcttaacttctcaagcagtgttttcgtttgctgcctttgttctgcacagctcactgtatcattgcaacatgatgtttgctacccattcttattggatgtctgctcctagtgaactctctgttcatattcatgcataatcccctattgcatcttgtgtatgcataatcctccgatatacatttcgatgatgctaaaggactaaattcatctgagcttatgcattgtgcagtgagatcaaggaacgcatcaagaagaccaaggatgaaaagaaggcgaagaaggctgaggtaaccaagtcccagaagtcgcagtcgaagggtgccgccccgaggggttccaagggcccgaagattggtggtggtggtggaaagcgctgaagatttcttgatccccaggaaagggtcgcctggttctcgccggctgtctaaatcgtatctcatcaaaagctaccctgtagaacctctgttaaattagcactactgccaaaatgttttaacatcgccactggagataatgtcatgaagtttgaaatgctatgtgggaaaaatgtttttctttggttgtgttactattacgagatttgacttggcttaatgtttctgagcaaagtttgatgctgcttggcattttaatcctcttgtgttttgttcggtaaagagcattggtgttcatgtatcatgatctgaatgctcgttctgaattgacggccctagaaatcccatcgtattatattctctacagaaatataggcttttgaaatcctgttagtagcgttaaaagcgaatttgacttttaaagtttcaccattttttgcgaacgggtagcaggaaagctaaagtacgttcccttcaaacaggctagactttgtagtgtccgagtggtatttatttctctttccttatttacttgaaaaaatattcatgtgttgcaacgggtaaatgctattttaattttattattgtttacggtttagttagataaaattcactgtgggaagtcgtttggatatttttttcaggaaatcatgagctacaattaggttcgtatttcatctcatgctagcatgcgagtttttttaaagatttcttatacgactcctattatacttccaaaaggaaaacaatcttaaaatctaactcaaacacgcatctgtatttccaaaaacgaacgaacttaaaacctgactcagatacggatgacgtaccaaaataccagtaaaaacatctttaagttttaatttttataatagtagatatttctctttctttatccaggatttttgctatatgtatgagacttgatttcgtatttgatgtattaagtattgggtatcccatattcagggcattaacagcatgcatcatataagttaattttagggcattaacagtatgcatcttagtataagttaattttttttctttggtcttgcttaaaaaatagtaaatactctcttcatcccataaaatcaactactgactatgtatctaggtcaagatacacaatcaaaaattggtttttatgggatggaagaagcatgttttagacttcagatggaggaagtactccctccattccaaaatatgcaggttcttgaatggatggaacacatcacaatagtacaaatctggatgtcttaagaatttaaatgtctattcaaatttacagtagtaagatgcgtcacatccattctaaaaccctttattttgggatgaaggaagtattacttaacatattactaactgtattacgatggaccatgctactctgcattagagacgttgtaaggcagaggatcaacatgattactataaattatgggagttggcagccatccgatcaagggcataaggcctatatatctcaggccgagtttagctctaaatttaattttttcttcaaacttctaacttttccatcacatcaaaactttcctacacatataaacttctaacttttctatcacatcattccaatttcaaccaaacttccaattttgacgtgaactaaacacatcattactacactaaataaaagtgtgctacaattttcatgttattgtagataccataaatcgacggtattcattacattgatccactgttatactcacatacttcctctatctcataaaaaaccaatttagtactggatgtccagatttgtagataggatgtgtcacatccaatatgttagttttttatggacggagggagtactccctccattaaaaaaaatcaatcttaactataaatatagacacacgtgttcaaattcatagttggaccataattttcatggagaaaatgaacatttggccacgttcaaaacacggtttcgctagaatgccaccccaaaaacacggttcgataaaatgccaatacgaagcgtgcatctgttgtcactttgccattttcaccattttattcatttccaaaaagattttggctcctccgctgggtaataagacggaactgccccttatcaccctacggcgttgatattcttccccatcccctttcttcccccactctctctctccccttcggcatggcggtggtggcagtgcgagcggtgtgtttcgacaaagggagtggcgcagggacgaagcagcttcgagcagagacgcggagctcgctgaagatacatgcgcggggatgagctagagcgccatgaccactgcgagcttggcgcaccctttagcgagctcgagctcgagctctactcgtgtggaggtggaggtcatgggcgatgtttttgtcagtagcgacgacatcgcacggaacctcatcattgactatggctctggcaagatcgcgctcaccgccgcgtgcatccacttccgtatccctagcgctgccctcaactcccccttccaccactgcgtggcttcggtcctcccaacaattgctttgctgtcactaccaccgaagaagaagccacttccgccgctgtcaccgacggcggttgctaagaggagcccacaaccccctcagcctttcgtgcttcggccagtgcggcggtgtggcccctcctagccaacggagggaggcgcaagaagcagccggcggcggtgagggcgtgaggcctttttttttttttttagaaatgctcgatcccctttcacttgcgagatgaagaaaaggcaagccggaggggtattttcgtctgatcaccacgtgaacagcaaaaaaaacatttcggaaatcatgaaaaggcgaaaatggcaatgcgacgagtagcgcgcgctcgagattagtattatatcgaattacgttttgaggatgacataatagcgaaatccagttttaaagatagctaaacgtttattttctcatttttcatgggacggaaggcgtaaacaataaacctctacaataatgcccaggattcggatctcattggatgtgagaagagagagacagcgagcaaagcgaagtgaactgactgtgaagtgaccgcacttcggatgcattaactgcatcgtctcggctaggctagggctaaacacgtccagagaccaaaacgagtcgactcgtcgtcgtcgtcgacactcgagaggcacgtgcactactccactcagctcacacgcaaaacgtccgcttcgtctcgtctccctcctctcaaaccgcatcgtctctcgcgccctcttcctctcctctcctcctctcctctcactcgctcactcgctcgccgacgctgcccaagccgaagtcgacgccggcgacgccaaaaagcccgtagcccgcttcgctcggcggatcgcgcgcgcgaaccggccggtgaagaaaggggaaggggaagggagaggggcggagagcgccatcgccgaccaggtgagcgctttgattcccctccttttccccctctatttctgaccctccggctcgcacgtgtctccccctcccacccaccatctccggtgtggccggccggcagatggtcggcggcgacgacgacggtagtgtagtgctgcgggtacctacgcttccccgaatttaaattttgtaacctaattttggtgttgattttagggttctcaccatagtttatttccaacggttttccctgaggagaaaggagaagacttggaatatacagtacgtaaaacaagctgaacgcctgaactagtacatgattaattagatattaactattttaaatttgaaaaatatattaatataatttcttaaagcaacttttctatagtaaatatttttcaaacacgcactgtttagcagctcgggaaatgcgcgcgcgaaaaacgaaggaacccttctccctatctgccactcttacaaaagaacacagcaaaacatttcattgctaagaacagatataaaagttttacccacaaattattttgagtctattcaacacgctgcattcatttcattagctgcatatatatttgtgtactattgctacaatgatcaacagaattagcagtgctatacgttttgccccctttcgaagtccaaaatttggcgctcttctgcctcccaggaacccctcctcgcttgattgcttcgacaactttaagcagtgatcattggaatataactccactgtgaatggtgcgagatggttactagttttttgtcagtaagagatgcatgattactcctgtcctgcccctgaatcagggttgcattgtaacaacggacatataaacgcaaattgaatttcctagtaaagtgctaaaggcagggatgtgtttgccaatgaattttctttgcaaatggtctagagtttggattttaataatgcgacgagttttgtaattccaacttgaattgatctcgtttttacaaacaagactattgaaaaagttagggatatgctacttatgatttgattaatcaattaatctgggggagctatttaaataatgatgggactaatattgtccagctgctgctctcagcttcaccctactctcatgctgccttgtagatcatgagcacaatggctgacagcgtatttggagaaagggacagcagtaatctcgagattcttcaacgaagtcatatgaacagcaattagttgactaggcaaagcatctttctgagtaaatcacgtcttgttagggtacttcagttgtctttcccagatctctcgtaaaattttttttcttattcctgcagatttgcatgctcaaggacaaggacctacacattatgtggtggttcatgcaaaaaagaaaaatcaagtttttctataatatctacacatatactcaacagtttgactgtatacattttttctattatagaataagacagcattggctgcagagggttcaaatgagaaagctgcggtagatgcaaatgaagtttcattgcctctttctaatctaagcaacactcgacaacattctgatagagaaaacaacatgcctggaaaacatggcaacgatggcatgtcaaaagacatgggacgtgctactagattgaagagactgcaaacgccaatcaacttatttgaagatgaatgcgttttctgccattcatttagaacacctcctcaggtgaaccatgatctattaaccagaggttatgttttgaggtcttcttaaccatttctgacactaaaggtcctcacttttcctatttcagtttcatggtccaatggcgcattatcaaaagggaaagcttgtgtccagtgacaatggcagtccatgcccaacagatatcatttatgttcataagaaatgcctggagtggtaagttcctaaatatatttcaactcttgatgcttattcaccacaatttagatttatcatcatgcgcttccaatgcaggtttaagatacaaggatgctggacaatttttatttttatttgttgagatctggacccttgtataattttttagtttaataccttattggtttgctttataagacaaccattccatttgtttaattatgtccaaatattagtcagtatgatatatagttttagtggcatgcaagaattaccattttgattcctatttcaaagtaaattcacatgatatttttttttagccattaaacagcctattcaatgtttgagacgtgctaagtctccccacccctaataaaaatacccggtggcgggagtggtattaaagtgggtagttggggggtgatggtgttttaaatatccccctccctccatcccccatcataattttgttgtgcgcatgatatattcttctgcaaaaagtttatttgtttgcacatgtgtatgtgtagatggttgattgatctcatgtagtaatttttcaattttctagatttggagacaattcttatttttagtatatttagctttacattataaactatatttacttcttccagtgcaacagttggcactagctagttactctcaaaggactatttcttgggtaaattgtttgtctttccctacttttttcttttgcgaagggccccgcaagtattttacgaaggtgataccattgtgaacttggagttggaaataaaacgtgccgcgaaattgaagtgcaaaagatgcaagcttcctggagcagctcttgggtgttattatacaaagtgcaataggagctatcatgttccatgtgcaatgatgactttgaattgccgctgggatgttgtaagctcttgagaatattgtgtaatcgatccttttgtttgtgatattcgtcaccactctaatagtctaatgttctaagctccgagatgctaattttcattttgcaggataacggttgtgttatgtgccctgaacatgcaacgatgccactaccatgtgataagataagctcgccaagaaatgagagtggcaattcttcttccttccctcagaggtttttccatgaataagaaattgttattcaatcttattgctttcttggaaggttatacaaaggctctggtatttgattaatcattgatccttcatttgtatttttctccttgattctgtgttccagccaatcgtcaattgaacaaagcgattccgctgattgcgaatgggaatatcctataatagatcaatggaacacatcaagttctttgtctcaagggtatatgacctttattcacctgccttttgagttactttgtaatcattttatgaattagctaatacggagtaaatacctacaacattctcttttgccttttgttgttccagacaaagttcagccaaagaaggaatttctgctgttcctaaaagggaaatagatcaacttaacacttcatgttcttcctttcctgaggggtacacaatctttcctaacctttcttgttagatgtctttaaggttcctgattctttgatcaattgtagtcttgcattccataaatttgtgttgtatttaatcattgcagccaatacttggacaaagaaggaatttccactgacgaatacaggaaagaaaagcaaacagatcacctttacacagaaagagattgcccctcggatctgtgggttttgcttggttcagctttaagtgaatccgagaaggtaggataagtgagaagtagcaaacattactctttttttgtggtgaacaagtatacggacaaacaatgctgaatcctacttcatggataattcaacatagtggatgatttgctacatttatgaagttaactcttccattccagcttttgtggtaaacatgatttatgtttttcaagcaggattccttgcaagagtttgcgtcttggacagatgcaactgtggtcaacgagtggactgaaaatgtgacccatgttatcgttggaaaaagtgctggtagtgcatggagccgatcttatgaggtcctgatggctctactgtttgggaaatgggttgtcacggatggatgtcagtattgagctatcttctctacagttctctatttcttttaggaccccaatttgagtattctttcctttacgtttatattgtttgatatacctaattatccctaaggccattcaaggtttatcataaatctgcagagtattatctattcctaagctgaagtgcttcgccttgctcttttagggattatggattgcttggtaaagtttattccaagtccagaagcttcctttgagttaagatttagccatgactcacgtgcatcaattggtggaaacaagaaaagaagaaatcaagcttctgaaggggtacatatacatcgctggctataagattagacttattttatgtagtgaaaactatcgtaggctgtcacttgtataagcttaggaatttgatttgcaaatctttcccagtaatattttcttacaggcctagctacaactgggtacaacaatgcataaaaatactttttacatatcgctgttcaaagtcaaggtggatatatctagtgcataactccatatattccacctgctttgtgttgcaacttacgacatttcattctttagagcaaattttctgccgcaacaatctccatgatgataatgcgatgctttcaggcacagaagttgttctcgggactgaacttttgcctcagtgcctacataaaccctgacgacagacaacacatacagagcctgattgcagctgctggagggcagatactggagacaaacggcggctcgcatttgctgcgtgaaaacctggagaaagttgctgtgaagccatgctacttcgtctacgacgggggcgctccaagggatttcacccaaggattgcttgatgatctccctaaggagatggaagagggcagagagtatgctgcctgtggagctcaggtgatcagccatttgagggtgtttgatgccattgcggcttatgatgcacagattctcagccacaaggatcacttcaccccggatgtgtaatggcgcaagctgtgactgtacatggtaaagcatatatccatggctagttgttggcaatttgtaggtgcttttggagcagtgcccttcagatcaaatctttggcactgtaggacagtaatgctgttgtatatatataaaccattcgatgtttactgacacatctggttagcctgatattcacctactaagagcaggtacaatagtggattattagccggttgtaaacattttaatgagataaaagatgagagaagagcagcgggctacagatctgtagccagctgcagcgcgaactctaagacgcaatgtgtgtatgacaggtgggaccatatattaatagtatagcaagcaactattgtataaattggctattagattggctataaatgaattggagttaggtcctctttgtttaggcttataagccagcttataagtcgaaaagtctaagtcaaaacaaacaagtagcttttttttatttggcttttttgaagccataagccactctaacactattaagccaaaagataggttggagaagcttttttggcttttatgagatagatgtatgactccaccactaaacttaggacattaaatccactgtcttataaatcatataagccaataagctgacttaaaagtctaggccaataagcctaagcctaaacaaagagggccttagtagtgggctgtactattgtaacaccctgaaaattcgaccaataaaatcaaaactctaaaaatacggattttcaaaaactttttaaacaaattgcattatgccgattttattcacctatttcattggattttgatttcggagttcgttgatcgcgaataaagaataattaattaggaataaaccctaaaattaaactggcaaaataaataattaaaatataatttaaaataaagattaagtgagggtggtaataaaaaaaaatattatcgcgaccatattagtatcaattaaatttaagtgcgatggaataagaattaactttaattaaattcaagtaatttatataaaaataaaatatgtgtaatgttaatctagggcgaatcttttggttagagcaacacaaatattgagtaaacttgatttgtgcaaaagttagaatttatagggcgagatttaaatagaaaatagactaaattagggttaataaggatctagccctattcattgcctacaaggtgcttgatgtaatcctagcctagccggccccgagccccgcgccgccgacgccgtcgcgtcgccatcgccgcgcgctgtcccatcgtcgcctgccgccgcgcgccgtcgccatcgccgctgccgcgccgcgcgccgtcccgtcgcgccgtcgcgtcatgtaacatactgaaaatttgctattttctaaatatgcatcatgccgattcttatgttcttaataacttcctaaacctaagaaattataattagagggacctcctaaaactaacctgtataaaatccctctttggtatttaaaatctttcgtggttttattctaaaaattgatcttgttaaatcgaggtattctctttgatttgattttgtatcttaaaccttctttcgaccaaaatttcctttctttaaatttagtttaaaaatcctttttacttttatgaatcatggtccaagaaatcctccaactatacctttgaacctaaacccaagcaattccaatttcattggaattaattgtcgacccatcctttaaaattctcgatccaaattatttctttaaatctagccgccgatttaatttccgtggcttgatttccttctcagcacgagaataatattattatgaacaattgctcctgtgctaagagaatagactttatccctccacccgaaatccaaaacctcatttagcccatatctaattctttaaattccatgccatatattttgggctaaaattctatttactctactcccgtcgcctcgcgccacgcgcttgccgcctcgcgccccgcgccgctgccgcgccgcgtcgccgtcgcgtcgcctgtcgccgtcgcgtcgcctgttgccgtcgcgccgagccccgtgccaagccgcgccgagccccgcgccgcgccacccacccgtcgcgtcgctgctgccgcctgccgcgccgcgcgcccgtcgccgtagccgcctcaagccccacgcgccgcgccgtcgcgtcgccattagggccggccacctctccccgcgccctataaatcccctccccggtcgccatttcaccccgcaccaccccacctcctcttcccccattttcccctctttcctctccaccgcgccgccgtcttcgtgccgccgcaccaccgccctcggtgccgccgcaccgcgtggagtgccgcgccgtgcgtcgcccgccttgcgccgccgccgcccctccccttgttcggtcgccgccgccgccccgggtaggcagtgagccgagagagagaggaagggagaagccgggagggagagaaaaagaaagaaagaaagaaaagaaaaaaaagaattgaaaagaagaaaaaggaaaaataaatagaaaattagggagagattaaggaggtttggaaaattaaataattggggttagttgtaggtttcttttagttgtagaatcacaaaattttatataattatagaatattttggtaatctctatacaaaatcaattcgtggtagaaatttagatttatttaagagctaaataattatgttgaattattaggaatgtacttctaaatcacaaaaaaaaagacttaggatgaatgaacttaaaattggaatgaagtggttttgcaaactttgtagtcgatatagaaagatcgattcgcgttcgacttttatttaagtttatttggatttcatttgaattctaattgaattcaaatcaattcttcgcacgtacttttagacccgagggagttgcggatccgagcgaggatcaagacccgcaggactacgagcaatgcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagtcaattatgacaattgcttagaaatgctattctagaatcatgcatactcatatttatcaaatgctatattcttgggcaattatctttgggaaggtaattgagatgcggcatgtggagacatgagcgccacattgccatgatgttgatgacatgatttgtgaaaggagaaataaaattaaacaactgttttcgactggggcggacggaggatttgggtggtgtccggaaaaggctagtgccgtccccggtcaattaagaaccgagccatgaagttaagcatgaaacgaccccccgtacaactgcatttctcatatgggtatagacctagcgaatagatagctgagcggaggcgacgtgcgggtgcggtgcctcgccgtggcgaagctgagcgtcaccgttagctcgccggccgacggcacggcgaccaccgtcgccaccgcggcggcctgagcagtagcggtatcggcggccagcatcagcttcggaggaagcgggatggactcctcgtggatgacaatcccgtcgccgccgccgtcaccgtcgccggcgatggcgcggtagacggcagccacgctctggaagcagctcgcgcaggagtcgcccaggaacacctcgacggcggcctcgacgccgctcttgatgaacatgtagtccatgtccagcgagcagattgggccctcgatgcgtgacctcagcaatctgccggcgctgcaggtgatcgtcctgtcgacgaactctttgcacgcgtcgaccagcacgtcgtcggcgtcagcgtcggcgccgtcgccggcggtgttcttcagcttcaggtcgaactcgagcaacacatgctcgaacgcggagatgccgcgcagtggagatgacagctccagtgcaggagagctctgaattattccaaacaaatcaatttttttaaaaaaatcgaacgtgtttgaatttcctaaaatttgttcaaattcagccaagatagatcctgttcaaactcaaaatttaacattgtcactcaccagtgtcacttcctgggcgttgtcccgtgtccggttgaacacaaagttgggcagcccctccatgtcgtcgcgggcggcgacgatcccatagacgagcagccgccgcccatcaccgccgctgccggcgccggcggcgaggctgagcgagcagagctgcagcatgttgtcggcttcgtagtcccagcgggggtgaggggtggtgaacctggagcggggcagcgatgtcggcgccgtctcgtgcatccggtactcggagtgccacgagaggccgaagaagccgtcgcggtgggaggagccctcgaggacgaaggtcggggtgtagcgccgctcgccggccggcagctcggcgttcagcttctcggtgagctcgtagccatctgtgtaagggtatcgttttatcgtggctcctcctgcaagacaagaaatgttcatatactccatttgtcctaaaatataagtatttttggactctggtacagtctccgagatgctactttgactaccaatatctataaaagttattttaaattaaaagagttgcacattatgatagtatgtttaataataaatctagtaacatcaattttacatgattgatctttttttattattttactattaatggtcaaagttaaaaatgcttatatgttggaaacggagggagtatgtggcaagtgttttaaatttgagggaatataatcttgtttgtttaaacatcatataaatagttggtaaatctttttataaaaaaacgacaacattaataatgtatatataaaatactctatataaaatcaagttaaaacttaaatcacccatctaggaataaaagaatcaaatcaaagtgctctggatttatctttttttaattctcaatatgtaaatcgaatttgaattatatttttttggtggtgataaaagttactataatgtacattgctaacaatttttacagctagaggcctcggttgttggtcgttctccaatgccattgtgtaagggctggcatgggttcaagggctttcttgacctgcgtgagaaggttttattctacacaggatgtacagggtctattttgtctttggtgggtcaagttttttttttaaaaaaaatacaaacattcacattgaatttgaaaaaaaagaaaaagttacacgaggagatatccttcgagggtttagaatcctgtcccaatatttgacttgcatattatgaacaagaaatttatactttggtgctgcttgcaatggaggcacttacgaatctcatattgaccaatccgatattcagctaagtgtttattcaggccttgcagctgattatcttcttcctcctcttctgctgattcttcgtggtgatcatcgtcgtcgtcgtcggatcggaatagccaggccgggatgagagccttgttggacggcttcttcttcgtcgtcacattgcagcagtcgcaggtgcagcttgagcggccggggacggtcagccatggctgcctcgtccggtccagcttcatcaccggcaccatccggtcgatctccgccatgtcgaactcggcgtcgcggttgcgccgccgtcgccgacgacccatcgatcggcgcctcggtgatcgatcggaaagcaagcagaagcgaaaggcgaataatatgggattaattcggatccggccttccaaaggcgatcgatcgcttcttccgtttgcctaaaaccgagagggactccgattctttgcaattctggttgcgaattcctaagaagccacggctcatgattagttgtagacttaaacttgtaataactacagtacacttgctagttactagtagttactacaccgcaatatttgtacattagttacttcatttatatcgtacaaaaagaaacacaaacagctcaggatcaatatacaggcattcctatacaccataggagactttgtagctcggagtgaaagtaggtgattgaatggcttgagaaacggctggcaaattggaaggcaaacttttattacttagagggcgactgacactaatcaatttagtgattatcagcctatcaatatatatgatgttcttttttgaaatacataaaggagtgatcaataaaattgattattttcaatcaaggttcttttggcaagaggatggacacaaaaggaaataccgactagcaaggtgagacatcatcgtaaagatcaagggggttgggaattcaagatcttgaaattaagaacaagattctctttagtaagtagttgtataagctactcactatagatggtgtgtggcaataaatgctaaggaaaaaatatttggagtcacagccttctcattggaaaacaagagagtcacacttttgggctagtctaatgaaggctaagcctgattttcacatatttgactctttcaacatcaaagatggctctcaagtacggttttgagaagataaatagttagggaatgcctatttaatagaacaatacccatgtctttataatgttgttaggcataaacatgcaactatttcagaaattttccatactagtctgctaagcttttcttagcgcagggaccttactggctctaagttagtggcgtgtaatcaccttctctcacacatcgctaatattatatttctcacaaccaagatgagtttaaatggaatctaaccactgatgacagattttcggttaaatctctatatcttgtgttggtgcataccgatgttcccaatataaattaaagaatttggaagattaaagccccataaagattaaagattaagatcttcttatggtacttatatcagggagtagttttaataaaagataatctgattaaaaggaatgggagaggaacttgttctttttgtcgtaaagatgaaactattaatcatttattctttgattatcttgcgcggtttggtctttaatccaatctgcttcgaatattagtttacctaatagtataactcatatgtttgggcatttcataagaagacaactacacaatttgaggcatttggtcttatttggggcaactgccactatttgatctatttggctttgcaaaaatgatgtgggttttgaaatgaaaaacatatcttctctgttataggttatattttttttactacatataggctctactcatgggctattctccagaaggtcaatttgttgggtaccatcactgcggcttgccaataattggagttagtggccatggagttttctaccctagcacatgggtggagttctaggctacggttagagagttcctaaagtttttcggttgtcttggatgatgatattatcttttgtttctttcttgttggctgggtgcactctttgggtgcatacgccagagatgctctcggaataattttatattatttactgagataataaaacttccattataaaaaacaatatacaatggcgaatagtgacagctaccgagagccacacctctccgcggaaaccacatgggtggcttctcattggatcatcctaagatgttggaagacattagcaggcaaggcaaccgattgatgaatgatatgggagcggtgagagagtagccccgacagcagaactctcctgctgtgcatgtcaatcctgcaaacgtgatatagttgggggtcattttatgtcctgagcggcttaggctgttcactttagtgccattttcaaccttaccaaatttcggtaaagttgccaaaaaatggctacatttagtttgctgccaaattttgataactatataagaaatcctgccaaaattttggcatagttaataaaattttggcattgccaaaatgacattgccaaaattttgtaaggttttttttggcaacaaagtaaacaggccctaagaagtagagaacaacaccatcttcccgcagcctcacgaagggccacgtgagcaccatccggggcaaccgtgacgtcttgtagtcctcctacgcccataagctcctcatgtcgagcgtgtctcaagtctcatcagctgatttgtccagagtccatatggccaccgtcgcgttggctgcttcggtggcggcgtggcacggtgacgatggcatgtcttcttcttctttcgttgtggcagcggcaacagcgatgcgggcggtgttaacggaaacgagtttgatgaagttgtccaagatgcctaggtgtggtgcatctccatacatccaagcttctcggatttgaaggtgtggagaagtaggtactacggggcagacgcggatctgacatagggccccgctaagggatctcagccctcactactggcgttaggaatgtgggagccccacctgagctcttctacaactatttgctccacatatatagaaaatggaggtttaaattttatctaatttattcagccccacctgcttttttttttttggatccgctactgtccgggtggaggctgacgtacctgagatcgacgggtggtggtgagccgcctccgtcgccggtgaagacgatggcggtgtcgcagcacatgaagccctgcgagagatccgcccagaatgtgttgccgtcgaacgagaagatggtgtccgtgcagaagaatcctcttgtgtgtccactgttcgctccgccacaggcatccgcggcgtgcagcttgcagaagaaggtgatcaccttggtccagcggcggccggcatgacatgatggtgttcatcttgatcctcagcagagcctcgtcggccgcgccaaaggcgaggccggagaggaggtcgtcgccggcgccggcgccaaggcgcgcgtagagcgtcaggccatccacaaccaccagcgcctggccgatcgagctcgccgcagccgaaggcgtccatgcgcgagcactcgattcataccactagcacgcgagccaaacccaatacggcaacttttacctgaccaccaccatcggcatcggcgatgtgtcgtccttgtcagatcgttaccactagccagttgtctgttgcttgaatcatactttcttcgtccaaaaaaactcaacctaaaaaggatgtagaaggaaatggctagattcatgcccagattgagtttttttttggacggagagagtaagttcacaacatggcaaaattttacctgaccaaaaattatcaaagtaataataaaaaaaaaaacaggacaggagctgattcaagatccaaaatgtcggtgcctgataagtttaaacgacatatctggtacggtacaggtaaaaacaggtttaaacattcaaaacattcagtcatcacaagaccgaaacataattaaaacggggttcaactttgtttcaaaacttaaaaatgggtttaactgattgcagccaacgaattatgaaccgcggtatttcgcagctaccacaaacgccggccatcgcaggagctccgatccccagaaccagcatgcataccctgttcagaggaaattaatgtagtttaggccaccaagtaagttaatctgaacttactatagaactaaacaagttcttgcagaatcattttgtgagagttaactgtaccttaataataccaacaattgatccaagccatgaaactctaatcttcaacacggagaacctactgcaatggctgcaaatgcaaacttacatcagaaaagggaattatggcactttttttaatcataattatgacactattttgacattgtgcacaaaaaaaacgtctattgggactcccaaatctgaccttgtttattcttacactaccattttgggtggcaggattttgggtggcaggaagaaggggaggaagggcaggtatcttctcgatatcgtcataacggagaataaagttgtcctgcaaccaactttcagatatattttcttctgctatcggaaaaagctgaaaatatctgtcagaatttctttcggacgtttaccttaggaattgcatcccaaatgttggcatcaaaaagatagcagagtccttgttcataagttgtagttttgacgagaggggtcgtattaggagctcttttaacccactgacgcagctctttgtggtaaacccacccgtatttgcatctgaagaaatggaagcaacaatctgagctatctggcataccaggccatcgttttactgaaaatgacaggcaaatgagaaaacaatatagaactgtggttttgtgcttacatttcattcgcggcatataactgagctgcatcctgtggcatactgcacaaaagacagtcaaataatgcatagcctactaacacaggaattcactgttgattgaactaagtacctgtagaagatgtagaatagtgtcatgaggtgaaacctcagaaaatgcaacgcctgcagaggaagataaatcgtaatgtcagatacaacaagattaatgctaacctaaacattccctcacaaaaagaaaaaagaaggtaactcgaaaattgagggccttacttgcaggggtggaggctgcatagaagagtagcaatccggaatttcataagaatactcttctttaactggctcacttgaccaaggagagccaaatgtcttgtaaagattatctgaagagttcatatccaaccctagtgttgtcaaatcaatccctaaagcaagagatgccggtccctcctctttcaacttcattaccctcagtagtccatgtaagccatatggatcatatggatccggtgcggtatcagttctctgagaagacttgggactctgaaccttgtgagactctggtgcggtatcggttctctgagaaggcttgggactctgaaccttgtaagactaaggagtgaaatcagttctctgagaagacttgggactctgaaccttgtgagactctgggccggaagatgactgcag

SEQ ID NO: 10634 - DNA, 3702 bp, Oryza sativa
ggatttaaaggcaaccttggaaaatttactggctttggtccaacattttcaggcccagtattttgaacctaataaacacaatcagtatggtcagtccatatttgaaaagctcagcaggcacctgctaccaattattttgtaggattcttacttactattccccataaagaaaaggtacatgaacaaaaaagagtcgtgttcaccaatggtggtgttttcaatcttgactatctggtcatgaggtaaaagaaatcataatacaggtaacttaccgaattagctgtctgcttatgttgtttacggggtggacaactgctgcccgtgttaaagccagatgatttgcccatctgtagaatcacatgtaacggaaatttaaggaaaaggagataaaactgttgttggaattacaatttttatttttttagaaaaaaactcacaggataatgttgtgcttgcataatatttgcattcttaggaagatgatccttgcgatgcaactccataccttacattcagagcatgaggtaatgttcaaacaaagtaccaagacataataaaaacctatagcatgaggtacttggcaaggaactgtctgaataacatatagaattaaataatgaaacaaaaagtagagtaagagtaccttccaatcttggtaaagctgggaagtcctcattatggattctaaattcctggttttgctgaacagcattaataccaaatgcttgttgtcttagaggtccttcatttgttataaaggagaaaagttagttaactaatattatcattcagaatatttagtttgcatgtcagcattaccatataacccctgaatatttccagcagaattaggtcgcccaactaattgaggaaaatcattgatgtcaaatagagaattttcaccaaagttaccatcatgtcgcattcctggagaaccagacgaactgcttcctgcctgcaattggttcttagatagtgttcctccaggtgctgaactagagcttccaagcatattcatagccggcaatcctggtaaataaacaatttgaaacaaaactgcccttttatatataagaaatgagaacgttcacattcttactaaacacagtaagttctgcacacgttttagttgcttcgtttgattgataaatgtaatagaataagcacattaacaagatggatgagatgtcagtacagaataaataacagctagcagaactatggcaaattgcctcaacagaatggtgtacttctttaataatggacccaattaacacttccattccccagatcaggtaccggtcaaatatgtgcttccttattcttttttgctccagatgactagtgtacttcataggcttaatactcagtccttttttttatatggcgttggctagttcaaaattgaaccaaccaatgtcatataaaaaaatagggagtatgtgatttttaatattatttattttagatcatttcattatcaaatcagaaagaaagacaaattgagaacatatgcgcgtgcatttatacaaggggtttatatgtttagtatataccttgttgatgagtaccacccatttggtttgatcctcggatattaagagccccacttccagacaaattcacaggggatgcaacagtaggcatagacattccggcagagcttatggttctcccaatgttgcccccacccgcaacgctagccacataagttattcgcgggccaaaattcccacaaactggagcagctgccaatccaagagcagaattgtggttaccatctttagtcaagtacgaggaggaagcttgtattgaaccatcaattgcactcatgttaccagtaaaaacaggacttcccccaacatgcatacctcctcggttgctgagagcaggatacccgacctacaaaaaggatgaaagaaaatgtgagctggattagaagagcttcataaacagactcgagcttaggagaggaaaaaagaacctgataaatggatgcttgaagactatttggaggaaaccaagcaccagaaatactacccctaggtggttgaaccccaagggatgaactaccagtcattgaggaaccccttggtgctagtgaacctgacatgtttctaagattgagattcccatatacaacccttccaagtttttcgtgagagttagttttagaaaaacatcactttctaacatgcacaaacggactagcaaaataaacaactgtaatgtcactaaccaggatgacgaaaacctgaaactgatccagattgaccagaaaaggtcggtgtcaacggctttcctgttgagactggaaggtttgatctggcaccactactgcttgactgaaaaagtaacaagacataagttaacctataattgtgacattttaatatgcatttgtgccaaaacaaaataataggatcaaattttaattataatatagacttaaataataaatcatagctagtattcaaagctgcttttcactactctaaagagcactaataacaacaagaaaaaagtgtccttcaacagcatgattcataacactttgttttgatttcagacatagtttaaggtccttgtgaaatagaggaactaaacaaagagaaggtaagttacaagaatacagtatccagaaggatacacaaaccaccaataaagtataaacaggctcgtgagtctgctaatctggactgcaatgatttattgaaataagatataaacacgtaaaaaaattatgatagtaaggatgagggccttctgaaaacaactaaacaaggatgagagcacacattcagcgatcctgacattttgatgatgatcaaagaacaaacaggccaagagcaagtcaacaatattctaccaattccataacaccatttatcagatctagagttcaagataagacaataccctgtataggcaatcctccaaaatgcaggctatttttcaaggaacaaaagggaaaggattgatgtattattgaacagacgatgtgcaatggatgcaatgcaggatccaaaacctgtttaaaacataatcataagaagatgtaaccactctacttgggatctcatgccgcagaggcttgttttgcttcgcctgtttacctatctcatccaactgccatgtaagcttggcctgtaatatttcctccaaggtatatatataaatctctctagggttcttccaaatcccctcaaccaaattacccacaaccgccgctgccgcggacagtgtctccatgctcaactattccaagattccattgtttgccgcctgctcaagccaccctagcgcacgacacccagccggtccctcaacgcactgcctgctagctctgcccttggttccttcctcccaggcgtcggcaggtagcagctatccatggcatcagcggacggtgcagcatgcgctgactatggaggcaaccagacaaccaagcaaggtgtgaccaaccaccaggactccatccgcgcatcctttaatcctcccgatgatgattgtctctctcatattctctcgattccccttttgccttttcagattaggaccatcatgttgtcagatctagaaatctaaaatggagtattggttttcgttcatgtttaccagtaactaggcctctagttgcatgtgcttgccagtaattgttcagcttgtacatcaagcgattagcatcctcatgctaacatg

SEQ ID NO: 10635 - DNA, 28344 bp, Oryza sativa
gaggagttggcggaaagggaggattacctgtgtcgactttgatggagatttgcggccgcccatccttgagcgtttactttggtgagaaggttgagaggtgaaaagaccaagaattgcggctaggcataggggttcaaccccttttatggaacaaaaccgcatctatcccttgttgccataggcacataagttcaatcccatatttaccccctaatctctttgacatgtgggcccataacccacatgccattgtgagattaaggggcaaataagaggatatgcaaacttttaggggtgaataaggaatttatcgaaaggggctaagcatacaaaattgagtaaattccttatttgcccttgaaagttgatttcgtccctttttgcccttgcaaaattgccctccaatccattgaccacctttctcaacttcccttctttatttgcctattgatacatcaaaatacatttttgctctagtgaatgcccttctttctcatctttattgttccttttgccaccatggcaacacttaatcctcattttcattatcagttcaccggtgatatcttgtatcccgtcatgtcaaaaaaaatatcttgtatcccacctcttggttggttgtaccctcatcaattggcacctcctcctcacctcctcaatcctgacctaccactccactattggcaacatcttcctccattctcacgcagtcacacagtcacagtttttctgattttctcattaggaaaaatattcttcagcatattcgcagaatgaatgagactcttaaagatatagtcttagctggttacgaactttgtaaggattgtggttttagtaatccttgttgcctcttaatctctactacttagaggtggagtcgtccgtctgccctccccctcatgacgcacagcacgagtcactacctccccaagaaaaccataaaaaacaaatggtaaaaaataccagttgtatcccatgctttaggttagacccacaccccaccatcgtatggtcagttgcaatgaacggacatattactagttaaaagcgactattggctgtcacctggcagtattctcctaaaaaatgcactatctacatgtgtttttaggtatttggttgatttagatggttgtgtatacaacttataaaactgtggatagttatatgttggttttttaactatagatctttagtatatttgtttgacatatgttggaacatgtgatcacattgctcgttatattgcaaataggcactatgtcatgcatggcaaactaatgaactgttgatggaaaaattctagaaaaagtaatagagatccataatgagagtaggtgaattacaaccagtccgaaaacccaaatgagggtgagtgcaagcaagtttaaaagtggtactttagaatatgtgactaaaattcaacctaatttgacaggcgaaaattatacttagtagttgatcactagaaggcaaaacaaaagtgctaatgcttacaaaataatttgaaatgaaagaaatataaaatgaaacaaatacttcctccgtttcatattataagactttctagcattgtccacattcatatatatgttaatgaatatagacatatatgtgtgcctagattcattaacatttatataaatgtgggcaatgctagaaagtcttataacctgaaacggaggtagtaataattaccaacactgaacaaacacaggcctactataactggagactagaactcacaacccatggaagtctaggattaacattttgtgagtagctttataataagctggtgttccaactagcctcaagaggccacgtatttatggaccttccatgtataatcctgaatagtagaattagctatgtgatactaaaccaataacatgtttggatgagcttgagatgcaaactcgaaatttccaaaagtgacttccaaaattaggtggtgggtcagcaagaaacaatgaaatttcatcagaataacacatgctcttttttcactcataggtattgcaacatactgaacaaaaataaggaaaagggactggaaattaccatattaaacgtaagcattcaaacattactctggtggatcaaattttatcaacaataagccacttgtaatttgtagtctcttgtatagatatacacaaatgggtacaaagctcattctttggctatatttagaatgcacattccaaatcctataatgacttgtatcatgtgaaaatcctacaaaactcagttgtcaggcccttactatagttagcacctttatgaaggtaagccacagatataaagttttctttggttagtttgaacaaatcctaccctatattcacactacgaactgagaagaaaatttccacccaataaaaatattttaggttcttctccctcattcaactatacaatgggtctgtttggcacagctccagctccagctccacctcttctggagctggagctcagccaaacagtttcagctccaacaaaaatgggagcggagctgggtggagctctctctcacaaaatgaactagagaggtggagctgggtttaggcagctccataactccactccagacccaactcctggagctaaatttaggagttggagctctaccaaactggcccaatatcagcacatcatctcatgcacacctataatctctcccattgatttcttgatcagatgcattgaccaaatatgaaggctacttgaggaagcaaatctatggtaggtcaccattcttttgtaaccaatttctaacatcaccttggttgcttagttttggggttgatttatttaagtcaaccaagtaaagaaagattttctatgtaattgcttctcccacaggcaccaattttgagcagtaagaacaaaagcatgaccatccatgtgcagataggttttagtttagtgtagttcaaatctcattcattaacgagtacagttacatggtacaactatagggtcggtttactcagttacctaacttgcatgccaataagagtagaaaataatgcagaattcatgtgttgtttcaatcctaaaccgtatttaattggcaaaataaatatagatacgcattactcagcacaaataggaatattattataataattattttgtatattggattaaaaggaaggtccattctggctagactctaggggagttcttaaaaggtaaaaggaccttgaatccattataagacagtaacttaaggcatacaaattaaaaaaaattgtacactggtctgtttgtggtctttttctatcatgagatgatgctaatggaacattaaattagcaagaggaagaaaaagtattgaagaaagcaacctcacattgtttagttggtttagtgtcacttctaacttcccctggaaggtaagaaatatgcagttatgcaccattgtccgaactccaaagccttttctccaagaatcatatagggagcgttcggcaggaggagtttgtgagttagtttgtttcattttccgtgcgcacgcttcccgaactactaacggtgtgttttttgtaaaaattttctatatgaaagttgctttaaaaaatcatattaatctatttttgaagtttaaaatagtttatactcaattaatcatgtactaatagctcacctcgttttgcgtatcttcccaatcttctcttttcccctcctctcaaactcacccatagtctatagtgtatgaactctgaatctcaaacttgtagtacaaaataaatctgcatggttaacacgacatacaaacagataccaatgagttgttaagccactaaaacatacaaacaatgaagatgttagaagcacaattatctttcagtggatatatgtacagctccatacgagaggattcttaattctcttgaggtagctacctgcgaaaaacatcggggttttcaggatccatcagtcaatcccctgaacaagaacgatgatgtcggcttgtcgagaataacagaacaatgcatatccatgttctccgaagattgagctccccagcttggatcaaatcgcagacgctcgcgtccgcagctgagcaggagttcatgaaacctaccaatttactgcaagaaaaaaataatctcaaaccggagcctaactggaattacatacagcatcgaagactacccgatagaccaacagaataatttgagacctgtagaacattctgtggcttgagttcattcaaaatcatcagaataaagccccccaccctatcccattccatcaatccctcccccggggcaaccggaaagggagagaacattctgcagattgggttcattcagatcacccaggctggaaactccaacgccaatggcccaagcatctctctaattcgaatgcaggaaaggccgccgctaaatcaaactcccaactccccccaaaaaagaaaaaaaatccaagcacgatgcacgactggaaactattcccctgggccgggacgaacacgccgtcggctgcgaatcgagatgacacaagatccatccgccggtgagcagcggcgcggccaccgacctaatctgagttttggcgatggcgagaccgagagttagcggcgggaggcgaggatctctctgtcgcggtggagacggggacgaggggtttgtgcttgtgcccttcgtccctgtgaacgaatcttgatgcactccgtgtaaggtggtaaggctctgtttgcgaagcttcaccttatctcgtaaaatctgaagctcttccaaataatcccactttttttttaattctaagaagttagttatagaatatggaaaatgaattagagagctgtttgggaagctttcatcacataatctcccactccctaaaccgtctatattttcacccatattctaagaatctttactcgtagaatctagaaaataaactagaaatctaaaactgaatctaaaaggctggctaccaaccagtagattttcagaatcttaaactactccaaacaaaacctagaaatcggatgctgagaaatctagcttttctaagccggctacatccagctatttcttacaatcttaaactccagacagatcctaaggctaagagaggtgcaaaaaaaaacaccaacctaccgtatgaatatttttgaaatattgagctaagattaacgaagttacgagctggtagctcgctattgataagtacttcctccgttctacaatgtaagtcatcctagcatttaccacattcatattgatattaatgaatctagatagatatatatgtctagatttattaacatcaatataaatatgggaaatgctaaaatgatttacaccgtgaaacggagggagtaccaaactgaaggaatgggctagtaaatcttgaaattaatgaagttaccatgtgactatcaattgataggtctcactaaaagagcgggttcgactagaaaaaacttgattagttaagttacgctcacttaaaaaaaccaaacattttcttgtaatgttaaatttaactagttctaatcatgaagtgtacgacctacatcttatttacggtattgttaaaacagattatttaaatatgttcctagaaaaatctccaactgtttgtaaggtcacttatttttttattttaaaaaatatttctatatagttacatagataatttataacaatactccacttaatataaatatatattaaacatttttttcattttacaagaaccagcccaacttcccaaatggccctcatcaattcgacctgggccactcggacgtttccgatggactcgtcaagcccacactccccccaccgatcagacagtgggcccttcatgggcccacgccacgccctcctccactccgtctgacctgaccatcttccacccagcgttggtctcgtctgcagcctcgccttcacctcggcgggtagatctcgcgggcgcatcgcgtcgcggggcaaattcatcaccttcgtgaggcgcaaaaccctactgcccttgacccctcccgctcccctcagatctccccagggtccaccgatccaaggtgaggcggcttcgtgctcggtcggtgtgtgcgtgacgtgaggtttcttgttcttgattttggtttcttgagttttgaccatggtggatccggcggtgtgtggtggtgtgtggttgcagatggcgagcacgggggggaggtcgatggcgctgtcgctgctgctgttcgcggtgacgctgtcgctgctcgagatgtaccgggggaggttcgcctcgtcggagctcatgaccatcgccggcggattcgtcagctccctcctcttcctcttccttctcacggtgcgttgaatcgtccgctcccaaccctcctcttacgatcttataccccttaataagtttttaagttttgctcgtgatgccgttgtttgtccctctttctttttagctaatttgaagtgatagaatcacatgagtggtaaaattttcgttttattattaatttagacaaaccccgtagcaaatggagttgccaagatgttgtctctcgtagcttttgtcacatttgagtgattcagtctgtaggggataaacaccatagaagaaaacatagttttgctctgtgcagaagtgggtagtaacattgtgcttctctgaattgtaatatccgactaggcgcataagcgagatttcggcttagaggacctggaactagtttattcaggttcagttttccagatatccacagaagaatagcttctgaaatatcatacaccatctaatattaagttcactctctacacaagaagtcaaggatggcttctgaaagagaatagaacatttaattttaagctcacttggtactatgtaggctaagctatctgctagtatttccatgatgctatcataattcttgcaaagggcatgttaagtatggaacctggagcttcgaacttttaaccttttgagccaagataatagaactaaagggggttttggccaaaagcatgctaagccccaagagcatccagcagaactagcagccccaatgtccatactactagtcttatctgatggtcaaagaaagtatccttgaaatggggtacttatcccagctttctgctctgtaacaagagaacagtgcaagcagacccttaggaaggcaacaaaacttagcaaaaacaagcacataagacatagtgagcaggtggtatccacatttgattttcaccttttatggttgtattaaaagatcagtgagttttgcacttttttaactgtttcctctcaacattaatattagtatatgataatttgatatacttttgcagtttattggcaactatcaggaagctaatggagttaaaactggatggggtgcaggtatgtatagtcatacgatctcattcttgctgcttccccctgatttttatttcgactttctttaactgtctctttctttgcagttgttgtcgcggaacttactgcacttattgttgccggcactgtccatcgtgtttgcatcacaacatggtatgttatctttaagacactttactatttctttctacggacatttagaatttttctatatggtcccattaacacatccatagatctgagtgtttgctgtttgctaaataagaaaattcttggattatccagagatggtaatctcagacatactagtggagtatttgcttatgaactgttgctctgtttagatgggaggaaatgaaactaacaatttaggcaaaaacaagatactccactcctttgtttgcaaggagttaaaacttttttcatcctgttgaatgtgatatcattcaagatagtaatgtgtatttcacacaagtattttttacctatcttaagttgtatattgttaacactaatgctattggtaaatatggatttgtcacatgttgtaaaagctgtatttatgcaacaatgtcactggaaacgctatgcaatttgcagattacgctattcagaattatggcatatagaatgggttactagtagttctgttgaacctgtctatataaaatatcaaatcaattgcccttttatagcctattatgcttgcggtctaagtcccgccgctacttggcatttttttaagcaacttgacacattgtggataccctcataaccatgactttggagagttctatgacagtgagaaattgatactttggagagttctttgacagcgataaattcatattattaacctttggtcagtctgtgcacccgttgctgcagtccttgcgaatgtgttaatcaatttttatcaactttggctgcagcttcctgttttctgctggatttctctacgaggttgataagctctctggaatgattctcgcgaagagcgagtctaaagcgaggcggcactaggcttttgtaccatgtcatattttgtagatcaaatcaaaaactaatgttcacacccttcatggaactttcaacccagctagctttttcccccaggcatacgtataccatttgaattatgaattcctctagtgtgtttgcactgatgtcacagttcggcttttatgagttttatctaatgagaatggtgttgactaggtgatttcgatgtctttttgacagtctcctggtgacatcagttcatattttttgcaaagcaatgacacattttggcattttagacgtgccctgttgcaaacgttgaaaacattgtgaagtggtagctgtggttaagatctgaatttgtcaagcatgttgcttaacgttttatctccatcaactctggggttttcttgtttgcaaagcgcggcacgacaatgggaaatgtcaactagggacctctggaattattctatgggacggggtcatgtagtctgctttgagattggtgttgaaatcttccccgtggattatttatttatttatttttaccttttttatttaaaattttagaaataaaccattcaaaacttattttcaaatctaaaactgttggtcacgtggcaagggttttatcaatccagctagattgatttggcgagacaacagcccactttatagccattatgggagacgtagcagagttgttttgtcaagcagtgcgagatgacgtggttagaccaaaaaatttagatttgaaataagttttaggagcatttattttaaaaactacaaaaggttcgaaaataataagaattcacgtccatgcagggcgatgaaagcattacaaagccaaagctgattttaagttttaaaacttttttttagaactaattccgtgtgtttcttcgccgctttcattgtccaacctttccgtgatttagtgcaaaattattcctgagaattaagtaatttttaagaattgaaaaatcagctaagcatgcactcgtttgccgctttttgcatgaatctagtgaaagatcgcgattgacatgaacgtgcggcaatttgaccaaggctctccctttcccagccactctctttcaggtccacaacagtagcacaatgcaaaaaatcacgagcaaatcaaaactcgagataaggcatgacgaccccaattggcaacttgcccttttctgcaaacttcacaccgcgagcctgacgcggttgaagaagtatttattaaccctatttaattagggttaattgtgtccggccgacctatgagcacatgtggagtattaatgaaggtgtttctatgtttcgatccggaagttatttctgctaattttagattgacctaattttaagaggatgaaaggtactcacaacaactaaggtacaaatttaccacaaggattctcgtcgtaatcaagaagacataagagatcctagaatcatatactctctctctctctctctctctctctctctctctctctctctctttctgttctttggacttgatgcatttatcttaaccgtggattacatggacagattaggacagaatccacaacgacgattcctctcctgcattgtcaactatcaactgcacgggcacaaatgtactccctccgtcccattttaagtgcagtcagccatgattttccgtgctcaactttgatcgtccgtcttatttttaaattttttacataagtcacgcataaagtaatattcatgctttatcatctcataacaataaaatactaattataaaaaaaagaataagacggacgattaaaattgagcacggaaactcatggttgtatttaaaatagaataggacagtgggagtacaatccaagacgacgactaacctgcacattaacctaggcaccttcttcctaagatatagatataccagtactagtataataatgttaacaaaaaggaatatcaaaatgtgggttggattaagcctcacgatcccatttcgcgcgcccgacggccaacacacaaaataataagaaatcatgcccgcgatggctacctgacaccaacagccgacctgattgagagagatcaattaataaactgaacaacaggttaaatggttaactaatccaagtcgacactaattactctatattagcgcaggtctttttttctttttcaatagcactgcctccaacttctaatagatgacgccgttaacttttaaacaaatatttgatcattcatcttataaaaaaaatttatacaaatatataaaatataaatcacttaaagtattttgagtgataaaacaacttacaataaaattataactaattaatttttttaaacaaaacgaacggttaaacatgtgataaagagttaacaatgttatcttttaaaaacagaggtactaatattgattaagcataagcaggtcggctctttgaccaaacggcgcgaggaaggagcagaggcgggagggaggatgtctggctgtctgaacgcgtgaggagctcacactctgatcatccatccgcgggtgggttgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgtgccggcggtgttgtgccagaccaacgcccaggacggtgagtgctcttgcctcgccgccggcgatcacctccgtttcttccatagatgattctaaagtcaggcaggatcttcttgcccggagaagaatcgcttggtttttgttgctggtgttgatgatcttcttcttgggcatgcatgcgtgcagctgcggcgctcgaggggctgaagagccaatggacgaactacccgttgagctggaactccggcgacccctgcggcggcggatgggacggcatcatgtgcaccaacggcagggtgacgacgctgtaagttacagccatctccttctcctcctaccaccaatatcatgtgatgggccttcctctgaaatcgtgccatggatgtctctggtttttgcaggaggctgtcaagcgtcagcctgcagggaacactgagcagcagcatcggccagctcggccagctcacgtacctgtaagcaccttcttctatcatcagttcatcacccagcttagcaaaagttcaaaacagcatgattttgcaggctatgaacttgggattttcgaaattttgttcatgcttctgtagcagttcagattgtgaattcaggcaatcaggctaggaacttctgattgaaccagtcaaggggcagattgtcagaacagtttgcttctagtttatgaactctgcttttttttttcttgaggcttagttcagctgaccagttcatgtttaccaatcttaagctttgactatttcggcaatgtgacatggattaggttcatttcttaccaaatgaaagaaacaaagatatgatgccaagttacaatagtaaatagatctggatgaaatatctgaagctttgactattttcgcaatgtgacatggattaggctcatttcttaccaaaagaaagaaacaagatactacacttgaagttaaattatcaatagcaaacgtacctggatgaaatgatccgtgacaaagttctggagtacaactaatttgtctaagaagaaatagtctagtagtagtagctgataacagaaacacttgcagggatctttccttcaacatcaatctcggtggtccgctgccagctgagattgggaaccttggggagcttacgacactgtatgcgccgcactgcccattgttgtcaacactactttttccaatcagaaataccaaactttcttactgatgtgcacaaatgctgtgtaattgtcaggatcttagctggttgcagcttcactggaaacattccaatagcaataggcaacctgcggaaacttgggttcttgtaagtggatatacctggtccacagtttcagatgataaaccctttttttcttttcttttgagtggattgacataatgaattcgtgccattctctatagggccttgaattcaaacaagtttagtggtggaataccgtcttcgattggcgtactcacaaacctcttatggctagacctggctgataatcaactcactggatctgtccccatctcaacatcaacatcaccaggcctggaccaacttgtcaaaacgcagcacttgtaagtaattttaatcttactttatggtattatcaattgagaaatatcagaatatgtaagtacttacaattgattgttttgctccaaacttcaaattgatgaacagccatttcaacaagaaccagttaactggaacgcttactggacttttcaactccaatatgactctcatacacatgtaagggatcgacaaattttcatgtctaatatgaataccgaatagatatatcttgctaacatctctccctatctcgtcagtttgtttgatagcaacaaattctcaggctcaatcccagctgaggttgggactgttagtacactcgaagttctgtaagtatcttgaaagttcacataggtggaactcatccttttattttctccaaaaaaaaaaatggtcatatctttgacttgcttttgtatctttgacagccgattggataggaatggttttacgggagcaatacctgctacaattggcagtttggtcaaactgaatgagctgtaagtgacatctgatcttaaaggaagagttatgacacttgaggcacctctcttgaaaatgttatcttctgcaggaacttagcaaacaacaagctaactggatcagtgccagatctcagcaacatgaccaacttgaatgttgtgtaagaaactaaccacccccatgcctcatcatccaatcatataatttgtctgcataactaaagattccactcttgaattgccagggatttgagcaacaacacatttgatccttcagtggcccccagctggttcacatctttaacatctcttgcttctgtgtgagttatccaaaacttttggaattttaaattttgtgtcgtcttgtgatgacaatttcatactcatctctatatgttttgatcactcagttcaatagtttctggaagtctttctggccaggtcccaaaggggctcttcacattgcccacactgcagcaagtgtaattttctggtaacttacaactcaacatataagctttaaaaaaaagtgtcttatctctgcctattttgtggccaatcggacagtgtgctgagcaacaaccaattcaacgggacacttgaaattacaggcaacatcagcagctcactgcagacagtaaatctcatggacaaccgaatagtttctaccgatactgcaagctacaagaaaactctactgtaagaacctgcaaactcaataagaaccaagaacaccatacaatcttcgtcttctctcctacctttcaccaacattgcctcacttctcatgccatatcctgtctgcagcctggcaggtaatccgttttgcgccgagcaagatcccaacaacagagccttttgcagcaggcagctacagaacgcgagcccatacagtaccagtatggaaaaatgcggctcagctcagtgcagtgatggtcagaacgtgaaccctgcaagctgcggctgtgctttctcatacaacggcaagatggttttaagggcacccttcttcgtcgacttggtgagcagtacgccgttccagctgctggagtcgaccatggcggcaaagctgaacctgctccctggctcggtcgctctctcagacatccacttcaacagtgacaactacctccaagttcaagtgaagctgttcccaacatccggggtgaccttcaacctgtcagaattgacaaggattggttcttctctcagtaaccagatttacaaaccaccagcaaattttggaccttatttcttcattgcagacccatatgcccccttggcaggtacttggatttcactgtgtcgagactcccactttatttgcactgaagtagttttagttttccctttgagaatgcagaggtatcaaaattacagcttaggaaataccacatttcgttatctgagggttggtatcttgaaagttttaattttttacttctaaattgcaattaatgagatgctaaaaggactctgctattttatgtcggagagtttagtatttgcacaaaagtactagtatatagtggtgtgaggattgctcactctgattttgtgtgtgccagttgctcttggtggcaaaaaatccaagatgagcacaggtgccatagctggaattgcagtagccggtggggtccttgttatcgccctcattttcatgtcattgtttgctctccgacagaagagaagggctaaggaactcaaggaaagagcagacccttttggtaaggatctaaaagctcataggtatcatgtcactgcaatgccaccaagcaatttgtcagggacacattaacagctacaagcagcagcatcctactgcatgctactactggaataaactgacaagatcaagaagttctgaaacaactgaacctgttttctgatccaaaattttcagcttcatgggctgctggccagaaggacagtggaggggctccacagctgaagggagcaaggttcttctcctttgacgagctcaagatctgcaccaacaacttctctgacaaccacgagatcgggtcaggaggctacgggaaggtgtacagagggattctcggtgacggaacccgtgtcgccatcaagcgtgcagaccgcaactcaatgcagggcgctgtggagttcaagaacgagatcgagctgctgtccagggtgcaccaccgcaacctggtcagcctcattggcttctgcgacgagcaaggtgaacagatgctcgtctacgagtacatctccaatggcacactcagagagaacttgacgggtaaatccacatcccataattaacattgccatgaatctgattacacattttatttcgccatttcgtttgcattgctaaaatgattcttttatcaaatgttaactgaaaaggttttgatttgcaggaagtgggatgtacttggactggaagaagaggctgaggatcgcgcttggctcggccagagggcttgcctacctgcacgagctcgctgacccaccgatcatccaccgcgacatcaagtccaccaacatcctcctcgacaacaacctcaaggccaaggttgccgacttcgggctctccaagctcgtggccgacactgagaagggccatgtctccacccaagtcaagggaacactggtaaattcccctcactatccgctcatgccaatctcctgacagaactgaattttgagcctcacttcagtactcactaataaaaatctactaacatcttgagaaccaatcaaaatcgatatgcttaatttgaaatcaaacttgaagtaaatatggtaactaagcatgtacccattgcacttcaccttactaaccacttctcccaatctcaaaataaatcgataaaattcaccttactaaccacttcttccaatctcatgacaaattgataaaattcaccctactaaccacttctgcaagtctcctgacataactgaacttttaggttcgcttcagtaaaattcgacgaacatcttgaggaccaattgaaatagatatgcttaatttgatctgatagtataaagaaaacaatcaagattgaaacaaatggtaataaaatcgatgggatgtggctagggctacctggacccggagtactacatgacgcagcagctgtcggagaagagcgacgtgtacagcttcggggtggtgatgctggagctggtgagcgggaggcagccgatcgagaaggggcggtacgtggtgcgggaggtgcggctggccatcgacccggccgaccacgaccaccactacggcctccgcgggatcgtcgacccggccatccgcgacgccgcgcgcaccccggtgttccggcggttcgtgcagctggcgatgcggtgcgtcgacgagtcggcggcggcgcgcccggccatgggcgccgtggtgaaggagatcgaggccatgctgcagaacgagcccgacgacgccggcgccggggagggggacagctccgccgacccgtccgccaacgagttcgaccgccaccgcggcggtggcggcccgccggcgcacccctacagcgacgtggagatcagccggggatcgtacgccggcgatggcgcgtcggattacatgccctattttgaggtcaagcccaagtagtcatcattagattgtaaattgatgagggtgttgtttgtttcagtttttttttcctttgttctttctccttttcagcttgtgatgaattgtaaattttgtatgtgttgcgagttgcgacagattaatatatactgctacagattctttcaatttttcactgtaccaggtgcaattatacaaacagatcaattacgatacgaattttatatttggtgtttgaatctcgaagattaagatgaagataaaaattaagtgtttcacgtaaaacgaggtgattataatgtgtgattaattaagttttaattattataaacttgaaaaatagattaatctgatattttagaataactttcatatagaaagtttcagcataaaacgcacagtttagcagtttaaaaagcgtgttatttggattcgaacggcctcttagtaaagagtagattgtattagtagtacgagaacttgcaggtgggtacgatttagtgcaacaactcgaaaaatatgcagaccgatacatgaaattggcactcaagtgtattttggttaaaacgttgttacgtacatatgattcaacatattttgtttgttatattataatcataactactagattattggtcatgaatacaattgaatatgtttaactagtagaatcgctcggaaattatgttacaacaattcttatacacttagttttaacgatcattatatatttcggtttcaaatcgacaggatatttattattataagcaagcaaataaaatacatctagaccattattatttgataatcattatacttattagattattggcaacgactactgttttttttactatgtggcttaaaaggtgtggtgtctaatattattttttttagccagaatgcacatactagccaagttgttacacctaaatgatcattttttaagttgttacactagattgcacccacctatcaagtttatgtatcgtggacacaatttactctctagtaaatttcctaaaacccacctactatggttcaaatttcacaaaattccaactactatgatcctaaagtttcacaaataacactattgataatttgtattctaaagaaaaacattattgatcattttgattttaagctatcacaattattttgactttaagctatcatatattctggttttgtggttaaggaacataaaaaaaatctcactattaagttgagtgacctctgacgaacttattcttacatctatataggacgtcaaagggcccactaggcctcaccaagggtagtggcacgggcagaggacaaatttcataattaaaatgcccaatatggcaaattttgtggttagattaaggactccatcgaattattggcaatgttcaatcattcgaaaaccagcaattttcctcataaaataaagtaatactagtactaacctaatgaagccacgaaccttggttgcatcaatcaagctaacgacctaaatgattcgggcgccttccacacaagaaaaacacacatgtactgatgtacacaacatggagagggaaatggctacaacaacgcgcaagattaataaagcaacatattttgcctctgaaaggacggaaaagaattgaaaatattcattatttctaattttttttaactatatacacggttttagaagaattgtgaaaatatacgcgtcctgcgtgatgaaaacgtggaccgtgtgtttgacgtggcacgaaaatgcaagagcaacgatcgacgcgatcccgcggtgtgggcgcgtggaaccgcgtctgtcccgcatgccggttgagcggcaccgaatgcgggacggcatgcttgcatgcagccacactttcttgctggcggtcgtgcgccactggctcgcgggaccgctcaaccgacttacggtaccgcggcgccggttcgcgggatcgacgcagtcccacactgccgttccgcgtgaccgcctcggtcccgctgcgccgttctgcgcgaccgagcgggcgtcggctcacagcttgattccacaccctcgttctgcgtgaccggtcccgtacccatcattccgcggcaccgctcggcctatcggtcccgcgccgccacgttgcgctttcgttccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttgatagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggctccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacattcattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcagtccgggggtacggcacggtcaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtactgaagatcccggctgcaaatcctgcaggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaactggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccttaggtcgaggtcttgctccgacggtaggcgccaaagcccgtggttgtaccgaaccagctgaaggtacgacgtccacggcgctacgacaggagaagacgcccatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagctagcgatgatcgctcccgcgtctgtcttcgtgcacgcctcacagaggacatggtacgtggctgctagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttatcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacctagttgtacacctctgccaaattggttgtcattatgccataccgagatctatcggtgtcgaataatagagaccacttctccttacgctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcattgtcaactcatccaacttgtcccacaactcattaaatttcttctcttggctctgtgcacatagcctcttaaagagctccataagatgcttgttcttgaattgcttgtagaaatttgcacccatgtgacgcatgcactaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatagtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccattttcacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggtgatttttaaaaatcgccctcccagagggcggtaggcgactacttccgtcaattttcaaaatggaaaactatttttgtaaaacttttaataaaaaaaattaaaaataaaaaaaattcccaacacgcgcgtcccccgcggctggttggtgggccggcccagtatatacagcgtcgcgtgggctctcgcaagccgtgggctctctctctctctctagtccgcttcttccctgagttcttcgtcttccccaacctcacgcgctctagcgcgcaatggcgaggacggggcggcgcggggcggcgccgccgttgctgctggcggcgacaacgccgacggggttctgcgagaccaatggagtggacggtgagttgatctctcagcactcactaccggcgaaaagcaaaaactgcttggctctcggctaatccttggagaaatattcttggggcagttgacgcgctgcggggtctgatgcagcaatggaggaactacccgtcgagctggaactccggcgacccctgcggcggcgggtgggacggcgtcatgtgcagcaacgggagggtgacatcgctgtaagagcccagctccttctgctgctaatcaccatatcacgcgagatcattagagttccggtcacatcatgacgaaattttttttataagttagaccttttaaaaatataattttattaagagaccacccggaaaaatattttcaaaactaaaccttttgactatgccaatagcagtggcgtggccaaacagagtggcggcaccaatggtcatggcatggcaagagctgccccatggcgatcgttgctgttgaaatcgtcaaccgggcgccaatgtggcagttttgccacgcccggtacttgccacgcccggtttgctggcgtggcaaactgtttaaatattttaaaggaaagtgtcatggttagtttgtaaagaaaagctgtttaaaagttcatgtgtgggattagtttgtatttaaaaaaatagtacttgacgaagcttggggctcctcaccgggagaccgcacaagcccccctttgccggttcggccgggggcgctaggtgagtttcttcaccctcgatctgtggaatgttcgcgagagagcaaaacgcacgagacacgggcgatgtagacaggttcgggccgctgagaagcgtaataccctactcctgtgttctggtggatctgtgtgtgaaggagttacagagagtcggagagcaagagagttcaggctctagaacccctcttcctctttctctcctctacgagctcaggtattctcagagtcgtctcagagtcctccctccctttttcgttctccatcatcccttttcggtgggcaaggtcctccttttatatctcaaggggataccacatgcaccacttctacctactcttcttttgggtggggacccaccctatcttgaccaaaaacttggctcgcgccttcgcctggaagctaaatcacagcttgtccttgagtgaggcccagcgccgtcactcgcctccacttcgccggaagtagatgcagcgtgggagcacggttgtctgccgatgacgtgaccggcgtcagaccagtcacagaccggtcattcttgtccaccacgcgtcagtttagcatgccgcacatctgcccttcttcatacaatgacttccttgtaatggttgcgatgaagcctggcatgaatctggccgggactgacgtgccaactccaggagttagcacgccggctccggctagggacgagtgcctggaggctctcatcattccgacgggacagggcgaggcatgtgacaagccgcctggtgccacctaacccgcgatctgac

SEQ ID NO: 10636 - DNA, 8348 bp, Oryza sativa
ccctcggggagacagagggaggggtggccatgtcaccctcgggcccgacccccccgagggggtcaggccacgtgggtgaccgcggctgcccaagcttctagtcacgatacccccggtcccatgtcaccgacagtactaaatgggtaaagattggataaagtatatggggtatttgtgaggtattattagaaaacttcgtgtggttttgatggacctgttttatgtgttgaaaatatgaatggttatagggtgtgtttgcaagtgcaggatgggaactcatccctcctgcacgcaaaacggagcggctttttaacacatgattaattaaatattagctaatttttttaaaaaaaatggattaatttgatttttttaagcaactttcatatagaaattttttgcaaaaaacacaccgtttaatagtttaaaaacgtgcgcgcgaaaaacgagggagaggggttgggaacatgggtttgcaaacacaaccatagtattggcgattccttttcgtttgagtaaattttacaaaactacaggtattttgaccaaattatcacaaaactacagatttaaggagttgtatcataaaactacacatttagcatcaaatttatcacaaaactgcagattttaggttaagtatcacaaaaatacatatttaatattgaacttatcacaaaactataacttttggagtttaaatccctagcaccattgttatggtggagctataaacattattactttgtgattaaattggttctaaacctttagttttatgataatttagtaactaaacgtgtagttttgtaacacttcatctttaatatgtagttttgtgctaaatttggtgctaaatgtgtaattttgtgatataattccttaaatatgtagttttgtgatagtttggttataatatctgtagttttatgaaatttactcttttcgttttcactgcaatttggaatgatggaattgactagatccggcattaccgatgggctgccgaacgctgtgatgcggttgatcttgagcgatccgggacgccacaagcaccgatgggttctgggagttcatacggctggtgcagcagtgtgtcaatagcagccgggatgtgcgcccaaccatggtcgccgtcgagaggaggatcgaagacatcctgaactcggttgtcaggtcatccaccaccgggttcatgactgccggaggcgacacacccagcaacgagccaaatcgtgaagataacggaaacgagccaaatcccagcaacgagatcgccagggactagtagtacgtacagcagtggtgatttgtcatataggtgtatatcggctgttttcgcatctcaaggcctcaagcagtgtgtgcaatctggagtagtatataaatatgtaaaatgttcatttcgatatactgtcaaatgcgtgtaaattaaccaatgctaaaacaacacactgtgactaaatttactgagttggatgatgaggatgattatgttgcgtgcacacctgatcaggaggacatataatataggccatttgggccgtcttggacaccaccgtttgatttgtatgaagttgggccgaactatgcaagcccagaggcgctgcctctgtgccacggcccacgggcatcgctggatggtcaagcaggtgatcggtggagcgccaatggcggcggcgagacacacagcgcggcgcgcgcgcgaacgtgcggacgcgcgcgccccggccacggccgccgcgctcgtctcctggcctcccgcgcccgctacaaatggcggccccggcgtcccctcctcactccgaagcttcccggttgacgacctctccggtctcccccctcaccccaccgcaacccgggacgtcttccatggccgacggcgccgccggccccgcctactaaaccaccctacccaccccctccaaactcccacacattacatccttcaaagagagcatcacacacacacacacaccagcctagcgatcacatttccacgatgacgacgacgacgcgagtggcggccgccgccgccggcgtgctgctggtggcggcggcgctggccggcgtggcgcgcggcgaggacccgtacgtgttcttcgagtggaaggtgacgtacggcaccaagaccctcctggacgcgccgcagaaggtgatcctgatcaacggcgagttcccgggcccgcggatcaactgctcgtccaacaacaacatcgtggtgaacgtgttcaaccagctggacgagccgctgctcttcacctggaacgggatgcagcaccgcaagaactcgtggcaggacggcctcgccgggacgcagtgccccatcgcgccgggcaccaactacacgtacaagtggcagcccaaggaccagatcggcagcttcttctacttcccgtcgctagggatgcaccgcgccgccggcggctacggcgggatcagcgtcgtcagccgcctgctcatcccggtcccgtccgatccgcgtctaacagaccacatggtgctaacgtcgagctggtacaccaaggacaacgccgccatggccaagatgcagaacgcgggcaacatcttcgaccgcccgcacggggtggtcatcatcgtcaagtccggcaagacgcagctcgaacggaccatgttcactgtgtaggccggcaaaacgtaccggctccgcgtatgcaacgtcggcatcaaggcgtcgctcaacttccgcatccagggccacgacatgaagctggtggagatggagggctcccacacggtgcaggacatgtacgactccctcgacgtccacgtcggccactgcctctccgtcctcgtcgacgccgaccagaagcccggcgactactacgcggtggcgtccacgcggttcatccacgaggccaagtcggtgtcagccgtcatccgctacgccggctcgagcacgccgccgtcgccggccgtgccggagccgccggcgggatgggcgtggtcgatcaaccagtggaggtcgttccggtggaacctgacggcgagcgccgcccgccccaacccgcaggggtcctaccactacggccagatcaacatcacgcgcaccatcaggctcatggtctcccggggccacatcgacggcaagctcaagtacggcttcaatggcgtctcccacgtcgacgccgagacgccgctcaagctcgccgagtacttcaacgtcaccgacggcgtcttcaggtacaaccagatgaccgacgtgccgcccgccgtcaatggccccctccacgtcgtccccaacgtcatcaccgccgagttccgcaccttcatcgagatcatcttcgagaaccccgagaagagcatggactccgtccacctcgacggctacgcttcttcgccgtcgggtacgtacatacatcgccccccattactactacctccattaaccttttattaaagataggcttggccattcattttatttttaaaaaattatataagtatcatctattttattgtaatttgatttatcgtcaagtgtgctttaaacataatttgattttttttatatttgcataaaaaattgaatattatgaatgatgtatatgatctgatactactgttaactaacttactgatgcgcataataataaaattttttaataagacgaatgatataaaaaaagttttttaaattacctccatttataatatacgatgttttttttacttttaacattcgtttataatatatgttttttcacaaacgtttgagttttgaccatttattttatttaaaaataattatgcagttatcatctattttattgtaattttattgtaatttgattattgtcgagtgtactttaaatacgatttgatttttctatatttacataaaatttttaaataagataaatgatggatacgatctgatgctaccgttgactgactgactgatggcgcaggatggggccggggaagtggtcggcggaggagaggaagacgtacaacctgctggacggggtgagccggcactcggtccaggtgtacccgaggtcgtggacggcgatcatgctgacgttcgacaacgccgggatgtggaacgtgaggtccaacatctgggagaggcactacctcggcgagcagctctacatcagcgtcgtctcgccggcgaggtcgctccgggacgagtacaacatgccggagaacgccctccgctgcggcaaggtcgtcggcctgccgctgccgccgtcctacctcccggcctaattcatcgatcgatgcatatatgtactgaacccgatgacattcttctcttgttcttgacattttttgtgatcttttgcttaatctggcgaaataatcaacttaatttgggctcgtgcttattgcatgtccccgcgaaaagaagaacaaaagaggagtggaaactgaaacgtacgtcctatgaagaagctgagcgccgtcgtcgtcagctggatgtaatttcgatatgccctctaaaaaccattgtaatggtggagttatattatacatatgatttcatcgctcacatatatatatatatatatatatatatatatatatatatatatatatactagctactgatgagttaaaaaaaccccatttttttttcaagtgtgattaatttatcattatttgtcagtcgatgtttttttcaatcttacgaattacgtttgaaatcgaatgacctgtagctcaagccctacccatctacacgatgggagtgtttaagatgccggaacatttctgtaatgattagtaaatgatattcgctttatccaaaaagtgttaagcatatttcatatttatagttttgatgtgctaaatttattgtcaacgagaacctaagcaaccatcttaatatataatttattggtttgttacattggggacgagttaattacttcttgattttggtgacaaaaagaaatgtgccttatatttttgttaacaaccaaatttggtaatatcggcatcggaaaagaagattagatcgaagtggagtcgaaggcggagatcgatttgagaacagagcaagaatcggctggagtccagatcggctacgattaggatcggctgggtctgagtcggactaggtaagccgatgcagccgattccgacaatacgacttggtgtatgacatcgggttgaattgaggtgcttcaagataattgccgcacatggatagagtcctgagaaggcaattgtatctattaattaaaatattttatgtaatttccttaaagatatgtttgggtaaaagtctgtcgcaaagacttatggtatcttagattttgttagagataagagtcgtgtccgatatggacatagtttgtaattttcgggtataaatagaccccgaaccccatgtaatcaattaacacacacgttcaatacaatttcggcgcatcgccacccttttgcttttgttttatttcgacgagttcttactttcgggttgagctgcatcggtttcgatcttcaacaagaggtaaaacttgttatgacggcttgcgttctcgggattagtgcttacatctttatgatactctaatcttgtttatgtaattcatcgagttatcatatatcttacataatctctagcaatatcaccatctaacccacaatcggctaacatctgttaacagagggtagccgattaggttagatatcgacgttggtttagattatataagatatctaccactctatgaaacttcagcggcttgattgtctagatattgttcttcttttcatacttaatgctgtatcagttgagtttgatctattaagtcatgcttagaatatcaatctctagcctgccttctggttaccgattagggtagtatcggagtttcagccgatcttatctaatttaactatatttgctctatatgcttcattgacacgttaaatctgccctttatgtcaagatattattgcatccaagtatattaagcttctgtttgttatattctgcttgttttaacatcttaatatagagtcgtatcggagtattagccgatatatgctagatctatccgatcggctatggtacgaacatatatagtcctgttattaatatatatttcgatctaagtgatttatactgtctcggcacggcgaccgatctatcccaatcatttgatttaagtatatatcgatataataattgtatattgctaatatctacagccgatcaagtagatttaattctttattacctatttacaaacgccgatcgatttacatatgacatcggctcaaagataaatgatatgtcatcggcacctagccgatcggctatcgtttatagatttaaccgcggtttctttgtatctatttcttgttgattgcaggatcaaatcaactggcacgctaacacacccgaaggcgagctttggacctgcactggagttaagcagatctcccaggcctcgtgtttttcgtcaacacgcttttggcacgcccggtgggacagattaggagtcagataagcaattttcttcatggccgagaaactaccgccatcaccgtcctcggctagcccaggatttgttaaagaaaaaatccaaaagttatgtttcacggacgttgatgaagggaacattgtgaccatcaatccagaaaagttcacacctgatcaaaagaaagattttgacgcgatgatgcagcaaggtgttcgcaaataaaaccgtagcctccttgttagaccgacatgtcattcttttccccggcttgctgagtacgttaagtactcacccttgccccttataataatctatagagtttgaagatgaagacgtcgacctgacagctgaggagtatctccaggagcaagttgagtatgaagacttctagatgttttgtgcctagccccaagcctcgcctgtggaataagttagttgcctaagttctttgcctagtgcgtagtcgcttagttctccgcgctgttcgcttctgtgccgtcgattttatggttctctgtaatgctgtgttgctcatatgtgggcctgtccatgatggcaacgtttgtaaggactactacccagtgatgtaataaaccaatttactttgattccacatttattctgtgtataccagctagtgtatcctgggactggtactatatcacaggtaatgcataacaccccggtgtgagtttgctgtgtttatggctaacaaatgtcggggcgttacagtgaaatgaaaatttttttatgtcacatcggacgtttgactggatgtcgaaaggggttttcggacacgaatgaaaaaactaatttcataactcgcctggaaaccgcgagatgaatcttttgagcctaattaatccgtcattagtacatgtgaattactgtagcacttatgcctaatcatggtctaattaggttcaaagattcgtctcgcgatttgcatgcaaactgtgcaattattttttctttttatctatatttaatgctccatatatatgtccaaagattcgatatgatgtttttacgaaaagtttttttggaactaaacaggcccaaagaaaacacatgcgatgatagtgagggaaatatatataccttcctcactgcctcgctgacattcgtcgtcgcatctggatcgcgaaagtaggtccacccacgagcagccatagtgttgagttcatcgatgtatctctcccagtcaatggcagatcaatggcaatgcatacgcttgaactcttcatcagtaaagtctgcatatccgttagggccataagggatcgtccttggctctagtgcgttaaccttgtctgcccacagggtggcctccttgaatacttcgtagcggcgagccttctcctcctcagtgctgtatgaacggccatactccttcatcaagtcatggaacctggccttcatggtcgcctcatcgaccttcacctcctgcttcttaatggcttcttggtagtctctcgcctccttagcaaatgcctcatcgtccgggagagtcttcccatgttcgacgtaattgagatagctagaccacaggatcttgccatctttgtccacgaaccctgcctcgattgctgcttccttgctcaggtaaggctccttgccggcgtcctgggcagctggtaacttcttcgtgacttcctccttatcctcctccctagctacaggttatgtacagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatactttaaatatt

SEQ ID NO: 10637 - DNA, 712 bp, Oryza sativa
aaaatgacaggctgccagtcaacgacacgaacaaatttccgccatcgattgaaaaggtttgcatttgagccacatcgccgcagctgtttcttctctttgtccatgcgtgaaattttatccaagtagagtgcttgttgtgagttgctatcgtgccgattgtggtctcatgggtagtgtttgagtggaattgcctttaatacatggtccatggccccattttttttgaaatgtcagtctgcttttgccatatcatggatcttgtttcacatggccctcttttgcatttctactgcaatcaagggcactgtttttttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactgaggcaaaacaaataccggtaattttgatgcagaaagcaatgggaccaacaatcaaccaagtattgacaaaccgattagcaatacctcaatccatccaggtaagcagggcccattctttgaccacttatttagttttaaaattttaaatttcaagtgccagctttaattcttcttgtaatgtgcaggccttcctatcaaacaaatcgtgatctttgatgatatatcatt

SEQ ID NO: 10638 - DNA, 12376 bp, Oryza sativa
  unsure (1)..(12376): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaaacacctaagtccccgtgacttgctgagtatgaaagtactcaccttgctctatataaatatatatagttcctccgccttgaagtaaagatgaagtgaagtgaagattagggtttcgtcctggttcccagctgtcgcctgtggtgttgggtgttagaccgttggttccgctgctgctgctgttgctggtgtttcctcgtctgtgtcttcggttgtattctcaggctgtcttgagctgcaacctaagttaaggtaaataagtcctctatttattttaaggatttgcaatgattcatatttgtcaccgtgggtaccagcactatgtcctgggactggtactgagatcgcggtttcgtaggaagtggttcgcgccgttattcctacgacacgctcctgtcaggtgccgttgtacggcggtgccggattagggtgtgacagcatagtgagcgcatagggcagatgtgttgttcgcgcggtgcctctgttagcgtggggaggatgtggtggcggggattgcgcgggcgatggacgatggatggattagatgcggtctgggtgatttcaccggatggatggatgagattagattagatgacggacggacggtagggattgatccgggtgatttggcatgtaggattggaggggtacaactcctcctttttatattagtatagataagtcgtttaactttggtcaaagtcaaactactttaagtttgactaagtttatagataaatataataatatttacaataccaaattagtttcatcaaatcaataattgattatattttcaaaataaatttgtttcgggttgaaaatgttactctttttttctacaaatttgataaaacttgaaacattttgactttaaccaaagtcaaaacgacttataacttgaaatggaggaagtacaaattatatatgtggtgaaaacctagaaactatcgttggattaaaaaatgaaggcccgatatttgtccatatcatcaagggtaaaaattttactcccaacatttttactcatgattgaatttgcgagtaaaatttttattgtttggtgacatgaataaatcttagacgttcatatttaaattcaaaggcagttttctagatttcgaatatatatatatatatatatatatatatatatatatatatatatatatatatatatatatatatatatatatatatgtgtgtgtgtatatatatatatatatatatattttcccattgacattcgttgtagccgttggtaaaaaaaaaaaaaacagtattatagaccagtcaagggacccagtggagtcaggtctaagttgtcgatcggtccggcgcgacggcggctgacgcgagaagattttttgaaggaaggagaaaaaaaaacgaagagagggtgttgtacgcggacgactcaatcggttagctcgcttcgtcgtccaccgtctccctcggtcaccgtcgccgcgcacgactcccatccatggcgatcgagctctgcccatttaagcccggggcgcctctcttcgaggacttgcaaacgcttgctgcaaggattggatcctctggcttctgttgatttggggagcttttcatcgtctcgaccgaacggccagccgccgagatcgaggaaggaggagatcgaagggcagagtgatttggcagcggtggacatggatgtgaggtttgggcccgaggagcagatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaatcatgtgtgttttttctatttctccttttttttaatcgtgcgttacaaaatagccctaaaattttgctacaaatttgcatcttcacggtaaagctaaactgcctaaagtgtattttctctagtgagatgagcaatcccatcttgtatttacctttttagaggtcgaactactaaatcaggtttcggtttttcgttataaaaagaaaatttgtgaaatgttcctcagtactgatattaatttatgcatttctatcatccaacttttgagatccaaaaagggcaaagtatcaccatcaatctgcacttgacttccatagctcagtctttctgcttggaacgtcccaccttttcttcttcttctttttttaatgtaggaagaatagtattattcgactgtaaaaactcttgcaatgtatgcagaccagccattacaagtactgaacctaacttctgcagagagcaaagcaactaatagtgacagcttagttggactcgtagacgtttgttgaatgcaatctagccttgatactccctccgttcccaaaaacttgtcaccaaacactattcacaatcaaactttgactaatctttttccgttaattaatttataaaacaattcaaaatatattatattatcaaattaccttatgtgaaaaatataatcacacaattttccatcataagagaatctaacattttttaaaatattcgggaatggaaggagttgctacttgggtgatacatggtgttaaaaatatgaatgaattattacttttttttactgaatatgagtgaattatgaatcactactccttttcaattttgaagactacttatgtcagcatttagtaccacacagtcgaggaggtagccaacggaatcgtgccgtcaataatgcttaaggaccagattacctttataatttgtgaattcctccatcaccaatacggattagtatgtgaagagatataccagattacctttttcattttttttttacttgtcaaaaggctaggtaggtagcttgagaagtacatgcatggtaaatggtaacaagaaaacatagggaaaaaaagaggagggatcaattgttcctgagcctacatgatgaattcattctgcattatattttgtattatgccactgaggcactgactagcttctactccattcttataggtatatgatataactcgtgaagttagctcccggtgctacaagggttataatggactgaatgaattgcacaaacttgagtggaacaacaggtgattaattggagcttgcttgtttttctctttctttttctttgacaggtctttttcaataaatctttgacaggttcttattatcgactaattgcagtattatctaaaaatcaactaacagtagcgatgcatattcacttctcttcatgctagtaattacaactcgtttatccatgttttaggggattctctaccttccacgcattagttgctgctgtagtctctttttatctgctggtgatatctgacctcttcagtaaggacgtccatggtgccatcataattgatcgaaaatcatggatgtctgatgccatgtttggtgtaagtttgcagccctacgcatccaggaaaccatggagaaaagagagaaagatatctgtcccaaaatgtctgaaattttaattattggcaggtatccctgggctacttcttgacagatttgttgatgatcctctggcatttcccttctctaggaggaaaggaatatgtaagtgttaatgttctgagttgtccctttttcttttactacaatttgaggtgacacaagttaacaatctattctgattgtattgatatgttcagctcttgcatcatggattgtccatgtatgcaatctctcttgctctgttgagtggcaaaggacacgtgtacatcctcatggtcctcatcactgaagcaaccacacccttcgtgaacctcagatggtaatactcattcagttttcccaaattgctcattaatcatcttgcttgttcatgtctgagatcacaattattcatgcattctttctgaaaatgcaggtaccttgatcttgcaggccggaaggactccaagctttacctgtacaacggggtggcactgtttgctggatggctggtataatttctctttgtaaatgtttccatgcaccaaccaattcatcttttgttcatcaaaaaacacgcctgaattttcatctaaaggactgccaataagtaaacaacaaaaaaaacagaattgaattttcatataaaagactaagccgatagtaaataacaacaaaaacaaaacatgcctgaatttttttgagtgctcagacatggaatggaagctgcaattatttatttaagtgtgcgtccgacaagatttgaacttgagacttgtagctccgataccttattgagtttttttttttaaactaacgataccttattgagttgcatataactaccaattcaacccaaatattaaaatgatgaaaaaaaactaacaattcacttatactccaagtgatactgatcttcttgttcttgtatgcaggttgctcgcgtcatactgttcgtatacttcttcgctcatgtgtaccttcacttcgaccaggtaatcataatcaaccaatcgtcttctcttcagggttcagctttgtgacagtctgttgttaaattagttcctggctgttcgattaatttgcaggtgaggacggtgttcccgctagggttctacagtatgatggcggtgccgccggcgatgtcggcgatgaacctcctctggttccggaagatctgcaaggggatggtcaaggccatgtccagcgccaaccgaagtcaatgcgtcaagacagattaggacttgggtaaaaggagatgcaacgctgtctggaagccaaatgcttactagcttgcttgtttgatgattaactaaactgtaatcaatcaattgattatttgaaaaccactcgtgcgtacaaaatctgttacttaagagtagatatgtcccacactctttttctttgttcttttaaagactcattgaccgtgtattatggaataggccaagatgtaatacatttataatctctctgtttcaggttataatatattttgcctttagtcaaagttaaactgctttaaatttaactaagtttatagacaaatatagtaaatttacattaccaaattagttttattaaattaataattaaatatatttttataataaatttatcttgggtcgaaaatattactattttatttctataaacttagtcaaacttgaatcaatttgactttgactcaaaacatcttataacctaaaatggagggagtattatctaaaagaaatgcaaaatcagtcactaatcacttggattttggtcctgatcgtcgtctgtttgccaggtttgtctctgcaatatctcctggatgcgtccatgtaagtgcagacaaaggcaagcggtaggcatcatcagcttcagtatatatacgtagtttaattacattgtcatcgatcgatgatgcatatatcctgaattaattagcacggtacatctacgcatggccttgtcagcctgaattaattagcaggatatatacatatataaatatgttcgcatggccttgtaacaataccaggtcaaattaacagaccacaattaaacatgtagcaaactactatgagttcagtgtgtaatagcacataggaaacgatgagtttgacatgtggaggcaccggcagattgatgctggaattctgctgcttgatgccaattagtccggccaattactcaattagtagctgaagaattaagcaagctaactggccaaattggttgatgatatcgccagccattgattcgctgcctgcaagcgcagcctagctcctcgtcgactcgtcctcaactagcgatgatcaccaagtgatctatcagctcgccattaggaagaagctactgcttcaaagctattttcttactcatttctcaattacacatcacaatcatgaaatgtgatgacttcgattaattcttaggggttctagtagctcggtttcggttttccttgagaaaagcaaagaaaattacgcatcgcaatcgtcaaatgtcagtactctgaaacctcttaggagttaacatcctacccagtttttttctctccttagcaagattacacatcagaatgacttgttcatcaatcaatcttgtaatctgaagtgtcaatgtcgagcttaactgttattgcaggagctttgttggatactagtagagagatgcagaattgctttgctccaataaatttacctctgaattttctggaaaataccggattgatgtacacatgtgatcaggatgatcattagctgcttaaatattcagtgaaactatgagctaattaaccaattaccaaagactcttaccaaaaccatgcagctctgctggctcattgtaccggccaagcttacactggccaatctgaatacagccaaagaatcatcagattgatgtttcgcagattcctgccgtgtagattgctctcacactgccactagcttccaggttgacctagtaatactactcaaatgataactagggcgctctaatctctttccaattgtaaagtacataaatagttatgaaaaaattcggaaaagacagaggactagatatcctccctattcaatattttaagttacgtattggatactacggagtttgcacacactatagttattttaaggtaatggaaacattttatttgagctacagctaatattctaaaattaagttttaaaatttaaaatttgattgcggttgataataaacaagcaagcagcctctgctggttgccacaaaaagtactcctttcgtcccacaaaatacaaacctagtactgaatgtgatgtattctagctagtacaatgaatctggagatgtcacatccagttaggtttgttttttgtgagacggagggagtatatataagcacattgctttctcttgctccactcatcttcagctatgcagaaaccctacttgattgattgatccttgataaatcaacttatgacgggaagaggttcagacatgcaagattctctaggcttgatgcagtttcttgatcatcaccagtatctatacagcagcagtagcagcaacctgccactgcagcagcctttgttgtcccatcaccaccgatttcttgaagccaatgagggttgcgccggcgaggacgactcgccggagttcgtcgagccgccggcggcggcggcggcggccgggacgttcgagcaacggccggagttaggagcgtgcaaggaggtgtactccgaggaaggcggcgcggcggaggagaggacgggcgtggcgatggcgggggccgacgtcgaacaggtggcggtggaggatgaggaggaggctcacggcgtgcggatgatcgcgctgctgatggagtgcgcggcggcgatgtcggtgggcaacctcgcgggcgccaacggggcgctgctcgagctgtcgcagatggcctcgccgtacgcggcgtcgtgcggcgagcggctcgtggcctacttcgccagggccatggcggcgcggctggtggggtcgtgggtcggcgtcgtggcgcccatggcgccgccgccgtcgtgcggggccatcaacgccgcgttccgggcgctgtacaacgtcgcgccgttcgcgcggctcgcctacctggcgtgcaaccaggccatcctcgaggcgttccacggcaagcgcctcgtccacattgtcgacctcgacgtcgtccccggcggcgcgctgcagtggctctcgctcctcccggcactggcggcgcgcccgggaggcccgccggtgatccgcgtcaccggcttcggcatgtcggcgtcggtgctgcacgacaccggcaaccagctcgccgggctggcgaggaagctgtgcatgtttttcgagttctacgccgtcgcgaagcgaccgggagacgccgacgcggtcgccgacatgcccggaaggaggccgggggaggcggtggccgtgcactggctgcgccacgccatgtacgacgcggccggcgacgacggcgcctccatgcggctggtcggtggctggagccggcgcggtgacgctcgtggagcaggagagagcacacggcggcggcggcggccacgggcgcttcctggacaggttcgtctccgcgctgcaccactactcggcggtgttcgacgccatgggcgcgtcgcggccggacggcgaggacgcgagcaggcatctggcggagcacggcgtgctcggcagggagatcgcgaacgtgctcgccgtcggcgggccggcgcggagcagcggccgggaggggcccgggagctggcgggaggtgctcgcccggcacgggttcgcgcacgccggcggcggcggcggcgggcgcgcgcagctggtggccgcggcgtgtccgggcgggctgggctacacggtggcgggagaccacgacggcacggtgcggctggggtggaagggcacgccgctctacgcggtgtccgcgtggacgtggtgctccccgcctcacgcgcgtgcttaatcgaagctagttttaatcccttttgattagcacaaagtacatggtgattaagcactaagctaatcacccgtgcgtgccaaagccagactggtctcttgcaagtgggcccacgtaggaatagtcacatatgcaatgtattgtactactactactgtggctcctgggccaactcgtcagttgccagctcgggtatatttatccttatatatgcttgtatccacaattctacatcaagtatacaatttttttactgcactgagtataatatagtgcatctaaagaagaatgtttacactacactccctccgtctctaaatacaagatattttgtccgtctctaaatacaagatattttggttatgtgacatatcctagtacaatgaatgtggacaactttcttatactaagatgtgtcacatccaatcaaaatctcttatatttagggaagaagagagtactatttatcactttgtagtactacttatcatatcaatcacttccaattcaaattccccctactctactgccaatcatcatcccgaatcaaactatacattagtatttaataaaaaccattagtctttttttaacctctaattgcagccccaagaaatgaagaacggcctgagttggatagttgcatcaaagacttcaggaaataagatgagctatggatcttgatggtcatttagagaaagatgatgaatattgcaccattgcaagggtatgagtactatcaaagtcaacgaattccaagcatggtttcaacagaacgggcacagaatatatgcagtattttttttgggttaatgccccatgatcctaatctactgaatctacaagccccaaaaggctctcctaaactacaacaccctcacccattttgtgatgctggtgtacgaatcagcatctgtccaatcctcactgtacattgatcaatgaacaaatggaactactactcaacataccacggtagacgaccagtttgcaaaaaaaaatcaattttacttcatatctcagcagcatcctgaaagatcctcagtagtttgggcggtgctcactgaagcccctctcctctcatcaaatttcccgcatacagtgaactctcgctatcgcacaaggtggtgctgttcgtcgaacatggacttccggactccaggactaacaaaattgccttgttcatggattcacattgcaatctatcaagaatggatcatcccttggcaggtaccttctccaatatttcctgtatcgccgtatgccgagttctaaccacggtttcatgttgccgttgtagtgcaatatgccagctttctttatagcaccatgattgactccatagtcatgaccaagaccagactggatccactgtgcttcaataggatggaccagattttgaaaagcaagcaggcctgcaggtaacaccgcagctctccatgacgcttcagggccatgttgcagctgtcaaaagtgagacataggcacaaccgtatcagttaagaatttgcagctcttcgcttaacaggccaaacgtgcaagaaaaaaaatacatatcttaaataaacttcaaggcttcaagcaagtttatcttattagtgaagatcacggtacagtagggtaagttcagttgaacacaaacagaaaatcaagagtatagccatgaggaatatgccttatgtcaaatataacatcgaaagtagtttcttaaaaacaattcttgaaagagagaagaaaagacagctgctaagcatcactattcaatactaaccttttggagtactcgattacgaactgcagtcacatcatgctccctccatttattgagatcaataacactcactccagacatccagatacatgaactagcatcatatgggaagtcaaccaagtatggtctgagatgccttaatctaactcgacaagactgtacagcaccaatcacttttcctttcaaatcaagattccatatgtgtgacaagtctctctggactatagtatcatcttccaaaacaatcacccgtttaagattgctaaacagctcaggaagcaagaaaagagagtgtccaaacactgaaatatattcagttctcatttgggtatttggaattcgggcattgctatgggaagcgatgcggaactcctcatatggtgataagtgttcaactctcctattatccaaatgtgttgcttggaaatcttcaaaattcagaacaccgatagtggcttccttgtaagaatttctaatgaaccaattcttaaatgcataaaagttctgtgcatcagtaacaagatgaaaaaccacatttgctgattcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagcttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatgttattcgatcaaactacagagtgttaatacatttcacaaaataataaggactacgaacatgctaggtgatgaaagagataatcctaaggaatcattcaggtaatgctcaatcaactgtaggctgtcaattatgcataagttatcttgtatacgtgcatattagacgacagtggatatcaaaatctgtgaaaataaaaaacaaacagtgaagcacaacagttagtaggtagaccatttttggtgcaaagtcaggctgcttaaatacccaacagtttcatgtatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatac

SEQ ID NO: 10639 - DNA, 505 bp, Oryza sativa
cctctttgtttaagcttaggcttattggcctagacttttaagtcagcttattggcttatatgatttataagccagtggatttaatgtcctaagtttaatggtagagtcatacatttatctcatataagccaaaaaaagcttctccaacctagcttttggcttaatagtggtagagtggcttatggcttaaaaaagccaaatgaaaaaacttgcctgttttgttttggcttagacttttcgacttataagttggcttataaacctaaacaaagagggccttagttgtttttctccgaaacccatcttaatttggccctttggctagatagaggtggttggcgactccatatcaccgcaaggcgtttaggtgttgcgatcgtgctcgtcgacttgtcaaaaaagttgccaacaaatggttctctagattgtcacctttttaataatgtgaaggtgttggactggtacacaagattccaagttattctaggtgttgcaaaaggattac

SEQ ID NO: 10640 - DNA, 1157 bp, Oryza sativa
agtagtaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatct

SEQ ID NO: 10641 - DNA, 8935 bp, Oryza sativa
taagggtcaaagcaagccctttaattcaattctttattcttacattaaagaatgaatcaaatctccccaagtaggattcgaacctacgaccagtcagttaacagccgaccggtctaccaatgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaagcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaaagaaatgaaactcattatcaaaggtagggatatgaaaagaggaagaagtcgagctataagaaaaaatccccgcagcaaccatagttgctgcgtgtataagagctgaaatgggggtggggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatcccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggatacccatgcatattgatatgtatgttccataaaaaaagaaattgcaattttactttgaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagtatctaagtataaatactaagaaaaagaagaaagatggattgatttgcggcaatagatgtctttcacatacaactagaaaaaagtaatttcctttttgaatggcagttccaaaaaaacgtactttgatgtcaaaaaagcgtattcgtaaaaatctttggaagaaaaagacttatttttccatagtacaatcttattctttagcaaaatcaagatcattttctggcgtcagcgagcatccaaaaccaaagggtttttctcggcaacaaacaaataatagggttttgggataatatgaattgacctatcccccaaaaattccaattatttaatatgaataattaggaataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttagccgccatggtgaaattggtagacacgctgctcttaggaagcagtgctcaagcatctcggttcgagtccgagtggcggcagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaacgcaaggctttgccacgtcgggtctttttactgaaatgcatcaatccccaatactagtacctgctctacaatctcagtggttaatgatgcatgtcagtatgatgttactaagctatgcgactcttttgtgcggatccttattatccgccgctcttctaatgattagatttcgaaagaatttagatttcttttaaaaaaagaagaaaaatgttttaagcaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatct

SEQ ID NO: 10642 - DNA, 935 bp, Oryza sativa
aatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattccccaacaaaagagaaaagaaggtatttgttggcagtagatgagttttactaaatcaaaattgtggttctttagtgatttattttagatttgaaattcttataattttgactcattctaagtatttcttattgccgagccatagtaattgcacctttaaagaaactagaagaattatggaaatgagttcaaatggaaaataaaaatcggctgctaaatgaatcccaatttgt

SEQ ID NO: 10643 - DNA, 259 bp, Oryza sativa
caatttctaaggaatcaagatatcctcttgttccgatataaatagtagctatctgctcttccactggaagaggatttgcttgggattgtttaagcaattctcgtaatcgtcggccccttgccaattgattctgacttgttttatcgagagcagaggcgaattgtgcaaaggcttgtaactccgcgaattgagctaattccaattttgatttgccagctacttgtttcatggctttaatttgagccgcggatcctactct

SEQ ID NO: 10644 - DNA, 113 bp, Oryza sativa
tgcgttgaggcgcagcagttgactggacatctaggggtaaagcactgtaaaggtgcggactgcgcgagcggtaccaaatcgaggcaaactctgaatactagatatgacccaaa

SEQ ID NO: 10645 - DNA, 611 bp, Oryza sativa
gccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggagctttaccaactgagctatatccccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagacttcttttcgggagcgattcatccttccgaacgcagcatacaactcttcggtgtactgcgctctttaagtgtgctttttcc

SEQ ID NO: 10646 - DNA, 271 bp, Oryza sativa
tccagattgagtctcaactattggtaaagcagtcatacttccttcccctaaaagagaatttaatttagcggctctttctaaaaggcgtgaatgcaaataaaaaacatcccctgggtaagcttcgcggccggggggtcttcttaatagaagggacatttggcgataagcttgtgcctgtttggagagatcatcataaattattaaagtatgccgttcgcggtacataaaatactcagccagggctgctcccgtataaggagcgaggtattgt

SEQ ID NO: 10647 - DNA, 802 bp, Oryza sativa
cacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagcaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgt

SEQ ID NO: 10648 - DNA, 697 bp, Oryza sativa
ttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaaaatatcctctttaaaaagtagcttagttccatctgctatagcttgaaccagtcccaaggggccagcatattcaggaccaatacgttgttgtatcgatg

SEQ ID NO: 10649 - DNA, 184 bp, Oryza sativa
ccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacattccacagcttcggcagatc

SEQ ID NO: 10650 - DNA, 3078 bp, Oryza sativa
  unsure (1)..(3078): unsure at all n locations
tttcgctacggctccggtgggttccgttcccttaaccaagccactgcctatgagtcgccggctcattcttcaacaggcacgcggtcagagatcactttcccctcccactgcttgggagctcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggggggccttgctgattcacacgggattccacgtgccccatgctactcgggtcagagcgtaagctagtgatgctttcggctactggactttagccatctagggtgcggcactcaaccgcttcgcctagcagcacaacgcttgtattgctctcccacaaccccgttttcacggtttaannnnnnnnnnnnnnnnnnnnnnnnnnnnnnnnnnnnnnnnnnnnnnnnnnnnnnnnnnnnnnnnnnnnnntttcagttcgccaggttgtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggagctctaccaactgagctatatccccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacgggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 10651 - DNA, 22263 bp, Oryza sativa
ccatgagattcatagttgcattacttatagctttcttattcgtagacaaagcggattcggaattgtctttccttccaaggataacttgtatccatgcgcttcagattattagcctggagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtcctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaatacccaatatcttgcttcagcaagatattgggtatttctagctttcctttcttcaaaaattgctatatgttagcagaaaagccttatccattaagagatggaacttcaagagcagctaggtctagagggaagttgtgagcattacgttcgtgcattacttccataccaagattagcacggttgatgatatcagcccaagtattaataacgcgaccttggctatcaactacagattggttgaaattgaatccgtttagattgaaagccatagtactaatacctaaagcagtgaaccaaatccctactacaggccaagcagccaagaagaagtgtaaagaacgagagttgttaaaactagcatattggaagattaatcggccaaaataaccatgagcggccacaatattataagtttcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaatgttgtaaatgaagtgagtgaaaaatcaaaactcagattgctcctttttagattccatatggggtgcccgggactcgaacccggaactagtcggatggagtagataattattccttggtacaatagagaaaaaaacctctccccaaaatcgtgcttgcatttttcattgcacacgacttttcctatgtagaaaaggctatttctattcggaagaggaagtctactaatttttttagtagtaagttgattcacttactatttattatagtacagagaacatttcagaatggaaactgtgaaagttttaccttgatcatttatcaatcatttctagtttattagttttgtttaatgattaattaagaggattcaccagatcattgatacggagaatatccaaataccaaatacgctcactgtgcgatccacggaaagaaaagtaagttgttttggcgaacatcaaagaaaaaacttgctcttcttccgtaaaaaattcttctaaaaataccgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaaccgatcaagaatatcccaatccgataaatcggtccaaattggtttactaataggatgccccgatccagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatctttctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactatttcaattcgagtagtagttgagaaagaattgtaatatatgcaaggatggaacatcttggatccggtattgaaggagttgaagtaagatatccaaatggttaggataggggatttctatatgtgctagataatgaaagtgcaaaaatttgttttctaaaaaaggaaatattgaatgaatagatcgtgaattttgaaactttggtatttcttttttttccggacaagactgttcttgtagcgagaatgggatttctacaacgatcgcaaacccctcagatttgaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggaaggattcgaccctccgagtaacgggaccaaaacccgctgccttaccacttggccacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctctggattcttatctaatgatccaggacgtaatcctgggcgtgacgagtaaaaatccaaaattttttcttacaaaattggatttgtttcatacatttatctacgagaaaatccggggggtcagaattccttccaattcgaaagtcccaaacgatccgaggggcggaaagagaggaattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttctttagacttagaccacgcaaggcaagaatttctcgctatttactatttcatattcttgttcctagatgttctatagcaataagaagaaatcgcaccccttttccgctacacataaaaatggatttcgaaagtcaatttttctttcaaatatctttactttttttcagaatcctatttttgttcttatacccatcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaatagaaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccgaaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctgaggtacttcatctaatttcctccgcagtcttaggcttcggtggcttttatcacgcgcttctgggaccgaagactcttgaagaatcttttccattcttgggttatgtgtggaaagatagaaataaaatggcctccaattttgggtattcacctaattttgttaggtataggtgctttttcttctagtactaaaagctctttatttgggcgggtatatatgatacttgggctcctgggggagaagatgtaaaaaaatttaccaatttgaccctaagccccggtgttatatttggttatttacaaaaatccccttttggggaagagggttggttggttagtgtgaattttttaaaagatatattgggggaacatgtatggtggggtttcatttgtgtattgggcgaaatttggcatatctaacccccccctttggcatgggctcgccgtccatttgtatggtctggagaagctcactttcttatagtttaggcgctccatctgtctttggttccatcgcgtgttgtaatgtctggttcaataaaacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactata

SEQ ID NO: 10652 - DNA, 63097 bp, Oryza sativa
  unsure (1)..(63097): unsure at all n locations
taatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatagttttttctaccacactttaaagtctttctattatattatcttgaatctacatagaatagattactagattgaaatagtagtctaattcaatttcttttttcactgcatccacttaatttcaatcaagtcaaaatgaaaaaatccatggggggagagaaaaataatatgagaatagactatagtaaaagaaaaaaagtaaaagggaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatatttaaaagaaattctagtactacgaaacaaaaagagaaccttcaaattgcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaagcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgttattaatgtgggtatttccgtttccagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaaacaaacttttttttgccataatgtgccgtttctactatctaccaagtatacgggtctaatcctagatggaaaaataaatagaaaaagaaatctaagaaggcggtcctccccctccatcaagagaatgaactaggtgctgatacagtacaacaaaattacctaaattacacaaacttgcctgatgttgaggcaatcaaaaaagcggcataagtgaatatataacccacggaaaagtgagctaatcccaccatcttgcttgcacaatggaaagagccacgggcttatctctccagcgaattaaattagccaaaggtgtccgttcatgagcccatgctaaagtctcaattaattcctgccaatatccacgccaggaaattaagaacataaaatcagtcggccacacaagatgtgcaaataagaacatccacgcccataccgataaactattcatcccaaaaggattatatccattaataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacacaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaaattctgcgtatttggaccaattcaaggggaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgttttggaaccaggctaatttgggagcggctttgtgataatggaaccacccagcaaaaagcattaacgatgcaaaaatcaatgtttcagattgtggtacaatagagctggaattcattaggtatatcggaggctgggaaaatctgaaaaaacccggagggtatttggatttctaggaaaaccccggctaggttaccataaaatatttcttgccctacgataggccaaactacctgagtactgggttcaatgtgagtaggatcacttagccatgcttcataattggaaaacgggcaccatgaaagtacatgccactcacccaaagaaagataatggagagttgaccgaaatgagcactaaagacttttagagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaacctttccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacctgatgggtggttggtattccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaatatttgactaagattggatttcattccactttcatatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttgtttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatgaaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcggaaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatacgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaatccataatttttttagaattggtgtgaatccattccaatcgaatattgagtaatcaaatccttcaattcataggttttcgaaatctttttaaaagcggattaatcggacgaggataaagagagagtcccattctacatgtcaatactgacaacaatgaaatttctagtaaaaggaaaatccgtcgactttctaagtcgcgagggttcaagtccctctatccccaaaccctcttttattccctaactctaatatttatcctggttttttattaatagggttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcannnnnnnnnnnnnnnnnnnnnnnnnnnnnnnnnnnnnnnnnnnnaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttnnnnnnnnnnnnnnnnnnnnnnnnnnnnnnnnnnnnnnnnnnnnnnnnnnnnnnnnnnnnnnnnnnnncaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaacttttcaagggccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttccggcaatatcaatcaactaaaagtcctatgtatcaatccttacagcggatttgtggggtcagagagtggttgaataagtattgcatgtgaaaggaagtattcgaaaaagattttggattcgaaataggcgcattcgactaagtcgtactttgaatccaatttcaagttcgattagaagaatagaaagtccgcgaggatcgcaaaaaaaagaatcaaatcttttagattgcttctcctttggtgctattttcttattatttatataatccactcgattctttttttttagaatacttttttttaagaatactaaagtattctaaaaaaaaagtattctataaaaaatctttttttgcaaactcaaaaatacaatagtcaatattcgttataatagatagacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaatttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaacttaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactcttttttcttttttatacgggaaatgatcccaaatgacaaatgaataggtgtggaagttataattgtaaataaaccacgatcgaatctatggaagcattggtttatacgttccttttagtttcaactttagggataatttttttggctatcttcttccgagaaccacttaaggttccgactaaaaaagtgaaataatttaattgaagtaagaagtctccccatctgggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagaataggtaatcttttttgaaagcttaaaaggggggaagtaaacctgtttttattttcttgaaacgagtaccctcttcctccgtgtgaagaaaagaagaaataa

SEQ ID NO: 10653 - DNA, 5805 bp, Oryza sativa
caacgatttctacggaaggcggtaagataatattttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgataattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttgcgagtcaatttctcaattttattaactcgggacgcttttttgtattccttgaaaattcgatttcttgttttaatcaaattacgaattcgaagtctttgttatttttattatattgatgctttatcacattgctttttatgatgtaatccatagaccatacatattggaatcctatatctttcttatttctcttccttctttctataatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtacttttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattcccccgcttacctatttcttttttttttatttttgaatctttctattctgaattcagttaacgacgagatttagtattcctttcttgcactttcataactcgtgaaatgccgaggtggtaccaaattccccaaattgcgacctaacataggatttggtatgtaaatagggatatg

SEQ ID NO: 10654 - DNA, 858 bp, Oryza sativa
  unsure (1)..(858): unsure at all n locations
atataagtagtaagcccaccccaagatgagtgctctctcctccgacttccttagagcctccggtagcacagccgagacagcgacgggttctccacccatacggggatggagcgacagaagcatggaaataggataaggtagcggcgagacgagccgtttaaataggtgtcaagtgaaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10655 - DNA, 262 bp, Oryza sativa
cccttctgcctttgcactcgaggaccaatgtccgtctggcccgaggaaacctttgcacgcctccgttaccttttgggaggcctacgccccatagaaactgtctacctgagactgtcccttggcccgcgggtctgacacaaggttagaatccgagctcttccagagtggtatctcactgatggctcgggcccccccggaagggggccttcttcgccttccacctaagctgcgcaggaaaggcccaaagccaatcccagggaac

SEQ ID NO: 10656 - DNA, 551 bp, Oryza sativa
  unsure (1)..(551): unsure at all n locations
aggtacccctttgttgaaggtcgttcgagcttttcctgggagtatggcatgggttacatacttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcttccgtccctccgtaccaacaaggggtnnnnnnnnnnnnnnnnnnnnnnnnnnnnnnnnnnnnnnnnnnnnnnnnnnnnnnnnnnnnnnnnnnnnnnnnnnnnnnnnnnnnnccgtggacgaaccttgcggagaaaaccttgggttttcggggcattggattctcaccaatgttttcgttactcaagccgacattctcgcttccgcttcgtcgacccccgctttcgcggttgcttccctttaaggcggaacgctcccctaccgatgcattttgacatcccacagcttcggcagatcgc

SEQ ID NO: 10657 - DNA, 517 bp, Oryza sativa
aaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtaattatgttagaattg

SEQ ID NO: 10658 - DNA, 1706 bp, Oryza sativa
acatttaaatcattcaagaattacttactggtttggattgaataaacaaagttttcaacttcaatataataggaaatcaattcatttcaagtattcttaagcaataacagtatcaagcaggatggcatgaaagcgttattttaccttcatcctcaaatttgtcccagtcttcatcccactcaattgccccctcttgcttcccaggttcccaacctaacaaacaaggacaaactcgcagattatgtatctgaagaatgcaggaagtgaaattgcactagggcagtattttgttctactgataacatgccaggagttggatagtgtagtaccaaaaggaagctcaactgatgcagatggcttgaactgcagtccaaagtgcttgcaccgttcactaaaagctttctccatctcctctaattggtattggattcgatcagctcgaacctaggaacagtggaacagtgcacagtgttattcaagagagataggtgacaacacctaagtacctaacaaagttagaacatacctgaagcaaaccatcaacacttccaccctgtaccattttaactaatgcatcatgcagttcaaattttcctctcctgaacaaaaaccaaccaactttgattcaacacagagagacaagagataagaagattgcagcaaaaaattcaagtggtaattttatgcggtgcagcgcagagcaacctgaacatcacggaaggcatgttcttcaactgccagtttggaagctaactctgccacttgcttgtatttctcttcatacttcttagctaatgattccacctgaattaaaataaaaatcgcccatcagtgtgttacaaattaatgattcctaacacctgcatgcttccaaatatttaaaagcaagatcaaacggccccaaaaggggataaagtaataagcatgttctgtacctcacgtttatcagaggatgccctttctgtgatttcattcagcctgttgtcacaccgacttttgtacagaaccttcgacaagacaaaacaaataaaggaatgataactaaatcacattaataaatcaattttcagcaacctagttatgttcatttaaaaaatcagcacatgtacaagccagaattactttaattaaccaaatcattttgcacatgaaaactagtaagagattacaagtgtgcttacaagatcttgcatctttgtacggtagtattctagtttctctctggaatctaggacttgcttctccacctcaaccttcacaatgcaaaagagacaaaagacaatttgtttcaaagttcgtaaaagagcaaaatataacatatattaagcaatacttacggctctaactgtcatttataggaagttgggatggaaggtacaaaaagataataatatcacttaatcaagagaaaaaagctatcctgaacttgcaatcgatgagtgccaagaaacagagtatcagcatatatcagtcaacttaataatgcatggaatggaaacttgtatggcacaaagtcagaatttcataaagacattagtgggggatgaaataatttcataaggagtgaagtgcacaggcggtccttaaacttgtacggatgtatcatctaggtccctaaactatcaaaatgaattttttgggtccccaaacttgtcatgagtgtcatataggtccaaacgggcttcaacccgctccatgagatgatg

SEQ ID NO: 10659 - DNA, 18968 bp, Oryza sativa
ttactctttcataaacaactaccaacagaaagttcatacataactctgtatcatatgtggtatttgcctcttgatttagctactatggttaaactagcatctttcccatgtgtcgcagcagatcataatggttcagagtgcataaatgcaaataaataaataaataaataagtaactatcctggaatctaaaaattgtatatgtgactacatgataccgatcaaccatctgcgtgtactcgtgtggaaataagcatttttctttgtaaaaatcttttgagacagtatgcatatgcctacatgtttgcaatcacaaaatatctaagtggggattgagtgtcgaacacaccataacccccaatcaccactttcataagagtaaagattgcttgcttctttcttcaacaattggacgattcctcgtgtgaacaaaccctaccatccgctacaacaaagctattgctaaattatgtatgcaagtattatttggatatatcatagagttgcggttgcttgaatgaataataagatgtctttaaccattatatatgtgcatcagctgctgtttaccattgaagaattagcctgctcaaagtggatcaggactgatatttagatcaccagttcagtacagacagttcaggatttaaggaagtggtcaaataccttcttaggggcatcctcctgcacagctgagttcgctccacttccgtcatctttatttgcttgaggtgctgcatggttatccataccaggcatgtgaggtcttggttgccctggtctgttagcaccatccatctgtgcctgcaaatgtggtggcaaaggttgccgcacaccagtagcaggcatcccagctgctccaggacccttgtgtggcagtcctggcccaacataaaataccttatgagcgaagagagcacaacgagaggtagacacaagatatcatgttgtgacaaagttatgaaataataattgaaatctggtagccagtattatcacttaccttgattttgttgccatgacgggccgttgtatgctgttgaaggcaagcctgttgcacgcagcagtacctcatcatatttaagagagtcaggaagtgctggaggcaaaggagttccagctcggtgcctctccatcaaataaagagcaatgcaaaactctctcaaagaaagcatgccatcattatcttggtcagacaggtcccacacttgcttcagaatctctgaaaattatagaagaacatcacttgcattagacgtttgcaacagaactccatcccaaggggatatgtttggcatcttaagaaaactatcatagaaatagaattagtcgaaattataacctacaccacaagtattatggcagtaaacataacaaatcagcgtaaaacaataagctaaaacagaaaatgtgtacaagaacttcacaaaagaaaggaattagagtatcttacagacagaaacaagcatttgcatacttaggagttagaagaattaaatgctagtcatgagatcccacctcttggaagtctccaactgaggaacagggtgcgagcttccgcgccagttattttgccatctctgtccctatcaacatccgcaaagactttagtgtacttctggatgtcagactgagtaacttttggccattgagaagctgaattagaaactccagcagaaacaccagatacagttggtgctggaacactcggctttgtgatgggatgagtctgttgaggttgactgccaccagaactcactgtcggaataccttgttgagaaccaaactgagctagattcgacaggttctgggagccagatggtgtggacataaaactggatgaattaggagccatgctcgtcggaaatgaaagtgtggatacattcgacttaggctgagtaagagcagagaagatgtcattgcttgctcctaagccactggcagagccatttccagacagcaccaaagctttcgaatcttgagctgatacagcactgttgctttgtggtggcattgacgaaggaggcgttccttgtgcctgttgtccgggagccatgcccattgtactagacaatgtaagaccaaatccacccggtgttgcttgttgtggagcagttgctcctggagtagcttgcgggagacctccaacggaaccaacattgcctcctcgccaaccagcaggtgctcccatgctgcctcctcctagtggtacttgattaatcccgggttcttggccttgaagtgatgctgctggagctcctggctgagttggcctcatgaaaccagtactcgaaggaggaggctgttgattaaaccccatgctaggcggctgtgattgcattcccctctgcgttgcaaactgagttggctgcagagcaccaccctgacttgcagccggcatcatagaattgaccccttggggtcttggcacggctccggcgttcacctgctgcgaaccgccaatttgagcagagcccggcatcataccacttccctgaggccttggagcaccagcaacattcatctgcggctgcggagctccagcctgccctggagcaggtgacaccgcggcatttacctgcggcctgggagcgcccgccgcagccatctgcgggggagcttgcccgccgccggctatcttgggagctggaattctagcagcggcagggccatacagcgccgactgcactatgtcgggcgtgagctgacgcccgctctgcgccacggtgacgaggcgcagcgcgttgaagaactccggccggccgaggaagccggtcttgttcttgtcggcgtgcatccatacctgcaacacacgaagttccgacaccaacaaccatcaactcattcgaattcgcgggagcgagagagatctactactgctactaccatccaccaccgagatcacgcctaaaatcgggcgcactctctccccaatcggagagtggccattagcagcggcggcggcgagggaggaggggggtgtcgtcgggacgaacctgggcgaggacttgctgcggcaggttggcgccctggaagaaggcgacggcctcctggccgctgatgcggccgtcctggttcaaatccgcgcggcggaagtaggcctcgaaggcctccatcccagccatcgccgggatctgggccggagtccacgccgcgcggatctgcggcggcgagcggcggagatctcgggaggggggagcgtgtcgcgggcggctgcagcggcaggcaggaggcgctcttctcctctctgtctgcgagggcagtggttggggtcctcctcctccgggtgtcgagatggtgagcgtgccaacttgcaaattgccccctcaaatttttcatatttgttcgaatagggcaactttagataaaaaaggaaaagcaaaatttgttcggaattattttttttcctcgaatttggttgaattcgtttcagctttagctggaaaatcgcgtgaaactaaactaactttctaaattcgtgagatctcgcatcggatttatgatagagttgatactctttgccggacaatagatcgataaccttgccatcacttaagtgaaatgaattcatagctaaatgatacaatgatttaccacgcttttatctaaacctggttatgttttaattagataacacaaatatttcttttggccttcacatgcacacaactatattatatatgtggataggaagatttgaagcctagttttgtttttaagaaagtaagcatctatgacttcatttggttgaaaataacaggaatgctaggtaactagatcatatccatagcatccgcatgtattattgatggtcttctcggctggactatcctttggcttcaccaaaactagcacattgctgctctgattggtcgtttgggaacatcatgctctttctatatggccttgtcaagcgctcaagcttgtagacacctcgccactcctccacacacttgtttagtgtcgcgttacaccttcatgtgcgacattcatcatcagctccctttccaaccgccaacaagacttgatgctaaggggcaaggagcttattgggtcggaggtatatgttccctgccgtggaacatgttgtgctccttcatggtgtcactaatggctttctcgttcaacatgtccttcggctccactaaatgcatgtgttgctacttggattggtttttggtgcctcctcgaatcttgcatatgaaatgtgccaacaagcatctctttccatgtccccgagcaggacctcgctgatgctctagtggtgctcctcatccttggattcctagagttatggctctcgtggaaccaccagatagccgccctcatcactcgtggtttccgcacattggcaactgacctctgcagctatggtgactcttattgatcccgtgacctacaccatcctctaaatcgtacgagacgtcattgtccccttcaaccgtcttagtctacccaaggtgttgccttttttatgccttactgttcgattcctaagttcttgggcgccactatgagtctaaagggtcctttgattcatatgattggtagagaattttcataggatccaaatccctatgaaagtttttctatgcgtcttttttgattcatagaaaactttccatataattgtattcgtacacgcttcacctttctacgaaaactagcaagatataccgctttagaaactttacattgtttttcctatggcactttcaaaggtttcatatcctcttttttcttatgttttgattcccgtcggattggacaagcatatagtattggagaaacacaccacttcaattactgtgctttttgttttgtttttttcctatcccacacgcatgctagggttggaaggtggtggtggtgatgggtacaactagagtgcacaggtggcgtggcatcactgtatattcagaccatacatagcgcgcattatcgtcacccttagaatttcctccaaatggttggaacataatcaacaaaaatgtgccaacaagacgccggtaaaactagtattgtagtactgataggtattagccctgtgtcacatcctgattttcgtttcaggatttataaattatttaataaattattattagaatttatattaaatgttcattaatttacaagtgaagttaaatgtgggaaataaaatttcctaaatataaataatggatggatttaatttttattaaattctccatggttaattatactccctgaaatattctcggatttttcggagctcaattcctaattttaaccatacaaagaacatttcagtaattatccacatattgaattaatcattaaatggtctgattataatttttttaagtactttgagtgtccaagtattttcaggatttttcttgaaactatttgagcattggaagtatttttaacaattcaaagaccatttcagtgattattttaattggaaaaagttgttaaatcctctcctaagccgttgggctgatttcagcccaacatctctctccctcgcgcgcgtgctgtgcagtccaagtcggcctagccgagctccctcttctctttctttctttcctttgtttttcagccagcccaagacgaaaagtctaatttgcctccccgtgtactgttcatcttcaagcttggacagaagcccgagctgccgtcctgtgctctagccgacgccgcttcctccaccaaatccgccgcatcccgtgctccgtttgcaaaattagttgaggggaaatattcctcttatcctcctctatcttttcccccaagaatcggactttatcccgaagaaatcaacgcggaatcgaattcgttttcgagtttatctctccaactaaccctcggtttttccggctcaaatcctctcggttggagtccgatctcttcaatccaagcctataaatagcatcccctagtcgtccccttccgtttgccccaagtcccgagctcccccgtcgtccgtagagccgccgccgttgccggcgatcctccggccgcgttgcgctgccgcggtagccgtcgccgctgccgtccgtcgccgccgtcgggtgcgcacggaggagaggaaccccgtccgccccttcgcagccgccgaagaccaccgaagcgccatcgccgccgtcaagccgaaccgtgccgccatagaagctcgtcgccggtcgtcatccgtcgtcgttcgtcgcagtggttagtaccggtgagatcgcgttgttctcctctacgcgtaggtaccctccaaaagtccggccgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcataactcggattcgagtggttcaagttgctaaattcatctaaaatcgagatctacatgttaaaaatatccacatgtactgtttatgcttgttttttactgtttattaggtttttattagtctttttcttcgttttgcgtgttagcttgtcgtttccgtcgttgcgaaggttcgtgagtgcgtcggaagtgttcaggaagattaattgaagaccgattattgcaaggcaggtcacacagattctaaacacaatcctttgagcatgttgatcctatatttaaattctctatttattttaactgtgcatttattttcgaatgtcaccgggtggtgtgaacctattcctttgttatgaccaatttgcattgaataccctattctttgataccttgggtaataaattgattagcttgaaccttatatattggtttggttcagctaaatgctatatatatatatatatatatatatatatataattgcttagccatgcttagaaacattatcacataattgggataactaatgttacactatcacttatggttatatttaatggtagctcacgatggttaatcgtgttatgataattaattgataactaaaacttgacaatggtgggttgtgagcacatggttttgaaggtcgtgctcatgacaattaaggaccggttcgcgagctactgttgtgaaacattaaccgtgccaaccacaagccagcgtgggcaacggctttaccttttgtatagcatgattcattacggggtgccagactgagaagtggcgagaagtccgtgggggtcgctgggagtccatgcctctggttatatttatagagggggtgattatgatccaggaatggtgcgctgtggtgagttgtgttgtgcaggggatattgtcatagcctctattcgggtactttccagtatcgcgacgcatggtagacatgatgttgaggctgtgtcttgtgggtacagtggtgcacctctggccagagtaaaactattcgaatagccatgcccgcggttatgggcgggttgagtaatgtttttcgtgattagtctcacacctctcataataattatggatgttataactggtaataatttgcttagctcctggtttggagttagatctgtacagccgggtatggttgttcagaatggttgggcctgagcagcatgggcgtgttgttcagtattgattaaaattaatgattaaagtactctactgttttattactcttaaatgtttgctaaatgctgcttttgcaaatgaaccctatattatgccatcctttggtatcattgtgcacttgcatatttgctgtgtggcttgttgagtatgtcatatgctcatccttgcaataatcatcaaacctcttttaaagaaaaaggatccagaaggagaagacgtttggcttataccctagttgagctgcctgtgggagtggagctgaagccattgctagaccgttaattccgctgctgttttcttttcttttgtaagtatgtaacgttattattatgatggatttgtatattaaattgtcagtttgtgtacctcggctgatttctggacgaggattttatgcacaaattagtttggaaattactagtgaattttcggacgtgacaccctgttacatatgtagcaggttcatcattcacacatgtatcaggtttcgtacccacttgtgcctttatatcaacctggtatatccaagtttagtaccgtcatatcataccatgtaccagacacgtactccactaaaataaaccaacctcgtgctagcatgtcacacattatagtataatgaattagtatatagagtatatccagactttgtcacatcctagtatgaagctatgttcagattcgttgtactatgatgtatcacattttagtacagatgttagtttatcttaggataaaatgtatcacattctagtacgagattggtttatattggaacggaggaaataagtataatactattttggccaatattctttttgaaagaggggacaagtgaataaaactccattgatttgtaaaatcagaaccaatgcaaattaatcgactgtcatctcctcgctataacagcatgtcacacaactcacaacaactgcgaaagggcatgtaactcggtaattacagtgaactgaatagtaacttaaggttatgagtggttggatataaaggctggtaaaaaaaaactctctctagaaaaacaattcacaactagccagatgtatgcacagtttcacacaggcccagaagttagcgccgttgcggtggcggccagcatggccttcttcctcttcttctccctgagcttcaccaccttcctgtggcggttggagtacccgtcgctcccgaagccggggctcgtcgacggccggtactccggcagcaggtggtcaatcctgtaccggatgccgcacgcgttgcacagcgtgctcggcccgtccggccccacccgccactgcggcgtctccgtcgtctggcagtggccgcacctcttctcctcgccgcatttgcgccgccgcttggcggggcgcgagcagtgttctcctccttctcctccgccgccgccgccgctggaaacttcgtcgcggctgttgtcgacggcggcggcggcggcggtggccagctggggggataccagtgaccagaccctcttgcgtacggcggcgggtgcgcggcgcggcttcctcgccacagccgaagcttggagccacggaacgtcgtcgacggtgctcggcgtgcccgccttctcatcgccgccgcctactgctctctgcaagtccagcccgccgccaacgtcggcgtgcatgtgctcctcgctcctggagtccacgtcggcgtcggccgcgggcgtcggcggcgagcaatcaagcttgaacgccgccaagaaagggtcgtccaccgccgagaggcatctcatgacctcctcaaacgggtcgtcggggcagcacagcccctcgccgtcgacgaggtcgtcgaaggggacgtcgccgtcgacgaaatcgaaggcgacgacgtcatggagggagacgtacggcgtcggtttccgcatcgatcaggtgcaaaaactaattcgcggtttccgcatcgattaggttaaaaaaaattaggggtaatttgcgaggtttagggcttgcattagtggaggcgtcgacgaagagggagagaggagagagacacggttagtttcgtctcgggagaaaaactagcgatttgtattccgaaacaaactctgataacagaaggcttccggagagaaacacactcaaaatcggctacgactgctatcttgtattgacacacgatttctattctaaacagatacaaatttcgttaaaaaacgcctgagcggaacgggccgggagagatatctcggtgggcttaaacggaaagccagacttctcattgtaaatgggccggccggcctccagaattcggcccatgtccaattatccatggcagtatcttttgccctcgagaacagaaggggaaacagatgagttgtgggcaagatgaagagtagtattgggaaagtatttttatccttagagagtattcccttgtttcttgtacatcacctaaataaatattattttcttctaaaaaataataaggtatattaatataaaatatatcacacttccaagagttggaagctgtcaaacatcaccaggcagtcaagttgtagagatggtgaaatgtatggagaagctgcagtcaagttgctacattaggagtaaaaggtgatttttcatctgaagaccaatccagaaatattgggacaatctgactgaataactgctaattataaccaacgttttgctctaagtgttattggatgttttcattagtggtataggttgcttatgtaagtatgtgagttttctctaggtgatttctttgtatttctttcaaacttgatactgtatttgtcactgtgaacaatgtgaatattttcctttactgtttaatattgattgccactaatcatgatgtgaaaaaataactgaggcaaagaatcatgcctttctgctatgcaaaatgtaagctttattctgcgcaagggctcaagcatttcatacataatgtcaggagccgaagagctagaaaatataatatgcagctagctgatttgttgttgtcagttgtatttgagtagtacttaattttgttttctattgcatgcattgctggatcaatgggtgcttggtcaagtcagcctcctgcaactatgtcgctggtaatatgctttcctatagctgatcttttccctcttcggtcatgttttattctgttctgttctgcttaccacacctctcctcctccccaaaaaataaagtatggaacatcattatgtagaaactaaaattcaagttgactcaaattaagtagaaaacatgctagaaaaaagaagtatccctccctcactgcttcaaaagaattgagagtacaggtagtggaagaaggaagcatatggagcaataaatttgtctgcctctactactattagaggtaaagctgaaaatgatttataatctcatttggatacagttagcataaatatgtaagtcataaacttacagtggagctgtataaatattttttgtatgaattttgaatagcaacctgatatgacatccatgcacattacatttacagagagcatatgacatgcttgcaatgattagacttccgaagaaatgtgcggtgttgtcgttatgagctgtgaggcccagcaagtagagcagattagtgtgattactgattctatatgttaaaatcgatatactacatcatgtttctatgttttgtagtgcagactgcagactttttcttgatataatttatgtatctattcaataatatttttttctacagctaataaacaacaatgatgggatgatttttataagcaggacataaacgctagaaagctaaattgacaccctggtgcctcccgtttatagatgtcaccaacaagtaagagaattcctcctgtgtttatattggaatcttgttgttgcttctatctgtaaaacctgaaaaatcttaaaccattcctatgctgaataatagaagatataaaatgatatgtgttgccattgcatccttatatttatttcttcaatccacaattaactatctaaaccacttttttttgttttaattcacataaattattttcgttgctggttttagtatgaatattttgatatatctccgtgcaaaaaaggattttgatatagctatatgcatgtgcattgccaatcgattcctttccaatatgtaacagtagtcattgcaaatatactttcatattgtttctctctgttggggcaaaaactctgaaaaatgatatttggactggttgataggctcaccgggtaaaaaggtagaaaccatgttagaaacacaagtatcggggatttgatgtatatattgtttagatcatgaacatttaagttttgaacaggtttatttacaatagctgacatatagtcccttaatgtattatgaaacccacaaggaatttaattttgaaataaacatcatacatttatatcatatttttactaccactgttaatatggtttgtgcataataaaaatgttctcttgcaatatgatgagtttgatttatattagttggagaggatatatccggtttaattgatattggcttatacatgccttgcacgtgcacgatcactagtcgttaaataacgcctgagcggaacgggccgggagagatatctcggtgggcttaaacggaaagccagacttctcattgtaaatgggccggccggcctccagaattcggcccatgtccaattatccatggcagtatcttttgccctcgagaacagaaggggaaacagatgagttgtgggcaagatgaagagtagtattgggaaagtatttttatccttagagagtattcccttgtttctcgtacatcacctaaataaatattattttcttctaaaaaataataaggtatattaatataaaacatatcacactacaaattcaaatttaacattttataaagttgtaaaaaaaataagaaatataactgcgaaggtacgttaactattttcaatttgatttgttatttttcttgtatatatgtagatatcaaatttaatcttacatatttgtatagtgatatatttcatatattttgatattttttaataatcattgtttttgtaaactagtacgaaccttctctgccggatgcaaatgaagctgcatatgcaactacagtcgatttattttttcttcactcctttttaagcttccttatgcatttgtgatgacaaattcagtatccttcaacacacaaagcttacggacattttgcactcaccaacaccaccttgccacaaacccagcaagcactctgaaaagcagagttaaacaaaacgaaaaaaaaaaacacgccccaaaatgtacaggtatactcaaggagttgatccacgagaccgatcagtcagtcaatcagtcgccgacgttgagcagcacgtcccagagcgtctcgtcgacgagctcgtccagtatctccgcctccatctctgcgccggccgcgccgacgtcctcgcggaacgggccgttccacggcgacatgctcatgtcgcggccgatcagctcgtccacggagttgggcgagtccgtcggcggcggtggcgccagccacgcctgcacggtgttccacagcccgtccagtagcctcttgccgccgggggatctcctcggcgccgcgccgtaccacctgctgaacgcgcacagcgtcgtcgacgactggacgacccgcggcagcgactcgttgatcaggtcgaagaggaggcggtggtcgacgccggtggccgcagcgtcgcagtcggtggtggccggggctgaggaggacgacgacgactcgacttcctcgaacacccacgcggggatcggtttcacctcgcggtctgagaagagttggtcagagcttcgtctctgtccgtacagaccggcgatgacaagaattgctctgatgtaagctttgatggggttatctatctcgtctgtgtcgtcgtcgtcgtcgtcctggattggacttgtttctgcgagttcttgatcggtttgagcttgctccgacgatggatgctctggttctgagaaaatttatttggtcagaaacatcagatcaacattgcaagtgccatgcctgatggctgcaagcaaattcagagagcaaagctgcagttgctacttaccagaagcactcgaactcatgtccctagccgccatcttcaagggagatcggtgctcgctgaacgaagcctccaatggcgagacagggctcgggtaacctcccctgctcatctcatcaggagggctactgcaccacgacgccgggctcggcggcacctcggtggagttctcctgccacaaaacaaacagcattctcatgtcagattgagctgacgcacaaaacagaatcttgaagcagaatgtgctcaaagaattcagatttgcctcacctggaggacgccggggtggatgaggacggaaggggcggtgaccagcgttccgatcggagggagatcatcggggaatggcgactcgtcggcggagtggagcttcttgccgaacagcttcgctctcagccccagattctgcctcaggttggacaccctgcccttgatgttgaacgtgtccttcctccccttcctctcctcctccgacgatggcggtggcggcctgctcccgtagccttcctgcttgcgctgcagccgtgctccggtcagcacccgcggctcctccgagagaagcttcacgaaagtggtccccgacaccggcgccgagaacgacctgatgaggttcctcggcgataccgggtcggagtcgatcgccggagttggtgacgccttgtggtggccacgtctgaaagacctgacgtcgaactcgatcgcgtgcttcttctcctccttgctccttatcttgcccttccttgccacctcatgcctcggcttcggcctcggctcttcgttgaacgacgccgaggcggttcttctccggtgagacagtgccggcggctcggtctccggctctcgtcggagcacattcttcagcctgtcggagaggtgcttcctggcatctctgcagatgtagtccatctggctctggccattgagcgggatgtcgctgcggtacgaccgcgtcgactccgaccggagcaacgccgagtgcaggtccttggtgacggtctccctgatctggttggcgatgctccgagcaatctgcttcgggtcagccggaatgtcgccgccggcggcccacctgtccgccgccctgtcgtcggaagccatcctcccttcgagctcgaccttgagccgcttcttcacctcctcgaggaaggcctccatgttgttctccttcttcaccatctccggcgaccccaacgacgactcctcgatgtcgtcggtgctcatctcgggacagggcttcaggatcactatcttcttcggcgacagcagcctctcctcctcgtagtagaatctcgacagcggcagccgcgtcgagctggcgtccgcgctcgtcagggagaacgtccggctgccggagatcgacgtgccggtgccggtgccgctctccttgctcctcctccagtgtgcgtcgccattggagtgcgtgtgcttcttgccggcattatccttccctctgtgctggaacctgtaaggcacgatgtcagtgcacctgacgtcatcgtcgtcgagatggctctccaattccagagctctcgactgctcccacatcctgctcgcctgccacgcctcgaaatccttcttgaacttctgcagctcctcctcctgcgggtgctctcgcggctgcggtttagcccattcactgctgctgatcgccttgctcagctgaccaaagagctccatgctgtcgtcgtaggcacagacctcagcttgcttcggcgaatgcttcatggagcccttgtgttgcacgaaggagacatgcttggttgagaccatttcagaaggatctcttcttggcattggccttgtggaggttatcatgtcttgccttttctcctccgtgtggccggcggcaagctcaccggcggttgtactcattggaggtgagtccatgcccatcaacctggcaatgacacttggtctcttctgaacttcatttgttctgaaggatacgtcctcatggatgatcctcttgattggggatgagctgtggttgagaccagcttttgggtattgttgcctcatgttgcaggagtactgcacaagttacaggaagcttaatcaggccactgcaaaagttcttgccagttaattagctcttgcacaggatgtaaagttaaacattggtttatacagctccttatttattgatgaaagatacaactttgttttcacgatgaaataattcatccacatggggttagatgccaaatagtaacttatgtacccaacagtagctgggggtctactgttaggcaccattattaatggatgtttcatgatgtcttctcatacagcaacattcgggtacagatacacctagcagcaatgttactatgatgtacagaaatcataagtaggcatctcatctgtcaagagaaatctaactactttggctccttcgtgcagaaaatgaactgttagtcactgaaaagacaggttcttttctggaaacagaagaattcactagatgcttatgaggggacaaaacatgaaaggaattactctcttactacagaacagtgaggaaatgtacaagactcaccgggacatcctcttggaagacgccatagctttgtggagcctccagggtgaactccatgctattccttggggcttcaaatcctacaaattcagagatggcaccttgatcagttataaatttgcttcaaattcaattaccgaatagctggaaaaacaacatagaaagtctcaatgaactcttttatttcaagtgtacgttaactcgttaagcatcaaccatcattaaggatggggcttgtcctggtgactcggtgattcagaacttaaggcaaagaccatgtgtaagttggacagagagaaatgaatcaccgtgtatcaccgtaccttcgccctgcttcttgtgtgaccacttccttgaggtgctagcatgagagaagtccaggtactgcagcatggtggcacttgttgccagagagatccagcagtacgctgcgatggcaatattaggatatctgaaggacgaacgagacagaccttactatcctgtaaaattatgtgaggtatcatgtcagattctacagaaaatcagccacaccaaaatattgtagtgaacacaatttatgatcaccattacgacttttttcctgcaaataaaaggaatagcgcacaagacagaattcatgaagacatttgctcatttcaacaggtcaatgcatattcagcaagcttgaattccttcgaagaataccccgatcaagaacccaaaatttccaatgtgtgaggtggaatttcgtatcagtaatcaacatgaccgaaaccacagaaacatagagggaaaaaacatcagacgaactggaggagaatcttctgagaaatggtttctggaattcaattcatttcgaagcaaccatccagtcatcaagacggttgagcacatgaacagaagcaaatgatgatccaaaaacgtcaaacataatgagcagttgaaccccaccacgtgcaaacagatcagaagcaaccgcattcctcccagaaccaaacgcatgaactaaacggacggaacagagggagctgatcaatcaagcaagaagaactgaggagaggaagctacgtacaaggatcctctcgtgcctcctctctgcagttagcatgcagctccccggcaaccaccggccggccgccgccgatcagcggcgaaactgttgcttctcccaccgtggaaatggggtctcgctggggtaagaagagaagagacgccgcactgcgatgctctgcaatgagctgcaagcttcttgccaatgagcctgtgctcatgtgcaggtagtagtggtataagagttacagcccatgaagagggaggaaagcagcagccgggaaagcgaaagcttctccctttgcctctctttccccacaaccaccctccttttggtctccctccttgcctttaatattccctcttgatcgccatcttctccttgccacttctcttgtccctgatctcctcctcttttttagcctttacctcttgcaaatttttaacagatgccgggagaagatgccttaatctcttcttggcttggcattctagctagaatgcatgcatacccagctggccttgcctacatgctggtgaagaagagaaagccatgaaatgcttagcgataataattcctcctatcagagaaaagattatgttttttgtgggggctgcagatcaaaatgacagcttttcttgtatgtagccatggaagattctcttactacagaagccagcttcagtaacggaagaggagagcttttgctgagttattttagctgggatgacagctcaagtacgcgaggattctagttggtgcaccacacgctttgatcttttccgttttccctaaccacacgaggccgttccatttggcgccattctgttaactgccaccggccgttctgaagaaggcgtgggatgcagtcagcgccaatgcaatctgtatctttcttatctccccctgcgctggtcagcatcatgtgggaattggatgagatgtttctccctttaaatattcagttaatcacataatccataggagaatcacttgacagttgacacccagagttgtaccacaattttacaataaccagtgtctgaatagactgaaagaatccctacaagaaaaactgaagatgaattgaactacataatttatatattagacgttaaaagcaaacacaatatctatttaatttctccatgaccccaatatatacgcctacactacacaaggctatcatcggcgagacattttttcactagagaaatgcccaaactcatgaacacgatactgcccaaggagcagacacacatagcccctgtttaggggagcttaagtcattatcgaaaaaaaagaggagcttaagctactctcagattttccagcttttaaaacaattcagcttcttgctcaaattctaaatccagaaattaaacaaggagacagaagacgggagatccattttcttctgattctcacaagttagatactcactagctgcttcttaaaattttccaaagtccaaacagcaccatagtgctctcaaggaggagtggatagttctaaatccagaaattaaacaaggaggcagaagaagggagatccattttcttctgattctcacaagttgatactcactagctgcttcttaaaatttccaaagtccaaacagcatcatagtgctctcaaggaggagtggatagggtaggcgccgtgcaccagcgggataatcgaccccatgcgtgagggcgacatctgatggcgaggatctc

SEQ ID NO: 10660 - DNA, 35609 bp, Oryza sativa
  unsure (1)..(35609): unsure at all n locations
tcttccagctcaacattattacattacacgtagtgcacagaatttacagataaaatagaccaccgtatctcttcagagattgccttgcactttctgccttcaaaaacatcgtcaacaagtgtaaaggagctttcaatagttaaaactcaaaaactctactaagatggtccttcattcacttgccatttgctaattataaccaaaactcagagggttggcattttatggtgtctttctggaagggttttaaggggaactagggctcagtgggttgtaaaggggtgtcatgatcagtgcactaaactttaattatgtgcccatctcaatgaaaagctagtgcatctttgggtaaaaattcctgtgatcattcatatcaagtgcccccacaggaacgtgtcatgtgaagttgctgcttgcttgaaggataagccctactgaattaggtggtggcttggcaacagtggtccaaaatgctagatgcatggcagagaagagaccatctttgtccatgaattgtttttacatggatcatagtacgagattgagaagcctaatctatttttatactctctcttttttaataggtaacatcatttgcatagctgccgctgatgggattttgagatataaaacaagtcttctattctcttttgagttttgtaatgcattgcctggggtctgcttgtactacacttcaggatcagagaagatatatatgcatatagaatcagttttattttgttagtgaattataaccagtggcttttaaaatggggttaataatctgccagcacaaaatccaattcatgccgaaaaagtgagcatgcctcgacccatgaaactatatgatgcatttagaactgaactatcccacatgatttatcactcaattcgtcattaccattttagtagtcatatactctggccaaaagaaaccaaaagttttttttggggggtaagaatttgcttgaagtctctatatctagtcatgttttgtgcatttctacaattcaacatgagctcatctaagctacctggtcatcgtttaaagagaaaaaaaatataaatattaataaccaatgcagtgcacaccggggatgcataactaaactaacaggcatcatggatacaaaatgtgcagcaataatgacctagtagcaaatgaattgtgtatagtgtgtgatactagtggcaaatgcactgcatgctaaaggcattatcacaatttggaagcaagggctgtcttgaggatacaaatttaactgaatgaatttaaatacatggtcgaagaactaacaaatgctatatatttagatgtatccagtgagtacaacaatatgactgtctgctcacctttccaaggtcggtgaacttgaaaaaaatattgaggtactacaatactttcttatttgaccaaacattctgttacaaggctacaagtttatggggcagtcactaaaggagcactcttctttcgcattaagaaaaatgcagttttatgcattataaaaaatacaaaaagcagcacacagggggcagcaaatcaccttttctgcaacagactgctcaaatgattgtagacaccttctctcatggcatccctattaccagtatttaaggtgtaaataactgctccaggatgattcctcaacctcgcaactgcattttatgtggagaatatctagtcagcaatactttatttatttatttttgcaagtgtgtgggttcaggaaatcagaataatgactcatgtgtacatctgaagaaagctgtggcacaaaaatgttgttcttgtaagaatattggagttatccttcttttgatgtttgacatagcatagctggatataaggtagagtctaaaaaaaatgtgcaacttcataatacacctataattgaattggtattttagagcaaaccaccatgtaaatggtacttcgtaggagataatgtacagttagtaaaatcattaattagaagcttctgtcaagatgttaattattaagtgatggtacctccgggaatgtctcggcccaatcttggtacaggaattgtggctagcactggaatgttcgattcaataactctcattacagcagggaagaatgccgaactaaacagctccattttacccacttcatcaataatgaaaagatcagtgtcgtccttgacctgatgtgtaaaaagagttattaactccagatcacatgataaataatttttaaaccagctattctgatcattgtacaattaatattacatgtatcgcatgaatgtgctaaaacaatgtgcatcccttactttattttatacatctttagtcagaatggcttacctgcagctccggcaatgctagagactccagagaagctatatctactttgtacctcccaacagtaggccatctaacagactcgcggctgcaggaaaaaaaaacatagatgacatggacaggaattcagtaagcacacataaaaatcggattgacagtgaattcaaatataagtatttaacaaaggtcataagtcaaaccttacaaatttagttctgagataataagtagagcagaatgttagagaggacaataaggaaccgcggaatttcatgtacttataaatcagtattttgcatcggaactttcagaaggagtaatatcaaattttcctggtgatggccagtgacattaactttttttgcaactacggtggcgatgagaagcgtgtaactttaatccatttttctagttggatcatttccttgctatgtatacaatttgtcagtcaaacggatccaagttcagcaaacaagggaaaatgtcagatggacatgaggctgcacatgatccgagacatgaataagtagcttaataagctggataccagcagtggggcgatattctaccatcattgtcattgcataagtgtgcaggtaaaaaaaatacaacagatataggtaactagattataccgagtttatccataagtaagaaaaggcggcactatttaacatggacatggatgttagctacctaggattgcagctaaagtgcctgaaacttgatcatatgcaggaatacagtactccagattttgaaaacgaaaatgtccaaactaccacatcacaagtaggtggtggtggcacaggaaattgcgagcattctatcacatattcttttagcttgtcacaacagccagatgcacttgatttcagtgtatgaaaatctctcgcttcatatatgtcagaaagggaatcataatccaagcatggtagcaagatgaacccgacctggaaaccttggaggaggcgagcggcccggttcgcccatcgagcgtgacgacctcgaacccgaccctttccccactctccctcacctcgcctacacaacacgaaaacaggtgagatttctgatcgcgaaacagcgcgagcgagcgcgcgggggagcttctggaaagggcaactcagcgcagtacgggtgtagaagccgcgaatgttgagatgcgggtgggattcgcggagggtttcgaacacacgcgtaaccagcgtcgtcttccccacgccctgcgagagcggcggcggcggcggcggccgtgaggcggttgacgaaggaaggagaaagggtttagcggttggggtttgcgggatggggattccttaccggcgggccggtgacgaggaggcacctcgacggcgcggcggccatctggtcggtcgtggcagccggccgcggcgaggggcgggtcaccggcggcggccgcagcgccggcgtcggaggcaggacgggaggctggtggcgctgctgcgttgagattcgtgtctgtctgtttcggtgtttgtctctctgccacatgggcggatgggccacatggtacacggagagcgcgtaaccggcccagcgaaggcgtaaacatgaaatgggccggatgattgcttcctgggccaaagtgtggtgtacgtgatgttgggcccagccgtctgtacaggacggccaggtggaagagatatagtaatgctttgggactactatacatttgtcgacagatttttcccaaaaaatttgacagatgtaattatagtacaatcatagtgtaattacattgtaacttatatgtaattacactgtaacttgcatgtaactacagtgtaacttatatgtaagtttcacataattttgaatcgttagatctattactagatttgttttggtgaggaaaacacacatatgtgaaagaatttgttcccacgacctccattttaccgaaataacatgttacggagagatttttgaaagttacatacaagttacactatagttacagtgtaattacatgcaagttacagtgtaattacacttcaattgatgtactgtaattacatctgtcaaatttttgggaaaaaatttgtcgacaaatatataacaaaatcgaatgcttttggatgaaattcaaatgctgcatttattgcctgcttatctggcctgcctcattttgaattggaataacttaattttagaattaattgaggattttcttgctttttatattcagcttttgtaatttttggctgctacgagtaaagggcaaagtaatttgcactctgggtcacatattattaccgaaatttcacttttatcatataagaaggtcctttttcacttgaactaggtatgcttaatatatgttaggatgtggattctcgttgtatggccatgtcaacgacaaactattacgtccaaagaatttgtatataggagttgcactttgaactgggtggccgcatgtcaatgactaaccacctcttatgtctacgtgggtcgctcggtttaaaaagtgcaataattgccaacagtatctagtttaatgagaaaaaacacttcaaaaggtagtttaaaatggaactcgacaaaaatgtagtgtctagtgtgtaatttattggtaaaagcataaaaatcctatcctaaaattagtttttacgtactttggctatgccataaattgtactcatgaaaatagcttccaatttcccagacaaacgtgcattgtttccatttagtgggtcacgtgtcttataacagacattctggtttagcaaacggtaaatctaattagagaggcctctctaattagttttaaccagagacatccgcgtgctagtactttaggagttttggttgctatcaatccattgagcaagtaggggaaatattcctatcatctatgattcaaataaaattttctcttaaattactcatccgatttacaatccgattacaccgttgtgttcgtaataattaaatctttataacaagatctcacatgattatattttgatgaaaaatcacaaattacttttatgatatgtctaaattacttttagatttcactaagttacttcttagacatataaaagtaaaatcagtaaagcctaaaagtaatttacatatattatagaagtaacttataaaaaaaagtaactttaattaatgccttttttcattgaacaaaatatcacacatatatatgtgtgtgtgagagagagagagttacttttagatttgattaaaatacttcctatacattcataatgctatgagatgattacttttatttttttagttaattccataatttgtgctgattaatttaatttctagatagagtcatgtttttatctctacaacggatttacttcaaataacatgctaaagttacattcgttttgttctaagtcacttctataatatatgtaaattacttttaagttttactgaatttacttttatatatataagaagtaacttagtgaaatctaaaagtaatttagacatatcataaaagtattttgtgatttttcatcaaaacataataatgtgagatcttgttgtaaagatttaattgttacgaacacaacagtgtaatcggatcgtagatcggatggatagtttaagagaaaattgtatttgaagtataggtggatgatgcctcttatagatagagtggtagctgatttagacaagccagctatcactagctgtgtagttacgccctttagcaaactgttttgtgtgtatgtgtgaattggtatggcagagttttagcatcaactatttgcactatcatgcagtatggcgatttttgaatgtcatttgcctcgatacaacatgctgagacacatagaagtataggtatagcattaatatttatccgtatctccatagtatactactatagtatcttctccatttaacaacggtgatctttttcagagagcacaacagaacacgcacatgttttttttagccctggacacgcacatgtagacatgtatttagacatgcagtaacagcatcatgtctcaaaatttcgtgctcgaggatctgccttctcacactcattttgtctgattaagcactcttaattaaaaaacggtctgcctaaaacaccagacggaaaaatgtaacaaaaattgcgggtaatagcaatataacagttgcaaatgtcaaaattcttttgttccactgacatgtgggcccacgaccttcagtacgcgacccctggagcacccaccaatcagtttcgcccacgacacgcggtggaccggtcccacaccttccccccacccccaccaaacgcgccccgaggccggccgatccgaaaccgtctacacggagcgctcgagccgaaccccgccttccatgtgggccccacgtatccccctaccccacatgtcattgggtagggcgatcccccgcccgagccggacgaccccgccgcaaccgaaaggcccccccccctctcccaaagggaaaaaaaataccaaacgcacgcaaagccacacgcaccccgacccgttcccagccaaggccaccccccgcccgcaccaccaccaccaccacctcctcctcccgccgccgccgccgcggccttcgatggcgaagacccggaaggccgcggccgctccgccacctccgcccccgcccccacccgcggagaccccagcgaggaggaaggggaagaagaaggggcggccgtccctcctcgacctgcagcggcgcagcctccgcctccaggcccaaaaccctagcccggccccgtccccctcgcggcgggacgccaatccgtccgacgaggacgacgacggggtcgggagtggggggcgccgacggcagaagcggctcaagagcgtcctctccagcagcggcggcggcgaggtcgggcgcgctccccccctcttacctgtcgcgccaatttttcgaaatttgcccgaggtttttgggggcctccccgaggagaggagaggggggtttttgccgtgggacacgcgatgatgcggttgccgtagtggttggatctgcgattttggaatttttttgaggggggtgggtttcgtggtacggctcgctctcgtggtggggaatctggcgggagggggagatcagtgcgactgtgggagtggcacttggggatttttagcttcttggagagcgttgctttttttgggcgggtttggatttttatttggttttcctatggagtccgggtctagggatcttgaccctgtcagcgctttaatcctttccatcgaagggaacagtacgcggatctgacaagttttgacggatttgacctttttcctcccggattattgtgttgcaagcgctgtccggggttgaaaaagcgccaaaagtcttcgttttttgtgtgccaagtctggagttttgcagcacttcgccctggcagtcgcaaaaggctgacgttcctccgtttccatggcgaattcgactctgacggctcctgttcgatgctgcaggatgatgaggcgcccgcggcccccgtggtggtgaaggtgnaggtgnagnagaagaagaagaaggtctcgtcgaaagcgaccggaaaggtgaggcttggagggaagccaagcattagtgttgaagtggttaaagaatttgaaattttctcgggttaactcctccttgcgcttgtgggagcaggggacgctgcgtcggatggcgggcccactacggggactcccctcccggacaaaaagttgcttctcttcatcctcgacaggctccagaagtgagtggcccggccccatcctgatgtagttctcttctccccccaataagagcttgcctctgattgcttcagctatgtatgtgtgtatctcttctttgtactgctcccaggaaggacacctatggagttttctcggagcccgtcgaccatgaggaggtgagcaattcagttcttggtctgctgtgtatttgtgttctgaagtttgcagtgatgatgttgacaactgttttgtgttttgtgtatctgttgttgtgcgtgcttgcatgcagcttccagattaccatgagattatcgagcatcctatggacttctcgacgatccgcgagaagctgttgaatgactcgtataccaccctagagcagtttgaggtatgatgcctgtagtttgagttgctgtctccttgcgtgttgtctgttttattggcttttcattcactgacactacagatgtttgcttctgtctactgttctgtacttcacgttttttctattgctttatatctgctaaggctagttctgttattttcctgtaaaatcctaggtctcgtgtctagcttcacatgtcttctctctcttttgtttgtaccacaagtgtctatgcagttttaagtcaaactagtttatcttcataattcactttcaatgaatttgttgatactggttgttggtattgtttatgaagccactgaagtgttttctgcattttggtaacaatgtcaaggaattcctgatttgagaaagtacatttggtatatccttgttcttacacagggtcaaattattgttttttttatgagttaatgccttcattaatggaaagtgctctctggattggcatgtagaggtcgcatgtgctactttttaatgatcatcgtggactgtagctaagagaaagcccagtaaacttcataatgattcctcctattttagctccaaagttgtatccattcaataactaccagttactttatgctcactatttatagtctttccctgttgatttgcccaacttagtggtggaagcttcgcattcttctcggcaggctagcacatggttcatttgtgtgctaactcaggctaagagcaatcccaaatttgatggttctgtatactcaaattggctgcttaaactaaaaatatcaatatctcaaaacactggtaaaccatagtccatattgaaactgtacttcttggatagattataactctatctatcccttcagaagtgagattcaagttctgcactgtatggtgtttgagtccaattttcaagttctgcatcaactcaaatgatctggggatgtttgtaaatttgtttctttctagtaacggatcttcatgtgaagtggacttcaaatagccttcatgttttctattctggcacaaatgttctccagccactattatattttcttcataatgtctatattttgttttcagccctatttttctcttaaaagttctgcgcttttctcttgataagcgtttcggaggagagagtttgtcatttcaggccattaaaaaaccttttagcgacacagatatggttgctttattattttgtttttggggtttatccgtgtttatataccactgagttctatcaaaggtccataatgtgctgctaacgccaacttattgatctgtcattgtaacgactcggtgggatattttgttcttccattttgtacaatgtattgagttttgaaaaattgctgtgtagctttgcacagcaacattgttaagagttttccacttgtcctgcatatgtttgctgtatggatttttttcttctaaaattagtaaatcatgaagcaaatcataatggagtaagagtaacactttgcttaagtagtttggatcttcgcttaaaatctctttttttttttggctttactagtatgaaccttctcttaatatctaatgtttttttaatgattgtgcagaatgatgtgtttctacttacatcaaatgccatgtcctacaattcagacgacacagtctactatcggcaggtatctattttactaatgctgtaatgcatgtgccttttgcaacaggactatgtgatccattttgtagatataccgccgtactgtttgcacgcattcaatgcttggtttatataggttattcataacccttgcaaatttcttatgcttggtgcagtttcttttcgtgagacttctataaatttgtgcacctgttacacaaatggcacattcttctttttgttcctgttgtgcttttgtagttggtgtttttatttcgtgtgaatatcattgttacactaaggccaacacaagtttttttttaatcaacttcctttggtatttttattttgatactcctttggactcttagaacattggaagtccattggatttgtgttatactgataatttctacaaagccaagacacctaggtcgctatcttccacagtatgtttccccagctggtagggatgaaaacggagcggatagtttccgtccgctcaggacaaaaacggatacggatacctttcggatcggataattctcggatagttcggatacggatacgaatacggatattttctcccggatacgaatacgaatatggtaccagggtttccgtcggatacggataataattcggatatccggtgaacggtgctattcggatatccgcaggacccatgagacataccccatttctttctaactctataaccttcaatatacctttatagattttaatagtagtttatctcttaacactagtcactattaatattatttaaattttaaaaaatatttataaattatacctcattttatataaaatgagctaattatatatgttgatatttgtttccattagaagttgagttggttttcgtgttccgagaaaaaattgtttccgtattcgtgtccgatcatatttgattcttattcgtattcgagataatccgtatttgtttccgtattcgagctatccgtattcgttttcgtatccggtaaaaaatatgaaaacgaatatggtatgagcattatccgtccgtatccgctccgttttcatccctaccagctggaattatactgcagcacaaaagaaatcgatacacttgcataaatacgaggcattgtatgtaggataaattccttctcttatctggaaactgttgaaatccattgacgtgatcctttctgttatcttttgtcttaagactattttattttgcaagttagcctatctttgtggtctttttggcttccaatttcctgagatgttcatttatctacttaggcacgatctattgaagctctggccaaaaaggatttcgagaacctgaggcaagctagtgagcctgaagaagaacaacaacccaagactgtacccagaagaggcagaccaccaaaatatgcaaagaaaattgagaagactgaaaatgatgtttcaccagatttatccaatgcaaaaacaaaatctgcagaccatgctgaaacaattagaaaaaggttgactggggacagaactcgaaatgcaaatatcacaacaagagactcaccctttcttcaacataatacacctggttcttttgctggtaaaagaacagatagatttggtgattattcaggtttgtttttattgctaattgctcgtatctctacagtgctgtacttatggagcttgagcatggcttgatatcgtggtatctttcaggccttcgaagtacggaaagaagaccaccccgactatttcagatgatgagcgtcgtagtacatacgatcagcaatacttccatagtagtcctctgttttctgcccttggtggtgagaggaaagtacttgtgccggtaagcacgttcagaaaattttgtcctgaataatttatgaattaaaagatttataaaccttgccaacttacctactgaacgtttgcaactactacttggtgcattgctatctcaatgctgagttattttaattatggaaacaggtgggacttcaacagcaacatgcatatgctaggagcttggcgcggtttgctgcaaaatttggtcccgtaggctgggacatagcagcaaagagaatcagacgactactgccttctggaacaaattttggcccaggatgggttgtggatggtgagccacctgagaactctcagtggcctcgagttcccatgctctctgatccatccatccagtctactggtgttccagctagcaacgtaatatccaagaatgatgaatccaatcagaagtctggactgacttcgaacgaggattctggtgaagagcatctagctagaaccgagccagtggcttctacatctgcatgcgttaacacaaactctgtatctgccaccaagctagctaccaagtgtgaaaacggggctaatgtgtcatgtgatggtgtgggtagtactggacagacacctcccttgcagcagcacagccatagtcgagagatccactcaaatatgaatggcttcactgccttgccaaacacaattagtcaatacgcagggcaaggattcttgggacagatgcagttgacacatgctcaagttcttgggatgttttccggagtcaatggcagaacaaatggctttatccatgggcacccactggtggctaatagcattaaagcaccacaaaatggggatgttggaaaggtagccactaatccatcaccagatgcaggtcatgattcagaagctgcattatcacaaaccatgactagttctgctccaagtttaagtgctggtgttcaaccatcaggttccatgccaagcgaaaagttagcaaatccaaaaaagcacccggacttggcattgcagctctgaagacaattagccattgacatagttcagcttagcgccgtccttgattggaaacatgattcagaatcccagcttctcgagtccttattctccgcttctgctatgctgatggatattgtagcagcacactgagtggttctgagggagaattaacaatggatttctcgtcgaagaataattcattgtgaggcgaggtcatgggaaggagtaactagagccgatgaatcgtttgactcccagcaaatttgttgtaaaagggtaggtagtctgtatagattctaatcttatttccgatgataatgtttcggatgggcagcatctggcatccaatgtgtaacattatactagtggaggtatacaagcagggagggaggcaagtgcataggtgtgcctttttcctgcgaggattgatccgattccaggttgtatgagactggcggatggacgactgctgcaactccaccccagttgagctgagtagcaagtagcctgagtcaccaaaatcttgctctgagcccctgacatgattctgtgttgacattttcactgacatgattatgtagtgttttaacatttgttgatgttgctcttgactgtacttcttgctctggaatctgggatacccggatacatatgctgttgatatttgatacttcccacggtgccagcatcagggttcatgcttttgacgaaaaccgtaacgttttgaagttttgtcgtggagctaaagtagatttcgagtgaaacttcgaatggtttttgagaattaaaatctgaaacagtaaatctggctgatattttgttgaaatttgttgaaatccgtcgtactatcatgtggtaggataccccggtgctcaatccgaaaggtgaactctggacaccattctgttgtccttggttttcacagcactaaggcaatgattactcacagtttcaatcacgaagacagcacgatcggtccagttggaaggtgaaaaaaactgggccgtgccattgtcctgcggatctgcatggacattgcatgattctttgcaaggtggcctccatgatctcccgctctgaaatccgatatttgcatccgtccagatcgcagatgacgaagacgatcgagtcgtaccgatgctgctgctgctgctgctgcacccaaatcgcgtagattttactaccacagcaacgcggaggccgtatcaacacgtgaaaacggcaacgaggaggagagagcccgtgaggttgcgcgccatggatggcaatggcgtcgcataccatcatcatcatcatcatgcttggcgccgctggcccattgatggtgagcatcgagatccggttgcctgcccccggccattccattacttcctcacagtgaaactgtttcggcccgtactgtcctccggtaccagtgtcgtccactgcctctactgttccacctccactttctccccccagcaaaaattgcagctaagcttgctgctgtttccatgccaagtgtatatattcagttacaaacaaaaaaaagtacagtgtctatataaacggaatccgttcctttgacctactgacctctgtgttaacactgggtgactgatatatgggttctctaataagcgagcctatatgttagtcacccacgtcaggagcggtacgttagcggagtcttatttttatgtacaccggctaacttgactattttccttcgtcttttgagttgcaagaaatttcctttttcttatctatccgaaagtatctcttttaatgtgctcaaaagataaaagtaagaaaataattccgcggagtatagtgcgacgcggagtgagaaaggtctctctcttcggtttattcactgatatgaaatgaaatttagcacttatttttttattgattcctggggctagacgaaaacccaattaaataattgattcctattgaaataatattagggttccttcgaaatgtacaattgcgaaaagacatgaataggaaaaaacaactgaatagaatctcctagtcattgtattcttataggattttaaaacataggaaactttcaaaattactgattgattggcacacagaaaaaacatagaaatagggtttcatagtcattgggtttttataggattttgaaacacgagaaactttcaaaattatcgtttgatttgcatacaagaaaaacataaaaatttaagacattgtagtaagaaaacttaaggtgagccctcatgtttctcttcggaactgtacattattactctaaaatgatccattccataagaattttaaagaaataagtattgccccttgaaaggaacaaagggttgtttcctactggaaacaaatcctttagaatttctatgttttttctttgtttcaaagcggccttacgggtaacatgaattgaatccgtgataaaatcatgcatccacgaccatatctcacgcacagtgatagtggtttcccactcgacatcttgattttgttggaatcaatctagcaatttttgtctatcattcatctgcttgattgctatccagtagggattgattgggacgaaaagattggcttgtgatctacgcaaaaaactctgatagactgatcatgccgaatcgtcaggatttgagtggtttgcaaggaatggaagcatatctatatgtactatcatgttaagacacagcttggctgcttatgatcaggcgtcctaggaacctaagtacaacatcagcaacacggaatactaatgctaccttacgacctgatgcaactgcaagtggccattgcaaacgctataatttcgccgtgaattcatcgagcgtgcgcgcatgtgaggcgaggcatgcgacttcacatgcatggagatggagactaaagctacaatcggttcacatccacttgccaattgctaattatgcctaacctgtcattctgtcaagttttaatcccacatttcgtcagccatttggtccacaattctgcaatggatgcgagagttcagcgtatgagttctccggtttatgatctcgcatctgtcttatcccagtaattcatattatgtgtgtgctttgaatgacagtttcagtgcaactaattgcactataaagtataaacaatatactctgttttttataataatgaataagaatccgatatctatatttataagtgaatatgaaaataaaatttacttataaatttttttgaaaaaaaatgtatggagtacaatcaagtaatcaactaccacttgtcgtcgcacttacaacataatgttaagaatttattggtcactctccatccctttggctagctatagttcagttgtgacaatactagtcggagtattaggcaccaaaactaaccaggcacttgacgccactgattaattaattactcctaactgactgataaatcaatctctttattgacgactgctcctgcagaacagcactccagctctactaactagctagctagatccgcgtcacctggtgctaatgataataggagtactagtaatcagtaatcacgagcagtgtgtagcactgttctgcattattgtccgtattctattcagccatttgtgcgtgttacacgatgacgagctactagcgccatagcttaattagcctttcagcgccggtcatgggagagccaaatactcgttgctttctcggcacaaatggacaaatcacaaatggacaaatagtgtgatgcattgcctgcttgattaattggaaggcctgtatcgcttaattctctttgcccatgttaattcgagttatcaattttttttaaaaaaactgtttagatggttttttaaagaaacaaggggacttcctctggaatgaccaaaacagcttcccagccaccatttgtgcatgaacactccccttgatttgtccatccaccctcaacattcaacaaccacgatcacacgacatgtgtgaccgtacctcctcgcagagaagatcatcaaagagagatgaattgtacagccaaaatggctaaatgggcccttgatgagttcatgaacatgttgagaagttcatggtccaatttaacaggtaataatacggcagtttgtctgccccgttcctgactgttggatcatgcatatttccggtttcataattcagactggccgggccagggctttcatgcaccttgtgtacgtattttggactactgaacagcacaaattcgcacctacctcttcaaaaaaatcaactttagacgaatctagacaagtattttatactcagaatttttttagtggagagagtatacatttcatctcatcttatcacatcattagaatcgattacataagatttcagtttgctgaaaaccaagcgaaaatccataaaaatagataactttcgatcaactccataagaaaaccaactccgctcatttttcataaaaatgatccccggttttcgctgtgtttcgatcggtattggaaacccttcgctaggaccatgacaaaaccaaaattacattaggttattagggccattattggacattgttcgcactgttgcaaagttggcaactttccctgaagtcgcaggcatgcaccgtccatcatgtcatgctgcatgcccgggccaatgcattgcatgacgcagctgcaatccattccgattcctgtttcgtctgcaaaagtttggacttgctcgatggcgatgatgataccctactccttgctctctacgacccaaatgatgagtccatgttgcagttgcatactccctccgtcaaaaaaaaaaagaagataaacctgggtttccatgcccaatgtttgaccgtctgtcttatttgaaaaaattataaaaaaattaaaaaaacaagtcatgcataaagtattaatcatgttttatcatctaacaccaataaaaatacgaattataaaaaaatttcatataagacggacagtcaaagttggacacgcaaatccagagtttgccttttttttagacggagagagtacatgattatatatcttggtatacatttatccatccagagatcataggtgaccacactgacttgttaattactgtcagattaactcctaattagtttaccggaggcacaggtaattcaagggctcagctttaatttgcagtactccttttttttttgactaaaattttttttattacttgaacaggatctgttcaatttgcagtactcctcatctgcagttagctagttcagaccaagagttggtcccttgatacaattttacatgtgagatcacattcacatgtgaccctctcctccaccaaatgcaattcgtggctgaaaaccagaaaccttctgaattttttttaagcctgaaacctcctcaactaattttctctgaagaaaagaagaggtttctgaattctgaaacatgttccactccacacaatagtctctggtagctgtgtaggggacatgtctgatgtctcacctccatatttttcaggtagatattgtattatagtctctattatatgccaataattgttttcagatatttttaatattgaggaaaaatcaggtctgctccatatgatttctttgtggtacttgttcgatttagatcagagcattactagttaattaatgccacgtaccaagtcccatgtatgcgggctgtggaccccaagcaaatatgattgtagattcaacagagtttggtagcaattttgttttgcgtccatcaagagctgcactgaaaatagcttgggaaagcatttcagggaacacttctccctgacatggcccagcttggcaggccacatttgaccttaaggcaatggctgatatggaacttgaacaagaggatagaacaagatggcaccgacagatcctttacccactgtcaaaagtgaaaaggttagctatggcctcttgtcatttttttaaaaggaaaaaatattttttcagtatttaattgtatatctagatgctcttgtcttgactatgcatagaagttgtgtccagctcttgttgcatgtacatacttcaccagaagtttgttctgtttggaagatgcatttgtctctcttggagaggacataacagtttcacaatttactatgcaatcgtagtatgcatcaaccctgaacagtagtgcagtactataatatgcaaaagttcatgttgtttattataatatgccatattgcattgcacaagccacaaaagaggggataataccaaggatcaagcaggttttatcaacaccattctaatcccacactcccttgtagtacttgtgatcaccacccccaattcagaaatcacaggctcgtttaatgtagattattggatatagattattgccacggatccatcagttgcattatcttcccctcaaggctcaagctgatgcatagaaaactaaacacaagcacgttgtttcatagtgtttctgaaacccaaggcgcacacacatgcatgcaccagcatcttccatgattactgacacgctaaccaagcactgttcccacatctgaagccctgcacttcttcataccacatttttacctccacaccgacgcatttggagaagggatatgagctgagtagggcaagttctcagctaaccaatgcaaatgcatttaagattcagcgtaacttcgcctgcctgaatcctggtgttcattgatgcttcattcagagagaggctgaattttatttacgatctccactgttcgcattgcacaatttgccctgtgaaactatagtgcagcgacgtatagtagtgcatgctacttgaacgcccttgtctcctgcctctgaatggaattcgatcctggtggttgtaccatgtatgactctctaataaacccctttggtacagactgggatcaatggcctggtcgccgtgaagctgttcaaccttctcgcttactcacatgggttcaggtcctggtctcctgggacaaaatctaatgaccatttctttgagatgagatcatcttcattgtgagggatgaagtcgtgtcagtatgagactattcaatatgatttagatttcgacgctaacgaatactatacgcacgtagatacacttataatagaattataataagattagttatttataatagatatccgcctctttaaacatatgtaaagtgttagggaggtattggccatggtgtgatgagtggtgtataccctttatctaaaaagaataaaatttcccccgcaaaaataaaataaaattttgactatgactctaaacaaatatttatccgaattcatggctgatttgattttttataagacggatgaagtaagagcaaatttaatagtatagcccactactagctataattcatatataaccaatctaataactaattcatataatagttgtttactatactattaatatatggtatcacctatcatacatatactgcgtcttagaatccgtgctgcaactggttacagatttgtagctcgctgctcttatctctcactttttatcttattaaaatatgtttataaatgtctaatagtctgctattgtacctgctctaacggagaaaaataaatatgcaagctatgtgacagtgacacgtgggatcctcaaggtcgtccgtgggatccacgtgtcaacctcgtgacgagcgtctctgctgcactgacctggctgcccacactccacagagaggagtgagagtgacaaatactcagtactatcttgtacaccggcgattgccgcggtggagatcacgctggcgatgaaagcaacgatttttacacaaacacatcacacactacatcagcagagccaagaacccttacacacacagccacactccatccccaagctcgcgggaaaagccaaagcagcagccaaagaaatccaccttttctagacaaaaattttagacgaaccgcgagactgatggccggctttcaaatacggcagccgggcgctttccctctcgattccccgctgcagatgagatgagatgagaggagaggaaatctccagggaaatttggcaggcataaatgggtagtaattgattgattggggtggttaatgccttccaagattgctcctctgctgctgtgctgctagggttgtgcgattcggcatggggaccaaaccagagaggggaggggggggggggggggcatgacgacgacgacgcccccgttgctataattccttgcnccgtttcgccaaatccctcgggctgttgcctcctaccccgcaatccctcctcgccggttggtgatcaatccggctcctgatttgaagtttctcttggggacccagggtgcccgttccatgcccggtttgctcgtgcattaatactagccgcttcttggataggaggacaactagtagtagttcttctctcctctcgctcgctgttccttgccccattctcttggcttcttcttcttcttcttcttcttgttgtggttgtgtgttatgataagagttcttcgccgttgagatgggttgctttgggtgcttctcgccggaggtggacgacgacctcaagccatccaagcccaattaccactcttctgacgaatcatcaggttcttgatttttttttcctctcgtgtttcagactttcagttagttccggtttttttgctgggattgtgactgtttatctttgcaggcgccgacgcgaggagaaaggtcgcgccgttggcgacggatggggggaacggctacgcgcacagcttcaccttcaaggatctgtcagtggcgaccggctacttcaacgaggcgaatttcatcggagaaggtggctttgggaaggtgtacaaaggcaagatcaatgggcaggtgagttcaacgactccttcatattctacttcttgagatctttcgtgctccaagatttggttttcactttatgtttttttttaatgttcttcgtatgtggtgtgtagatggtggcagtgaagcagctcacccgggacggcgtgcaggggaggaacgagttcttggtggaggtgctgatgctgaccgtgctcaaccatccgcatctagtcagtttggtcggcttctgcgcgcagggtgacgagaggctgctggtgtacgagtacatgccattcggcagcttggagagccatctcttcggtaagttttcctcaaactttgctgtgcatgatagccgcctagttcatgttgggatttggtgttttgaaagaggagtttgtctgctcttggcagtttacatgttactgttgaaatgactttccctatctttttggcagattacgcgccagtgttaaaatgcctcattttttgtacttattgtagttctctgcttgtgataattttttttgcctaactttatactcgactagctctccttcattccactccagtgatatgctttctcaaaattttagcctagaagcaatatcctgatatctttcctcactaattgcttgttaagtactaatgctgtgtttatatgaggaaaagataaaagaagaaatggcatggaacatttatttagctcaatatgaaattatatgaaaggagagagaaaccctgaacaagcaaatcgttgatatcttctccttttcctggttgaataattgggtgctttttccttcagttcctgaaaaactttcttgacatgtttctttagctttgctgctgtgtttgtaaatgcttttactgcagctcccatactgcactgagttttactcacttatcaatatcgtcattcttattaactaagcgaccatcataaaaatgtatgtctgttccacaatgcaaggaaacattttaggactgtacaatgaaagtaatcgatatccatggcgggatcataataaatcctcgtatggtagtactaactactaaccaataatcttgtagcattgacgttcttttttagtgttacattgtagtattagctcgttgttattatttcatttttaatataagaggttattggtgcaaacagttatgttctactattgctacaaagcctcactgaaaataaaaaaaacaaaccaatcatttatgtgctgaaaattttcactctgaaataggagtagatgacaatgatgataaagctgagattattgatgcacttataaaaacaaagagatataaacttcaactgagcaactcagctatctgtgttactagatttcaggatgatatctatctctattgactattggtgcatccaccttattagttctattataattgagattctgcatttaaagatgtaaaatattagaataaacaacaataaaggaactattcaataaatatgccgcagtcagtctacactttcttcctagtaaaatttctagccatatgtctttgcctttgccatctttcttgtcctgttcacataaagaccgaatatgtttttgaagctttcaaaaaccatgaatgaggaacttttattgctggtaagatgacagggaaactagttatcttgctgtgggttatcaacgtagggttgtaggccagtaagccagttactcccaacgactgggatgtatttattgtctattaaatgagaactaggttattgcaaagttcggaagttctattgtatttgcaatttagattgtgcaaaccatccagtttttgcaagggtgcaaaactaaagaaaataaatcagatctattattcagtcaacacaaaagttttgtgatacttgtttatttaatctccaaccagagaagccaccttgtgttgatcaaccattttcctagatgccaaattattcagcaaaataatacctaagtctagccaaactgtccccacggctaattattaaagctcgtaggccttcatggcttgtctcatgcctgagcagcacatgctctcctgaatgataccagcattagcctgctaggtaatggacatgatgtgaatcatcttaacttctttttgaagattcctcatttttgtaaatttacaatttgttgagatgaagtgttattccatatgatatcactgataattcccatcccataatgcaactgtgaaacaattgaatttgccatgcaattatgtgatagaattttggagctgtgcattatcaattgcttgtattgatatacttgatgtattttaggccactgcttaatgctacattctgaaattccttgtcagcagctagttctatattcagtaaaaatatcatcatccaccctacaatatttttttattcagtattcatcttgtacatttcattgaattgatagaaatttcacctttgaatagatgtgcctcttggcaagcagccactggactggaatacacgcatgaggatagctgttggagtggccgaagggctttcgtatttgcacaatgtggctgatccgcctataatttaccgtgacatgaaagcagctaacattctgttggatgaggactacagaccaaagctctctgatttcggactagcaaaagttggaccagtcggtgacagaactcatgtctccaccagggttatgggaacttatggctactgtgctcctgactatgtggtgagtggtaagcttaccatgaaatctgacatatacagttttggtgttctcctgttggaactgatcaccggcagaaggatctacgatgcttcaaggcctaaaccagagcagagtttactaacatgggtaagcagctttaccttctcctagtttatgcttccagtgttctatctcttgttctgctgcttctcaaaattggcctgtcatagttttattattagaaatttagaacatgaagtatcatggtgtatgctgtctatgcaagtccaattatttgacaatcctttaatttcaatgtttctggttcctgttgggttgatactgctgatataatcgcccatattgccatggcatatttttatatgaatatgagatgacacattatattcctcgtaaaaagcttaaattcttttaaggattttagctcattaatgctttcacttttttttgaaaacaatttttgcagtcaagaccatttctgcatgacaagaggaaattctacaggctcgctgacccagctctgcacgggtgctatccaacatctgcactaaatcagttggttgtgatcagcatcatgtgcctccaagatcagccccacgtccgcccaatcatctctgatgtcgtaatcggcctgaaccatgtcgcaagccagccatatgtccctgagcgctcctcagtgtcgctgagttccccagcaaggtgcgggtcaccacaatatgccggcacgccatctagaaggcgaggcggcagaagagttgctcagtatgcatagcctagactatatccttgtctcaaaagaacagcaagatctcagtctggtgagacgggtagatagttgaaactgtcaaaaatgccatatagtcaaagccttcttgattcaagaaccggtctttagcaacccgattgacacagtttgctgtgagattggtgatagtttgaagctgaccatgatgactgttgttctttcatgcctttcattgttttcagttccttaattctgttgccagtgtacatagcatcatcggttgtgctctgcttgggcagcagccatcagacatgcatcagtccggcctggaagcatggggacaatgtacttaattgggattttgatcaagttatttaatcatgtacaaagctctcatgcctttgctgcatattactgccatcttgtagctggaacaaatctgaaatgtctctgttaagagtactgccgcaaaatcgtctcctcttcctagctttgtactgagaattttgttgaatgagaaattgtgaactgtgcatgagaaggttgacgcctgtcgatctgaagaagaggtcctggatgatgatgtcaccagttaatcaacagtggactctgatgaagctgaagatttggtccacggagcagccacgtcacgtaatggaagcacacatcatgccagctatcatgttgtcttttcttccttcacctccaaggatagccacgatttcctctcaaaagagagaaaacggacagccatgatttcatcttgtaccataacccaaagtctgatccctttcttgctgaaatagctttcacatttcacagtactttgtccgattatggagtactccctccctccttaaatagacgccgttgacttttttaaacatgtgttgacggtggatatccgtaaaccggatacaaagggtattggggtacgctggtacgaggatctacgtagtacgacatcaaacaagcagaagacagattatactggttcaggccccttgataagtaataactctaatccagttggtatgggattatatgatggaaaccacagattacaaagagaataataggactcgatgataccgacgagaccgtagtcgagttggttcgactagatcacccggtgacttggctcctgcaggctccgacttcgtaggctgtggtgaatgtgtaggtggtgagatcgatgccttaggtcctcccagggggtcccttttatatcacgggtcagcggatctccaagtaggactcggagatatcggacccctcatgatacaatgacgacccagtcttgtccgagtaagacttctctcgtatgtggattctgcttctattatgtgatgaatttccttaacgtgtacaggaaacatccgtatacgcacaggtataccgtatcggtatacaacatatatccaagggtagagggtataccttatccgtaatcctgacaacatgtttgaccgttcgtcttatttaaaaacttttatgaaatatgtaaaactatttatatacataaaagtatatttaacaataaatcaaataataggaaaagaattaataattatttaaattttttaataagacgaacggtcaaacatatttaaaaaactcaacggcgtcaaatatttatggacggagtgagtattttgttctccggttacatttatgttgggacggatttttttttttttacacatggtcgtcactcatcacgaccttaaatcaggacaaatcaatggctgccctagctgagttggcccaatgcagaagcagaagcagtcgagatgccaagaaatttacacacatttataatccttttttctcgtgttaatattcggaacggtgacgtcagcgcgcctgcactgcgatgcaggtgcagcttccgggaaacggaaagcagctgccgcgatgcgcatgaacctgggctttgctttgtttaacgtaggtggctaatccaatcagattagtgaagaaaaagaactaattgccacctaatcatccactgcctggtgggcccacggcccacccgactgtggagcccacctgtcagtagcggggggtgccagttgtccagctccgcgaagtgaacagcgcaatctagcgaggagagagagagccacatgacgcacgtacgcacgcacgcacgtacgccggcacgagcacctgcgtggaccgagtccacggaccagcagaatacacctcctggagcttgtagggtgggtattcggtttcgatctcgttcttcggtttttcagttatttcggtatttcaaaagtgaagaccgaatttcaacgcaaaaatgttaggatcgataaattcggtctcggccttttccgtctcggtctcaattctgaccgaaattccgcaacattttcatatatgcaaagaaataatggattttttaacacaaaaatcacgtttgtcggtcctgacattttatttttaacacaaaataaattcgtaagcatgtttgagtaaagacttttattagattgcatgtctagaagaagtagggatgtgaaaattagagtttaatcctattgaacttagtggattgtaggttgcaattagacttttttttaaaattcggtcttttcggtatatacggttaactgaggagactaccgaattgacctaacaaaattcagtctttcactgtctaggaccgaatttctcggtctcagttttttcggtctcgatctcggtcttttcggttcggttttttttcctacccctaggagcttggccagagagcaagtggccttcgtgcaccgggtccacggagcagcgcacgcgacgaccagttcatcacttggcgccagccatctcagtgtctcgcgctgtccacgtccacatttccgtgtttggttggttgttctttctactccttgctcgccaagctcacatcgtttttacctatacaaacacgcgcacgcagtcacgcacgatcctattcaagaagaagacgacgagggaatccatccatcgatcgacatggggaatcgcttgtgctgtcatgacgccgccgacgacgagaagccggcggcagcggcggtgtcgggcggcggcggaggaggagggagggaggagtacaggcggtggccgatcgcggcggagagcggcggcggggagacggggagggtgctggacatgccgcggctgagggtgttcacgctggcggagctccgggcggtgacgcgggggttcaagccggagatggtgctcggcgagggcgggttcgggacggtgtacaaggggtgggccgacgagcgcacgctcaacccggccaagagctccgccggcgtcgtcgtcgccgtcaagaagctcaacccggagagcgtccagggcctccacgaatggcaggtacaccgcactgcaactagctagctagctcgttgctcgattgatctcgctgttcaattttcttggctaattttgcgtttcgttttggccataattagcgagatagtttcaagaatggctcctgttcttagctctgtttagattaactcaacattgttacagaccgcatatttattaaaatcttttctttcgcttaagaaaacattatctttaacaggacaaatggcttttgttttaattaacctgttgctttctccgcacaaatggacaagtcaactgatgacctggtataatgtgatgcattgcttgcttgattagaaggctgcattgcttactgttccaagctcacatgttaattcgagtctgtgttctctgattagccatgaactcatcggcgatttccaattctctctttgttttgtgcaagtacagtcagaagtcaacttcctgggtagacttgtgcatccaaatcttgtgaagttgctgggatattgcaaagaggagagggagctgctgctggtttacgagttcatgcccaaaggaagcttggaaaaccatctcttcaggagtaaggctacgaccatcaatctaactctgacattgtactactactctcatgtctgaatatcatgcttccacaaaattggttcattttcagctgttagtctcccactcctacctaacataatttgacgatttctaatacgagtaacatttagtacctgaaactatctttatgtttgtccgaatgtgaacagacaaacttgcccttcgaaattcccgcttgacttctgcaaagtcagtgccgtacttcatcgtattgatctgaactttgacaaacgcgaccatcctgcattggttgatctcaattcttaactacggactagtcatacagtgattcatcaacaaatcacataaataattttgggcaatagtatcatgcatgtctgatttgctggagtctgaccgatcttcgtgcaggaggagcatttgaccctctgtcatggagcctacggctcaagatcgcaatcggagcagctcgcggcctcgccttcctgcactcgtctgagcggcagatcatatacagggatttcaaggcatccaacatcctcctcgacgtggtaaattctcttctcaactcatctcgcgaaattcgcagatcgatcgtgatcatcttccaaactccatcatttgagacacgcatttttcatcaggattacacgccgaagctgtcggacttcgggctcgccaagaacggcccggtcgccggcagatcgcacgtcacgacgaggatcatcggcacgtacggctacgccgcgccggagtacgtcgccaccggtaagcatgcaccgcaccaaactctctaatcctttatatgccactagaatttgaccagttcccttatatgccactagtttaagtttttttcacccttttatgccactcccaccactatagtgttagttgactgttagtcaaaggttagtttttttcgtaaatgaccaatatgtcctctcaactaaaaaatgtgtaaacttcaaaaaatcataactaatttattttaaatcttttttgattgaacaaaattttgtcagaaccagtgaaaaatgctctttatattaaaaatattgttggaaaaatgcatgtttcatgcttacattgaaaatttatttgtgatggtaatggctaaaattgcaagtgatgcagaaaaaaaatcatttttcatatgttgtatccagtagctatattagtactaaaatacctattgttggttgtatactaattcttaagggcaaatgcgtcttttttacaaaaaaaattaacggccaactgacggtggaccgacggcaatggcataaaaaggaggagaaatttgaactggtagcataaaagagagaagccaattttaagtggtatataagagagccggttaatttagagtggcatataagggattctctcttctcttaactatgcaaattccattcaaatttagccaaaatccccgaaatttcggttgtatatatcgcaaaggactaactgcaggctgcgtcgtcgtcttcctcgcgatcgttttcacttttttttcaggccatctgtacgtgaagagtgacgtgtactgcttcggcgtggtgctgcttgagctgctcacggggctgagggctcacgacctgaaccggccgagccaccagcagaatctggtggagtgggcgcggccgtacatcgccggcggcaagaagctggcggggctgatggacccgcggctcgccggggactacccggccaaggcggcggcgcgggccgccaagctcgccgacaagtgcctctgcggcgaccccaagagccggccgtccatggacgacgtcgtcgtcgcgctccaggagatcgagtccgtcggcaccgcgcggccggcggcggcgaagctgccgccgcgggcgccgccgcccgctgcgcaccggtcgccgcaccgtaatccttattccaagccgcgatgagctttgggattatctgcatactaacatagatttgaaattgaattgaattgaattgtattgattcttttttctttctacggcgcgtgtcatctttaaacaatctcactttgcaaatgattatactcctctgatccatgagattagccgtagtgatgaaccgaatcgagtcactgtccaggagagcgacaagatgacccagacctgtgctttcaggagaagcacatatacaggatgtgatttctgagataaatgtgtagacttgaggataaacatacgacgggtttagctctgaaaccataacatgccagaatttgtgtttagaggatagatgaaaaaaccaaaaaaaccacggacgccaaccgacaagatcacttttaagagttgattacaaaagcataacaattagacgttactcctgtgcgactaggagattaattcaaatatattttcatactgaaatttgagacacatatttaacaactataaaagggagaaaaagagagcttccgatctgttccaatgtcacaaaggaaagggtgtgtttagttcacgtcaaaattggaagtttaattggaattgaaacgatgtgacgaaaaagttgaaagtttatgtgtgtaggaaagttttgatgtgatagaaaagttggaagtttgaagaaaaaccaggccaaagtagcacaattcttacatttctaccgtactgtacatgatatacaaaaaaaaaaatcttcacccgtaaaagagcaggtttacacgagcaacatcgaaactactccaacatataaataacattgtattaacaataatgctaacactgatctaaaaacaacagaattcatctcgactttgatgatgatcttgtttcattgccagcactgcaactgctttcttgtgaaccctttcgcttctgcaatatgtgggtgcaagataagcttaccatgcaactaatgagatgaacaaagaaaggaaaaatatacactaatattttcatcaatacttacactggtgggaagacatttcagaattgcaaaaatgctcccatgaaggctgaacagacacgctgtaacgggtaacctgaggcaggctttcaaatgctgaaaccttgaagtgaacacttgagaactattgagtcagatgaaaccccaaaagagctacaaacttttgaactgtaactgactgctaaatctatcccaaagcttcatttcgacaaatgccaattattttcatcctctgacctactcacctacaattatgtacactagtttagtctgcctacacaaagttcctatggttatgaaactgaacaaaaggcatacagctccatcttctattcccgtggactccactgcatgaacttcagcatgcaaatcaataccaagcaccgacagggaacatcaacaattacttcatttccaattcaagaacacagcacggttcaactgcaacatcaacaggcagctgtccattaatttgcacctcagcccaagtatccaaatctgaagcctgcatacgccatcttgacttacaaccaaaggcagcgtcaggcattctttacctgaaggagcaatgagatgattgttttcagtgctgcaacaccactgtcaagacagaccagtttgaccgaaggaagcattgagcaacggttgaatgctaggattaaccaatattctaactgtttgattacttgatgacttgtatacatcaatacactccagcaggtctgcatcacaggttaaaagaacccactcagattcatcgtccaaatacttgaggtccacgtgagtatcctgagaaatgccgaaccgctttacgatctcttcttttagcctttgaaagccccaactaggctgaagacggaatatacatctttcctcgccatagatggcttttattttgagagaatcagacctagccttttgcacgtttgacatgttttctatcggtttgtgttcacttaaaagtacttgactctgagacctaaatagcatggtaggtctttcttcaacaaacatttgcagctctgcctctgcatggctagcagatttgattagtgtggagcactgattctcatccatagatatttcctctttgactgcaagctgaggagcactaccatgctgttgctgagtctttggaacactggaacaaccaaggctagaatttgagctctggctgcaggatggggagatggaattagagccagaagtatgtgaagtgaatctgccctcacatggacgatcaggaactgaaggttccagctgaaagttttgctcagatgctggaaaatggacatctccttgtaactctctttctgaccatgtggtcttggtaaaattttcatagagtgaactgagctgaactgttccttcaggaccatgtactgaatcaatgaccatttgcaatttcttcagggagtgcccaactttcttgatctttcgtgatggccaacgattaattccatgctgcctgcatattctcttcagtgtagtcgggcacactggaacaaacggtagaaacataagatcaatagtcagccacagatattgcagtttatatctatgcaaatagtgaatgaagcattagtcctatatactttcagttggatctattgcaaaaaccaagacatttgaattatcaattttatctcaattaattacattgtaagttccccgcctgattgtacacctgtcatttttttttatcctggaacttatctgaaagggttacatgcactgtaagcagattattactatgagcaaacttatcccacttcttttgagccatgcttcaaggagataaatgtacaggaaaagctgcaaaaaataattttaaaaaaggtaaggaagccagccatttcagagatcatttgtcattaaaatacctcctaaattctttgcagcttctttcaggctaccagcaaaatgcttccgaagatcttgcaggctaactgttttctccgtcttagtgcgccgtttttctactgctttgtccgagtttgaattgcttggatcactggaacaagtattttctttgacatcataatcttcatgccgcttaaaccctgaaaacatgctaccgtcaggtgccataactggagaagtatgccagccagctgtaacactaaatccttcatcatcttgtttgctgaatccgaatggcaagtcaacatctatttctccctttcctcccttattctgagcatccactaagctcgctatccatgatgatacctcctcagatgcttccaatgatgttgtccttccaggaacattaataccactacagagctcatccaagtcttcatgcacagacttggcataaaattctggcctggttggttgactaatttcaaatggtccatcatttaccagctcttttggcttcacaactcttaatgtatagcatacttgttgtatggtattagataaagaattgagcatggccctttgctcttcagtatttatgcacttcattggcaagaaaaactccaagacaaagtccaggcttccagtcttgacacttcgcagctggatggcaactgctgccctcaagccaaaaagtttggcatgatgcgagagagggtactgggtcttgctgtaggtggtaatgtctggggagaaacatggctcattcgtcccaaatgccctgccgacaacaccctcacctctgaacagatgatgctcggagcaagcctggtgaaagcctaatacggaacaatcacggacataacatgcctcatcaacagtggacacacaatgtttgtagctttcatcagagtggcggcttcccctcttggcctggcagatgcacggtatccatgtctgggctagtggcagattgtgggtatcacaaacagctctgagaacatccatgatctcaggtataattgctcggtaagaagcatcaacaacctggcatcaagcgggcagcatctgttactgagaacaacatttcagcaaagcactctgatctttaatatctttcatctcaccttggaacgaggatcacttgaaacatcagagctcctgagatcaacttcctgcaattttccacgaaatgtagttttattaagacaaggatgacaccaaggtaggagaagtgaaaagatttattactttggggattggtgtgcccagcagttatcacatcttttcctaatgacatttcatcgaatacgttaagagcataacatggtggcctgcaaagcatgggcatttttttcggctttggagaatcaaatggagcagtgttgcgcaaatctaccttgagagcattgcagatgttctcgatctccgcactgtagttgaccttctgcgtggtcatgacgagctcgacgacgccgaggcaggctcggctccgcggctcgaagaccggcagcgcgacgctgccgcggatgtcgaagtattgcgcgtgctggacgcgcgggtactcctcggtggagaagtagcggacgtccggcgtccactcggggacgcggccgacgaagacccggccggggagccccaggtcggcgcgcgcgctctcgtcggcggagaactggtacttcatcgacaccgtccggtagttggcgaggcgctggttccggcggtc

SEQ ID NO: 10661 - DNA, 6192 bp, Oryza sativa
cctcgcatacccccaatccgccgaaacgcagccgcgcggaggcgaacaaacacgagccacgaacctgggattaattgaaaaaccagagaggaaaccttttttatgccaaatcctctacgaatccaaggaatcgagcatggctgccacagcggaatccactaccacacacgcacacaaacgccgcaagacgcgagccttgaggaacccgacgagacatccccatcatggaaaggaaaggcacatcgccatcacgccacaatgacacaaacccaaacccaaaccccccgcgatttactagctatagctaagctagcccaacacgcgaaaaaccacccggtttactgcaaatcgaatcgcggttgagtagttgacccacctgctatctcagaagcagaagcagagcatgtcgatcgaacacagcaacagtggggaagagggggcctccaatggaacagtcaatttggccactcggattagcgagaatcgtaagggattcttctcgcagcgagaaaggaggagatgagaggcggtggtggaatcgtatttgagtaggcctcgcgctcctcctcgcagtgcgctctctttgattctatctcctgtatttttgtttgtgcagagacggaatctgctgcagcctctcggcgcggggtggggcccacgagaacacgttgtttatttggcgggagggagggggaaatggcgggaatgggcttggtgggggcctgaggtcaaccggatttgggtggggccgggaggggcaggacgggtaattttgggtgggggagaggatatgcatggggacatggcatgtcgtgctcacggggaaagacgacgacggcgacgttccgtgcgctgtgcggctgtgactttcgcctcacgccctcacctgatcacctattcacctgtaccctctctctctctctgtgatcaaaataaatcaattttcatatataaataaatctcaaaatgagcactctctccgttttataatatagaaacctaggaccaaatatagtattttataatataacgaatctgaatagaagagtgtccaaatttattatactatcgaacgtctcatctagagctagattgctatattatgggactgatggagtatttcttatgtgcgtaagattgtaatagtcttttagcaattcattcttggccagatggtacaatgttttttggaaattggttttcaatgtttcgagattgaaatttgtagaaaagtttagtaacaatcttgaagtggagaaattggtttcaatcaacaagatataatacttcaagattactggttaatgtttcaatcagcaatatatattatacttctattatttttcagaaatttgatgcctgggacgaatactatgggatttaggtttgaaaccggtaatcttggaagtggacaaattgcatttggtttagtacaatcttgaaactattctgtcgatcgtatagcacaatgtttcacaggaaagttttgttattccctgatattttgatctgactatttgcaattgcagtggacttcagtgattgcccacggatccagcgtataaattagtaccaactgcatgacatcaaccggccaattttgtttaaaaaaaaagtctgtataaattacacgtacgcacatccctgttcgtacatgtgtagtacactgattgttacgcgagctattttcccttcgttagctgtcctgaatctcgagacatgttggcgtttcaactctcacttgctatctacttccaactattattaaaggaggaatcaaaagtttaatccaagcaagcaagagagctggtgttgctgacagacttaagatcgatgtatgtggcgttgattaaaatctccaatcaaagatcctcccatgctttgatattgacaccccaaagttcagctccatagggagaaaagattccgaatcaaccagcttgctggccatgcttaattaatttgattagtctagtagtagactagtggtaccacataaaatttcactgccgaatttagccctgctacaggcatgaacttggcggtaggtgaagcgacttccaaaacatgagggggttggtgagccgaattggccagtaagtcccatctcatgtgaagaagaaaaaaaaaaggagggccatgcaggctgcatctgatgctaatcactgtttgaaatgaacacatcataattaagcaaagtgactttgggtaggtaaagtgtcatccactaatagcaatggtaagctgtaaaaaattccctgattgcagcagatccaccttgaaaattaatgggagcagattaattaagcaccagttttaacttttatatgcaaacttgtgcagaccacaaggtcattagggttttcacatggtggtccatgatccaaagggaacttgttaatgggaacttggaatccattatttgtggtgtgtgggggtcttcatgtgggggcaagactttttccaaacaaagattaggttaaattaaaggagctgatgatgcaagcaactgagaagttgattaattagtgtctgattgagcttaacagtactggtcaggaatgcgataggcatgcgttcttgttaatcctttgacggtaagctattggttcctatttgttgtgagcccgcggaacatgtggatcggcctactggtatctatcttaagctaggtttgattgattaatacttaatggagaaagaactgaagatacttgccctagtggtattggactgtcttgtcagtttattgctggatccgccctgcatgtgtggatatgattatacttgctgccaacgaatctcttgcaaaattaactgatgaatcatgcatatctatatctaatactcgttgctaagcataatcgttgctaagcagtagctcgcgatagtgacattagtggttttcaagtcttggagagttggagtactcttggtgcatatagctcttgtacgtattctcaggagtaaaaaagaggaagaaaggttaacactaactacgtttggttgatgtgtgaacatattcttaattttcttgtcttacgatagtactagtacaattaatttctaggattccagtagcagaattagttgtgataattaacacaaccgtgggcggcacgcaggttgcaaaaagcgaaggaatattaaaatcacacttgcgtccctacatcgctaactgacaacttgctacactgcttaaataattctggcttgaacaaattaagctgtagcacgtagccagtttcttgctagcaagcacatagatggatcatatctctccaactcgatttttctgaacttctctagacacagagaccgtgacatgtccagacataacaaaagtccaatggatcatattcatatgagaattcagaacaaagattcaataaagctaaagctagctgtttgtgcaagaaatttctcgtcgccttgcatgattaaagtgacacatttgcgcgttgaaattaataccgattaactaactaacgtcgtatcaaatatagttccctgcagccagtagccaatggtattaggttctcccctttctttctttcttttttttttaaaaaaaaatattccagttccacaactggtggatcatgcatggatcgtatatattcttagtctgaacaatcaatccgtttggtacacttgaagctaagaccgtctcatccacagcttcgtgagcactaagaagtaattgcatctaaacaaatctctgcattaatcggatcactaaattcagacatcatacagatcgcagattctgaattttaattatatcatcaatggacctgatgatcgggttgcatgcagtagcagaaattaaccaagattcgactcccggcaccaaaggaacgaggcgatcgattgataagttatcccaacttggcgctaatgcgtggcgcacttaatttgtcctgcaaactcgcagatcatacgatcctgccattaattctccgctaaacctaacactcttcgagtttgtttagcgtctacttgtagattctctctgcatgcagcacgcgtggaatcccgaatccacattccacagccaaatcatgtacggccggtcgtgtagaggtaagttcttgtgttctttccaagtagcttaatactccccccattccaaattgatctacatattttataggtacaccaagaccaaaaaaaaactaatatctctctcatactatatttactctaacaacaaactagatgcatacaccatccccactatttcctagccaatagcaaatcaagatattacatgtgggttataaatatttgtgtgcatgaatgcatgcatcaatatccatttactctaatgcataaataacgaatagacttaataaatgtacacaaatatgtagatcatttaggaataacctcaaaaaactatatgtagatcaatttggaatggagggagtaatctacagtgacctgagtagcactctaaaatcctgagttcaaatctctataagagcgaatttcagattgggttatttgaagagctaagttccctatttgatagactaagttcctaaattaaaatggttgcatatatctggttggtatagaggcgggataaaaatacccttctctaaaaaaaacttaataatcggaaatatctgaaaaactcagttggattaaagcagaacaatatggttaattggatgattgatttattgatgcatgtatgtacttggcatgtgtttggtttgggaatgaaatatgataggttagactcatccttgtttttaggatgggatcgtccccactatccgtttagcatgaggtaggagatagtcctagtttttaggggatggcctatatgtcagtgggaaaaaaaaagtgggatgaattggtccaccagtttttgagtgaccaattttattcggatcttaaaagaatattctttttagagattattttatcccacctattttcaaaccagatgacttaaaaaatagcttcgacctaacccaacccacttcatcccttgaaccaaacacacagttatgtggacggctggacgtgagtgtcgatagagtaggcttcctcttagctcgacacttcgacatgcagacgcagataaggatcgtgcttggttgacggcttcgttggcgtcatggccataactaaaagcagaagagtgatgaagaaatcgaaacagctctacgaagtacgaatgggcggtcggtaatgcactgttagtgctacgtacacgtacggcttttaaaaggaagctaatgctttctagtggagtgcaagagaagcgtacgtcgtagaaatgcaacgttgcacttgtaaaagtcactgtgtcggcacattgctattcctttttgaaactcgtagtaacccaggccccagggtcaatttcaaatagagctagcctattgacctttttttgttgttgttttttttaacaaatcttttgttgttgttgttgttgtttctgtaagaacggaaaaaagctgtgcacagcacttgtggtagtgccaaactatcgtgtcccaactagaacaaaaaaatatattattgggctgttgttgcgttgctgcaaaggcctgaaatttcagtagcccaactgatggcccacaaagtaggttcatgcccatcccggccgctgcttaatccactagaataggttcgttgttagtccctcttattgagatcgagtttgatttgcatccttaaccgaaataccagatacaactcatcactaaacttctgctaccggagtatctgaagtcccatgccaggattgtgagctgttactttatctccttcctccccaccgcgatgccgtttcttccaagcctacttcgtcgccacagcatccaccaccggaccccgcgtcggcttcgcacgacttcatcgtcgccttcggtgagcccgtctgtgatgtcctcatgcacttgcgccctatgagaagcggaagcagcccgggggcgcgcaacatggtgtttcttcctcctcccctctctcctcttttccccttttctctgacgaggaaattgtggacgcccacaccgccgcctctgacttgctagaggccccgccagcgacaacgatccagtccagttgctccttgggcgccgtcgtcaccagtaacaacatgatcggcgacagcgcaatggctagccgtgccaccaccccacaccagtgatttcaatttcggaattt

SEQ ID NO: 10662 - DNA, 6165 bp, Oryza sativa
acccccccccccccccctcctctcggcaagtgatcatctcgggcaaatttttctgtttttctcattctaattcagttaaattatgttaaaatttcaaaaaaaaaattgctccaaaagtgcccaaaagtaccaaaatttcgagaattttagtagaactgaaatggccgaaatttcagctgaaatagaaattggaaaccctgccccacacaagcttcccaaggccggtgacgcccatggcggggccagcgccggcacagccgcatgccgtctcttcatcgctactctgtgctccattgtttttcttggtggggctctaacgaggatggtagcaacggcgacgaggatgcgaaattggggagagagatgagtaaaaagaaggggtgagggaaaaaaataaagtgatgcttgtatgtgggatctatgtgggtcctacgttaactcgtcgccatctcagccgctcacaatactgccatgggactttagatactccggtattataagttaaggagcacgttatatgtgatattttcggttaaggatgcaaatcaaactctatcgcaacaggagggatctaaagtgaacttattcccttatgccaataaagtggccatatgcaagaattccaaaaaaagggattataattaaataattaatttactgtatataaattattgataaaaggtgtgcttacaataatgatgaagtatcaggagaaacgtgtcttcaggttacagattattacatgatggtggtacacgaattgtgcggtgatagaaatcatatatgtcctctttccaaaatagactcgatcgatcggtattgctagagtatgagtagcaattattatccgatagagtgaggctgaggccttccgtgactgaagcagattgcaacgctgatcgatctccttacatgctcggcttcgcgctgagacggctcgccagtttctgacccagagacctgtcagcctgcatcgaaagacatagtagattgttcaagttgcagttcagaaccaagaacagattatacagatcatgttgtacgtttttttttcaatttatggaacaaactgtaatgtgatgtatttacctgagaccagtaggagagccagatgctcctgatctcgtgggtgaggcgagggtcagagagtgcgtcgatccatctcttgatgaaccggtcttgcctgcagtgcatttagcatttgttcatcagtcaatcagtctagttgactaattcagtttagttcagtctctcgacagttaattcggttgctgcatctgcatgtgtgtacataccttgccggatcccatgaacggtacctctcccctggctgcttgaagttgttctccttggcaatcaccacctgcactcgcaacccgatcgatcaaaaccagttaataaattgactagctattactacttctcctgttttagattataaatcgttttaactttggtcaaaattaaactgttttaaatttgactaagtttatataaaaaatagtaacatttttaactcataataaatatattgaactatagatttaatgatttaatgaaactaatttggtgttgtaattattactatatttatctataaacttagttaaacttatagtttgagattgactaaaattaaaacatcttataatctgaaacgggggaagtagtaattaagaaagaaaatatagtgaaatgtaaaacccaaacgcaaatcaatcaacagaattaccttctcgcggcggccggtgagggtggcggaggggatggggtagcggggggcgtgcttggcaggatcgtagcgggatgggaagtagtcgacctcctcgtcgcggtgcatgaagttcatgaagccgtcgtagtggttgttgtggtgggcgcacttgggcgcgttgggcgggagcagcaggtagtttggtccgaggcggtggcgctgcgtgtcggagtaggagaagatcctcgtctgcagcagcttgtcgtcggagtagtagatccccggcacgatgatcccggggcagaacgccagctgctcgttctccgagaagaagttgtcgatgttgcggttgagcaccatcctccccacgggctgcagcgggacgatgtcctcgggccacgtcttggtgacgtcgagcgggtcgaagtcgaagcggtcctcgtggtcggggtcgatggtctggatgaacagcttccactccgggaagttgccggcggcgatggagtcgtagaggtcctgcgtggcgtggctgtggttggtcccgccgacggtgacggcctcgtcgtcgagcagcgacttgacgccgcaggtgggcttccagtggaacttgacgtagtgcgacttgccggcgcggttgacgagcgtgtaggtgttgacgccggagccgtccatgtggcggtagtcggcggggatgccgatgtcatcgaagaggaaggtgaacatgtggaggctctccgggtggtgggagaagaagtcgaggatgcgccagttctcctggacgtgcgacttggggttgggcttgagcgagtgcaccatgtccgggaacttcatgccgtcgcggatgaagaagacggggaagttgttgccgacgaggtcccagttgccctcccgggtgtagaacttgatggcgaagccacgcgggtcgcggagggtctccgggctgccgcgctcgtggatgacggtggagaagcggacgatgaccggggtctggacgcccggggcgcggaggaagtcggcgcaggtgaggtgggtgatgtcgtgggtgacctcgaagaagcccttggcgctggcgccgcgggcgtgcaccacgcgctccgggatacgctccctgtcgaagttggccagcttctcaaccaggtggtagtcctccagaaggatcgggcctgaattttcagtgttcccagttcagttcagttcatcgatcaccactcgacttgaattaaactgacaaacatgctacggaacactatcgtaaaatcgtaattagtactaatttactgtagtgaattgctccccacggagtctggacctagctgagatgtacagaatcgtatgaaattcatgtgctctaacaaacgcaacagtttcaatttgtaggaggaactaggaaacaattcaattttcaaatgattccgcctgtagcttgaaaacacaacaggttctaatcttctggacatggtgttataagttgtaaccaaatactatcaaagtattttttaggaaaaaaaacaaatgaatccagactagcacagatttactgggatgacgttcttgaatttaaactggtagcagcaaaggctacaccacagaagacacaaaaagtaatctcaaaccacaggaggaagggggattggcgtggtcatacgtacctcgggagccgacggtgagcgagttgttgttgttccatacgggggcgccggagttggtgctccacagcgggccgttgaacgagctcgacgggcggtgctgcgcgcatcacaccaaattccgcatcaaaaccacaaaaaaccaacgcactctcaaacccctcgccccagaagcagagcagagcacgttcgttaccttgtagggatccatggctgattaattaacgacgacggcgtccggcgcgctcggtcacgttacgtacgaacgtctcgcgaatgtcgccacacaccgccctacttatagcgggccacaagagaaagaagagccctctgggtcgtgagtttttttgtcgcgtcccggatctttccgggctcaaatgatgtggagtacgtggggctacggcgcacgcaggcctagtagtacgcgagacggcgagagacgtgtgcttttgcaaagcgagcggtggtggatgggagacatggggggagcttgggatgagtggacatgggccgcacctcatccacacgctccaccgccggcgctcgccgtccagaaaaataacgggatttgtttctgctgcggcctctctgctcgtcagataaacgtagcgatttttttttttggaactgcactagcctctggaatgtgaacgcgacggccaatgggaatttttgatcgggctgcagatgctgttcacattgacccgatacgtatagtatatccatgtgtgtgtgactattccatttcccaaaaggcaggaaaaacatacgacaaaagccagttgagacagtattggttgttttttcgggtaccatatgtgcagagatttttcacctgatcccggcaaggattttttacactcactgatgtaaagtatcttgcatgcagatggaggcatcttgcgccgcgcggccactggcacgccagacgcgagagaggaggataacattccacaacaacaataacagattgagaaccgaaaggcgccctcaaacgcaaaggggtcaccagttcgtcacccggttgagctgcttaacaatagattcatacatccggcagaagaggttagagcctgatatgacaaaggtagccaaccaccttccatctttcactattgtagagttttagcttcacaagagccccttttcaatccaataatgccatcaacacatgagaaagcaaatttctagcacatcttcagtgaagagttagggtatctataggttgtaagagcaggcaagtaaacataaacaacggtcatgtacactgcagtaaccaccaatagctcaatatgtatatacaccaacccaaagtaccatcaatacaccaatatctcgatcacgacatgacaaccatgtatggaaaggttaacccacttgactcatttattcatctaaaccatgtacctagatgatgcctttgaatctgacggtataaaaccaatgaaccagacaatcttacaatctgagctacaggtaacaagtcgaggacatcttcgatcacaacagtctatcagccaatattcccaagaagtcgctccaccgcagcatgaacatttcccgctgtagcaatcaaagctcgaatgttctcctgtgtgtcaaagaaacccatttcttggagctgagctagttgtgttgcatatagctcttctggtggaactgcaaatattggcattgcttaatgagggcaaaccaaccgactccaactcgaaaagaatttcaaaaaaatattaatgtgactatttcttgcagtattgcactccaaaatttagagaaaatcacttaccattgggtgcactaggaacacctaggccaccaccagcaccgagcccactgaacatgctcatcagattgttgaggttagtattgcctggcattaaagtactctcataagtcgtgccattaaagtattctaaattaatttcaatgaagcaccaaaatatatactatcaataattcaacaatctaaataagacatctgaccatgtttaatatactaccagttgacaagatatggtaacatcttacatttcacattgatttctaatgatgaactcagaatcccatttgagttggatgcctgattcaactaccactaacaaagtaaaccagggtacaaaatatcaacaaattaaatcactaaaattgtttcctagaaaactatatttggtctggagggcattcatttgtttcatctaggtacatgatcgatataaatatctaaaaaggcaaaatttgagcatcctattgctctcttagtaaataaaaacttattgcaagaaatgatataatatgattctgcaatttatcaacaaatataaaaaaaatcttagcctatatgactctctagaagttgacatatgtatctgatagttctgtgaaagacagttctgatagtgaacatcagtagaggaagttacctgcaccagcacctgattgggttcgctctctggttcaaaaaagaaagaaagaaagaaaaggattcaataagcagtagtataggcgagacttacaaataaaaatctcttgattttacactcaacaattaacttagaaaaagaaaaggtatacataaacatgatgagcttaaacaggttaagttgaactggggaatactcacgggccagcttgttgttgaccaagttgtgacatcaaggactgctggaatgagattaattgctatacacacaaaaaaatcatcataagccatctgatttccatacactacagcagtataactaatttacctgcaaagtttcaggagatgtcaactggcgaacaaattctgggttctggaacatctcc

SEQ ID NO: 10663 - DNA, 27075 bp, Oryza sativa
aggacaagaaaacatacaccaaaataaaaaacaaagtacacaaaacttaccagttgtgctccagggatttggaagtggattagtgtttggagcaggagaacctgttgtggattctgaggtggtcgttggtgaatttgcagctggatctctggcttggtttgatccatgatttcctaggagagcagaaaatgggtttgaacttctatcaccctccccagccatcgttggtgcattcagaaatggctcttgaacagtttcatacatgcggcggagcatattgaacccttctggagaagattcaatgttgctcatggctctgtctgtgttccgcatcatctctcgcataagttcaggattcctagctgcttcaacagtctggcggagaatgcttggatcattgaggacatgagcaagatctggattacgatcaacaatttcacgcatttgggggttgttcataattatattgcgaattagatcagggctattcaatatattctgcatgagtggcatattcattatttctctcatcaacgtagggttctcggatagctgttgttgcatctgggatagttctggaaggccagaaccaaatgagcccaaccctccactgttagcagaacctgaacccccaagaccatgcaacaaacctccaaaaccaactgctggtgaattggaagcagtggtagcattaatggcaggagttacattgttggctgcaggaggtgcggttgacgctggtggtggtgcagcaccacggaccatgtgaatggtgtgatccgtctcaacaccttcaagagggaaaataggcataagaataagcacatttggaaaatctttgtgactcaaggttaaacatgcactgcagcagtaaacttgctgcattcaaagagtaatgatttctaaaagcatttgtcaaaattgagtagatggacctagcatatctggtaactcataagttgatgtgcacgtgagcaaaataaaaattggtactacctccgtcccaaaatataacaacttctagccttcaaaatttgcccctaaatataacaactccacctacattctcttctcaaccaatcacaaccatccaccattcaaattacctacctacctcctcttctcaaccaatcacaatcttcctccgtttaattccatcaactttcttaatacacgtgtccaatcctaaaactccttatgggacagaggtaataacacttttaaaagcacaaaggtgggcaaagactgcataagaggataaccttctttcacgaagaccaatatccacacccaacgttgaaaagaaaaaccagaaacctcatataaatgattcggaaacacatgggtgcagatttgaataggttcaaatgcaagaggatatgatgggcatggatgcagtaggtgggatcaaaacccgatgctcagtatcaaattttactcattaattcaattccatataaagcttcatctagtggcccgaaagaatctgcaataaacagtacaaccctctgccttttacttgaaaaggaatataacatgcaccaaacagcatgcatcacagtagcagtttttgtagtacgtttggaagattgaatctctttcagttctacactgctgtggagagttgcccatgtggatagtgctgcgcatttagcttctgttgatgtcataacaagccaataattaatgctacatcataaggccatgaccagatgtacaagttatcacgttacacgtggatcattacgagtagttcataacaagcacttgcaacgaatgacgcaggacaataaaaacagcattataaagcttccatattcgctaatcactaagatgccattatgctgacaatatccagcaaggaatgttatattcctgcaaaaataccctaaccacgcattaccagatacaatttcacatcgcacgtgtgcacttaacaatgcaattggtggctccatgatgtttggaatcactttcatgtcaagaagggagggaagtgcttgttttccttctactgcatgttcgctaaactgcattataaattagagtagcaaggctccctgatactgccttccactgcatcttcactgggctgcattataaattagtgtgcaagtctccctgatgctgcttacccaataataccatcgtctaccaagtaataacatggaaaatcaaagagataattcacacacggcatgaaaggagcagctttccttcgcactcctgactcctcctacaacaacggcattggcgcattgtatcaaacatacgaactagaatgaatcggacctaaaccatcgcatctcaggcacagaccgagcaaatcgcatcaaccacacaagctagttctaaccgcacagaagagggtaggcacgtaccgtagctggctagggtttgctcgtccttcaagatccggcccttgtagatcagccgctgctgcggcgccggcacgtcgcagctctcggcgacgatcgccttgaacgccccgacgctgagccccaggtcggcccgcaccgcgagcttggagccgttggtgcaccggatgtgcagcgtcgcggccgccgccgcggcggctgcctcttccccgtccccgccgctcataaccctagctctcgatccgacgcggggctgcgccttcccgatccttcgacgcgtgcggtgcgagtgcgatgcgggcgagaggagtgtggcgtgtgttcccctcccccctcctcttcccgtgtcgcgtgtcgcgtctcgtctgcacgggcttgtgggagggaggagaacgaggagggggggaagaggaggcggcggaataactttgggcggagagattaacggcggaaataagtgcgcgacagagatggaaggctgtgattcctttgcgtcggtgggggcccacggcgagtcggcgaggcgagggaagggaggtggggtgggcccccacgtggaccggactgtaatatagtcgtgggtggatagaaggttctagcaccgtcacagtttatcttacgcgaccgccacgcgaaggcgtatttgagcataatacgtattctgctgtcgaatgtgtatagggtcctgtttgtgggagtccgaatattctgagaagcagccggtgagaagatagctggtgagaatctgaaaaagttagaaaacccagcttaatattttaagaaacaactgatgagccccacatgttagcttcctcctctctcctcctagctttcttcatcctctctccctgcgtctgtcgagcagcgggccacacatggcaaaaagcacccgatttataagttaagagacgcgttatatctgtattggtattacggtttaagaacactatgtgattccccgcgctttgctgcgataattacaaagcaattatcaatatatttttttcgacaatcaaactaggagtaaaaatgaagcatcaggttttatcaatgataatcatgaaacaaacaaatgatattgcgccttaatgtgaaacatattataagtatatattagatcttataaaaatggtagatggatttgttaaaatattgtgcaaatggtgtgagggtgatgattggaaatgcttacacattgatttgtagaaataaataaattgtagatgatgttgtatacctgtatgaggcttaatatgtaattattgctattgggtgatcatgtggtatgattgcatgttgagctttagacttagtggactataactttatagaaagtatacatactctaaagggacaattgcttatttgaccctattttaaaaccaaactaccagattgaccatactttttcatgtttgctcatttgaccccacttttcaaaatcgaagccaccgtttgaccctgttttcactagcccgttagggtttcagttaacaaaaagaaaaaataaatttactaacatgaatggaccaaaatgaccttgattacttgtcccaagttgcaaatcccttcatcccatcatcccacgtctcagtggcgtactggcgtggctggccggggcgtgattcgtgaagggaggaagaggaggagcggtgtcggcgagcaaagggagggacggcggtcggcctgggcgcgcggaggaaggggcggcatcgtggtgcgcggaggagcagcggcgctggctgtggcagcgcagagggagggccgcaccggcgcgcggtggagcagcgacgccgggtgcggccatgtggagggagggaggggcgtcggcgctagcacgcgaaggagaagcggctgccggcgccggctgctgccgcgcggagggagggagggaggggcatcgttggtgctggtgcacgtagaagcagcggtgcccgctgccgcgtggtgtgagcgaggcgccggtggcaaccgtgcggagggagggaggggcgtctgcacgggcgcgtggaggagaagcgtcggctgctgctgccgtgggagcgagggagggagggacgacgtcggcgccgactggtggaggagaggtgatggatgttgctccgcggagggaggaaggagcaacggcgccgactactgttggatatgtatttggatctgaaattttctgttcgacaatacgcttgaaatttttgtaaaaaaaatgtcaaattgaatcaaacgtttcaaattgaagacaattctgttaaacttgtttcaaatttgtcaagctatgccaaatttactacaaatatttgaaaaggtccaaatgaataaaaaaaagctttgatataatatggttaaatgagcaagggcaaaaatgacaatttgcttctgagttaacaccgttattgggccttcacggaatagggtcagctgtgatcttcggttttgaaaaacagggtcaaacgagcaaacaaaaaagtaagatcaatttagtagtgggcttcacaataggagaatcctctcacctgtccttctcacgatttgtgtccaaggccaacagggacagagtatgcatgggcttcagtaattgggctttgccccttttgccatctaatagtctcggcccatcaaaacaatatagtaccttactggtcctctaagaaggaaaaaaaaacatcataagtcagcaagaaatctttatacccaaatggctagttggatgaaagggtatatataactcattgcaaatcagaaatccagtaaatatctcatggttatcaaatcccatggcagttcgctatgttacatgtaatcaaattactgatgaagtattttcaacccaagtaaccatggcgacagtttcaaactttcagttcacctaagctcaaaagttcaaggggcagtacgactcaacattggtacagtacgcggagactaacaagccaaagtgaataatataaggttacaattatctggtagtactatctacgcactagactcagttctactacaaaaagacgtcaaggcaggcacttgggcaataacatcattctccagcatccacgtgagtttagctgcggtaaaagttcgcctgcattgtatggtggccaactgaccatcctgcacgcccaagcacttcgatgcgctgagcgcgttgattatggaatcatggaatggagagatcctggctaatttttgttgagtgactacggcttagccatcacgatttactggaaaataatgtggacagtgaaggacggcttccgtcagcaagatcatcttcactagcctccatattgagctgatcatactcagtggatacacgtggtaactcctcgctcatagtgtccatgattacttgcccaagaacaaaccggacctcaccagggtgcccatccttcagtaacttataatcaatttcctgcatccctcttgtcccttcatatgaagttaagtcagtatcaaggccctcaaatattctcaacactctctccctctctctgctagatacaagcgcctgataacaaacccagtaacaaaattttagtacgctttgtatgtataatgtaaaaattcatttaggaacaaatatggggccaattaaacaatggttcatgcatcgttagaacagttcctactacacaatattagaactccattaggtggctctgaacaatgattgatcagtcaatatttgcatgcttacttgcagaagagcccaagcaacattcaatgattcaactatggatttcataccaggaattaatatgacaattgggagttgagacgtatgctaaagaaatacttaccagtcctgaaacttgtgaagcctttgagtatttggccagtgattgttggagagcatctatagatgtcaacgtatcaactgacgacttgactagtgatgctaaatgtgatgtttgttccatgagattctccagtttgctccgagaaggccctagtgtttctggaataaacggggctggtgctccaatgtcttgattcaagaagttgactgcgccctcccatgatccaaaatacattagtgcagcaaaagccctgattacctgggcatcatgtggagaatttaccaatgcactgtgaaatgtcaacagtgctaacctgtggaataacatgaaatgccatagacgtgacttgctcaaaatatacaagaattgtattagacacaaaatgggaacattcaactgcaaattgacagtggtatataatactagtgtagaaaaaaaaggtaacactctaaaaaaaaaagcaatgtgtgtgtcagtgtgcataggtgcgtgcgcaagtgtgtgagaaattccagggtggcatacatagataataagataatccactttgtccttcgggctaggactcacacaagttatccagtatactactggacactcaaaatttcacagaaatccatgcatatcttctagtgatgaaaactggaaagtcagaaccgctagactcacagtgcacatcagtgtgtccctaagactgcaaagaaaggaatattaacttcactatacatctctatcactctggtcagtgcaatcttttaatcagctacacttctggtttgtgaattttgatgattgtagtctagtactatgcatctcctgcaaagtgtatatgtaggaccagccaatcaaaaaagaacactaaggcctcgttcgtttagaggggattgaagagtatggaggagattgagggggaataattcacaccacaataggtgtggaataaatcccctccgatccctccttcacagggattaaccgaacaaagactaaatgattttcacacccctttatataatgaaggtaaatgcgcacaggcattcatttaaagtttcttaccacaaacaggaggggcatggctgatcagcagagagtaatttatcaagattagccagtagtttctgcacatgtgaatgcacatcattatacagcatatataaacacataacgagccctagtcttaaaacttaaatattacacttctaagtcactgactaaagaaaaggaaaccaggaagacactacttacatagttacattaaggcaactaacaagaagtgactgtcaagagctgatgaacagtaacaaaactatagaactatgcagccaatacttcatgttcatggatattgatgcgtaacaacactagttagctaacactagccaacacatgtgcgtggtttaaattatttcaccttttattatgaagcaaaaaaaaatcatatagtatgacacatttccagagttactcaccatgagcattaaatctgtgtcatttgatttatccttcatctgatccgacatatatgctgcctaaaatgaaaatatcattacatatgcaagtaagataaagatggaagtggtcagtaccacaagcatgactctacttacgcaatggcatgatcgcattgctcaacctacctggaaaggcagcaaaaaatcgagaagtccatattttctaagtaacctaagagaagaagctgctgccccataagacaataaataattcaattccatcattaatcttgcctacacagtaatgaggtcaaaagcattagaaaaaaaagaaacaatggtacattttgccatcagtgcatgctctaattgtcaaaatgccacagggtttttgcccaattgctcttatctcattggattcaagtgtgacgcaaaaatgctagttagaggctaaaaattgtccaaattcccttcatctctattttctttctcctctctagctttcatttttcataggtgattgcaagtcacctatgattgtgcataaaggaagagaaataacttgtttttttaatatgctatcaagaagccatttcggtcatagagacagtcaaaaaccattgacttaacagtgtactggcattttgacaactctgaaagaaaagtagtgacatttgagcaattacagaaaaagtgatggcaggttgacagatagtgcaagccctagtggcaattatgcaataaatacatatagttccatggtgggatacaacaaaccttgtcaatatctgttatggacaaagaaagttcccgtattgcagcagaagtttcactggagaactcaaaaccaaggcgagcagcaattctcaagccacgcaaaatcctggctgaaataaaccagaatctaaattttctgtggatagattaaagaaatgaggaatattctttgaatacctaccagggtcttccttgaatgaaacacgggcaggaatcactgtagacacctgttatccactcaaggagttagccaaagggggaaaaaaacaaggatatttctggatatctgcatggattgagatgaaccaagctaattgttaccttgtttttgctaatatcccttactccattcacataatcataaatcttaaagttaaatggattaaagaataagctgccatgaaaggattacaacaatgttagtaattacctccagcaatgtttcaaaaagaagtcaacaacatctgttaaacatttcaggcacaagattttattcagaagattacctgtttattgtaaagtctcttttcatagaattctgccagagaagaatatccccctcatcataacgtttaaactcctctgaacatcctatatttttacttcctttcacatgatttgcattcgtgctaaagctagaaacctgttagaacaaaagaaatccaaagaaataagcatttggcaaagttgctgcaaagacaattgttcataatgtggattttcctatgaataacacacctcaatttttgtgccatacatattaccctggcatattggaaagcgtttgccaataattatacatcgttggaaaaccattttcttaatctgaaaaaaaaaagcaacgtctgtcaacttagcttttttttttcttttgcttttatccagaaaatgaacacttatgacaaattaatgcaccaaaacctgctggaggcttgcggtagtaatcacatcaaaatctttaggtgcccttttcagtagcaaatctctcacgcatcccccaacaagataagctgcaaaccctgcagtacaactttaatagagtaagcatacataaacacatccctatacatatttaaaagtgagaacaccacaaaatgttccatatgtgtactcttccgacaagttcaagcagcatattcatgcttcccaaaggatctatagttaacatgaaggaagctgagaaattgagttccaaaaccatctcacgttacaattttgaactattgcttgccttcacctcaaacatgtttccgattagtggggatgctttaatggatgggcatggcatctgcactatggcacattaagatagaagttcatgcattgccgggacaagtgtaataagattaccttcttttttttttgcctttggataatattacaatagctcacttggtgtaatgcaacaaaaaggaaacaaccactaatatattgcataatttcattcgtagtaatacatgttttaccgtacaggagcaaacggtggcatgagtatggaatatcaatgcacaaaaaactcagaaatataaataagtgttcaagagatttattacccaccttttcgttttagcatgtgtaggacagtccaggcatggcgaggtatatcccctctagtaataccaacaaccctcgagtcaaaatatctccatgaagaagaatcaacaaatcctgcacaaacacaaatcctatttttaggtttcccgctgtgtaaccagtagttagctaaggtctgcctgcattattccactaaaagcagagatttgatcaaaatactaaacaagtaaacaactatgcagttcccgtgtaccaacaaagaaagtacgccatttccagctaaacgtaaacaagctaccgtgcagcacaatcaatagcatttgctcatttgctgaaagggcgaattgcacagatgtgatttactgatctacacgtgtgagcatcaaccatctgctctccgggggccatcacgagtgatcaaaacatcacctggtcttctattagaagaggaaccgccgttgcgtgggcccatgtcgccgccgccgccttccttcttcgagctgtacgccagcgtctggaagcaacagaacgaagcacagtaagacgagagggattccagcccaagcgcgtcgcccgcaaggcgctcgacgaaatgccccggtagcaggaccgcgagagactaacctgcagaccggaggccgcggagccgaggcggtggaggaggcggcgagcaggcgggggcgatgggtcagcgcgccgtcgtggcgtcgtcatcactcgcccgcggccgccggctaggtgagtgcgagcaggttgcgcctccgggccggtaggttagacgtgtgctactgggctggacgcagagccgcatctgggacgtcggctcatgggcccagagagtcaaggctgcgcgcatatcttatgcacatggaataagttcattttatatccttcaccttgacgcgaggaaagcctccgagctcgaggcgacatctcacctcctcggccgccggccatggcgacaatctccgcgactctctccatctccttcctcccttcatcaattcgcttcgccgtcgccaccacctccacctccactacctcctcctcctcctcctggcgtatcaaggtaaactccccccaacccaaccgctgcttgcaagagcctcctcggcggctctgactctccgtggtttgtgtagcgacccgcgcggttcagatgctgcgcggagccctcttcaccggagcaggagaacccctcgactccggccccgccaccagtgaagcctcctgcgtcgccgtcgtccctgtggggcatttccacgagcacctggtctgcgggtgtcgccgggctggggtttctggagaccgcctacctcagttatatcaagctcacgggctccgaggcgttctgcccggttagcggcgggggctgcggcgacgtgctccaaagcgactactctgtcgtcttcggtaatctcttagcgcttttgccgattacttcctgctaaatgtccgttgaaactgtggaaattctgaataactatactttctccaatgtaaggatcgaagtgtgtactgaaagccaagtataagtaccaatttcatctgaaatagtggctgatgatagtgtttctcagatattcattattatatggctaattatctatccttctattgatatatctatgatggtgttttgactaaacttgatgtttcccgtttgttaccttgatgaaagcaaactggtgatgtgctctgtagttttaacagttggtctctctctaatttgacagggattcctcttccactacttggtctggtggcatatggtttggttttaacgctctctcttcaagaaaatgggaagaagttcctccctggaattgatgatctggatattcgtttaacattacttctgatctctacttcaatggccactgcaagttcttatttcctatatattctaaacactagatttattgggacgtcttgttcatactgcttgttgtctgcatttctctccttcactttattttccatcagagttaaggtgagcgcttagtttccctttatttttcattgagacatttagtaattaagtaacctactcaactactaatgtttattgtattaatgcaggacctcggtttggaacgtgtccagaagtttgttggtcttcaattatcagtagcaattattgttgctcttgctctgacaaattcctacagttcagctacaacacagttaaacgggtgaggctcttgaaaatttgtggtgccaaatgtatttgtttctctgaaattggttaggtcttaagcgtcaaataatgaaatgcctgactaagtatatggcatcctcatttattacatttcgactatgtgttttctgttaaacctttttattttttttcttttattatggcattttgtttcatatgttggataagtctttgtggtccttggtcgtgattcttctttttgcttttgggtagtttcacctttttcaggacagcatctaccctttagcatatttttcagttgctaggacagctgcggttagtaggacagcagcagttagcatttcctttatgcctcctttatgctttattcagtttggatgccctctaggacagcatcccattcaaatttcgaattttagactaggagggtgcagcaataggctagcagccagctatggctatatatatgtatccaacttccctcgggtaggcatggcttttgtgtttagtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcagcgtcagcaggacgccgagctcgccgcagcagaagagcgcaggcgagcaacggctcagaccgctgcagcagcagcagcgagggcggccagactggcggcagcggagttggcagcagccagggcggaggcggaggcggaggcggcggaagatgcggcacgtgcggcggaggtagaggttgagaccttgcgcaacagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccaacgggaacccagacgggcgcgggcgtgccggcggtagcccggagcccgcacgcggccctcgcaggcagcacggctctctctcccctgaccagcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggagggcactggatgcccttatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacttacgacgaggagagagctgtcgagaagctcttccgctgcgtccctgagaagtacaggcagatcgctcgctcgatcgaatctctgctggacctctccacgatgtcgatcgaggaggcgttaggtcgcctcaaggtcgtcgatggtgatgagccacagcctctctcggggcccatcaccatcggcgggaagctccatctcactcgggagcagtgggaggcctctcagggtgacgggaggaagggggagtcatcttccccgacaggcggccgtaagccgcgcaaggcgcggggaggtgtctagctacggtgggcgcgaagacgtgccgagggtggtgcccgcagaggcgcccagggcgttgccaccggcaaccacaagccggcacgagacgacgcctgccgcaactgtggcaagcttggccattgggccaaagactgtcgacagccacgacgtggctaggcccacgtcgcacgggtggaggaagagccggctctgctcctggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgatcggccgacgggagttcttcaccgagttcgactctagcgtccgaggctccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgagacatgccgtgccttgaccacgtggagcagctctgcgacgtctgcgtggtgacgaagcagcggcggctcccctttccccagcagacgagcttccgagccaaggagcggctcgagctcgtgcacggggacttgtgtggcccagtgacaccagccataccaggaggacgacgttacttcctgctgctcgtcgacgacctctcccgctacatgtgggtgatggtcctcagcagcaagggagaggctgcggacgccatcaggcatgcgcaggctgctgcagaggcggagtgtggccgcaagctgcgcgtgctgcgcaccgacaacggcggcgaattcacagcggctgaattcgcgtcgtactgcgctgatgagggcattcagcgccactacaccacgccgtacagcccgcagcagaacggtgtcgtcgagcgccgcaaccagacggttgtggggatggctcgggccctcctcaagcagagggggatgccggccatcttctggggggaggcggtggtgacggccgcctacatcctcaaccgctcgcctaccaaggccctcgatggcagaacaccgtacgaggcttggcatgggcgcaagccggcggtctcccacctgcgggtcttcggctgcctcgcgttcgccaaggatcttggccacatcggcaagctcgacgacaggagcaccccaggggtgttcatcggctacgcggagggctcgaaggcctaccgcatcctcgacccggagacacagcgtgtgcgcactgcgcgcgacgttgtgttcgacgaagggcgagggtgggtatgggacaaggcggtggacgatggttcgactccgacatacgacgacttcaccgttgagtacgtccacttcgagggagctgggggagtaggcagctcttcttcacctagcgtgtctaccccagcccccgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccggtggagttcgctactccgctctcccacgacggggagcgcatcgacgcgtaccacgacggcgagcagctacggtactgtacgatggaggatcttctcggcgaccagccggtgccgggactggtgcctcgcgacctagaggcacagttgcaccttgcgtgcgacgacggtgagcctcggtcttttgcagaggccgagaaacacgtggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggcttgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcagcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgtggaggtcgcagcgttcaaggaggagatgaaggccaccttccagatgagtgatctggggcctctctccttctacctggggctcgaagtgcaccaggacaactccgggatcacgcttcgacagaccgcctacgccaagcgtgtcgttgagctggctgggctcaccgattgcaacccagctctcactccgatggaggagagactgaagctgagccgcgacagcacggcggaggaggtggatgctacacagtaccgacgtcttgtggggagccttcgctacctcacccacacacggccggacttggccttctccgtcggctacgtcagtcggttcatgtagcgaccgacgacggagcaccagcaggctgtgaagaggatcatccgctacgttgcggggactctcgaccacggtctctactacccgaggtgtcctggcaaggcacacttcgtcgggtacagcgacagcgaccatgccggcgacatcgacaccagcaagagcacgagcgggattctcttcttcctcggcaagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtccgctctggccctggcaaagaaccccgtttttcacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctccaggatcgggatggcccaacttccccgcaagacgacgcacaagacttagggggagaatgttggataagtctttgtggtccttggtcgtgattcttctttttgcttttgggtagtttcacctttttcaggacagcatctaccctttagcatatttttcagttgctaggacagttgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatgtatccaacctccctcgggtaggcatggcttttgtgtttagtgaatgaagaaaatcagaaaattgccccatctcgagtgccatcctcttctcagtgagagtaaccattgaaattctaacatcatattccatcataaattcttgtttggagcagctgttttggtcttgacaattaaaacgcatgttaagaaaaacaccgctctttctattacaatattttgttgtgggatttccctgattaataccatatgaacttttatcttacatattgcattgtcttcatcgccaaaagtgagtgactttcagttttctttttctatatatgcagcacagatgattttgttttagaacgatatgatacagagataacaaccgaatcaaccccatttgctattgcacttgcaaaacatttgcactctgttggcgctaagatgtatggagcattctggtgttctcattgtaacgaacaaaaacaggtacaacacaagctcttgaatccactgtacagaataccggatgattttctgtagcttcttacatgctctactctaatgcttctgtaaatatgctgatgctatgattttttatttcgtttttttatttgtgtgcacaactaaatctccaaactggaagtagaaaagtttttacttaccttatcatgtggtcatgcagatttttggtcgagaagctacaaaaattctggactatgttgaatgttttcctaatggagctggcaagggaaagaaaatggctcctgaatgtgcagctgctggtatagaaggttttccgacatggattatcaacggcaaggtacttaccatatctttgatgtttgtaagcaagctcatgattgtgatggcattgttttattgagcctattatccagaaatataatgccattgtatttcttcttgccgtactgaaaatctatatactcccctatactttgattagaagcacttctagcatcctgaactctgaaattgcacaccaacccttctgaactttataatactgttcagatactggcacattgcaaactttagatggcacgctaaactttaggtactgttcatgcaatcgacagttgcgttgctgtatcttcatggtctcctaagactgctgactgcttatcagcattcgctctttcttgacaaattgattgaccttcatgcaggttttgggtggcgaccaggaacttccaatccttgctgaagaatctggtttcactgttgagggaaccgagcaatcataaggtcagacacgagagcaagtttcattcaattgaaggcgagtgttttatggttttagtgaagaactcaggttgtgaaggctgactacaacaattccgcatgacataccgtcacaccgagggaaggttttcgttccacggttgcatagcctacctaatacagcccctaaccactgtaataatcagtaaaagctgctcttctctcatacggagattgggagatgatagaagaagcccaaatgagaggtgttgtataatcattttgtagtatgtagattgtgatgtaaaatgtaaaagggcgcattgcttctcttcctaggtacataatgtaatgtataataccttgcaatgtgatatttgtacagaaaagtgtattgttcagtcttttaccctcggataaaggcagttaatgagtagccagttgacgagaatctaaagaagtgtttattttgatggagtaatttgaatttagcgctgaagattttaagagatgctatagctgtcagaaccgataagcagttttgaaagaagctgatgaatctaactaggaagaagttgtgcttgttagaagctcgttaaagagaaccgagtgtgtgaaagaaccgaatgaagcagaatgcttcgtcctaaattagatggctcccatcggtgatatgggctcgggggtatcaggtttagagggaggaggctgccccccaatgaacatctcgcacagatgcgcgaagatggctagcgtcatcacggcgttgggtgcgagatgcaaggcatggatttcatagcaatccaaaacctcatggaagaatccgaagaatggcggaatcaaccccgccatagcgaaggacaagaggtgcacggatcgctccggataccgtggccgcagccgcgactcccccgccctcacgacggcgccttccgacataatcttgcgggggaggctaaggtgcctatccgtcgtaatgcgtgatgccgggagcactgtgtcgccagcatcttgagccatgatggccggcagagaagcggcggagggcttggcgcgcggaatagtgtgaagtggcgagaatgttagggcttaaggagcgagaagacgagtgggcggatggcgaaaggaaggaggcaaagtccctacctctgtatccttttatcttcgcctcacccgcgctcacctcctcgtttcacgcccccacgattgcccccacgattctcgcgcccgcggttgtctcttcgtttctcgcgtccactcatcacgtcgcccatggaatccgcgccctgcctttagtgcgcctatcagcggcacactcggagtagggcgcgcaacagtcatgggcacatactgagcgaaccgtcaccactaccgccacaggagtagcaggcgagggaatcgatgcgtggtctgaccgaccccctaattttcgcgccttaagcatcctcatcattagcgcggtcagtggcggccaaaccgctgccgtggttggcacgccaacttggccactcggtaatatttccttggattccctgccgggcccacaactccagcttgagaagtcgtgaggcaccacgtcagaccgacctcaggaggccaatgtctgatatggtgctgggggctactgtcggagatatgggcccgggggtatgcgaagtgaggggaagttaccttcccatccagccgcgtggctctacagcctagccccactcccgcacctcgcgaagtcacggaagcggccgggggggggggggggactttcgagcgaacgggcacttgggtctcacaaccccaagcacttgtgttctacactcaatcaatcaagcacaggagtagggtattacgcttcttagcggcccgaacctgtataaaccccttttgtctcatcgtctttgggggattgaaccccctcaagatcacacagcttcgctcaccgaatcctcgaatctcacccgctgcccccggccgaactcacaaaggggggcctcacggttccctggtggaggagttcattccccgacaggcttattagacgataaaaattaatttataagtaaaacttttatagatttgttcgtaacgacttaaaagccaacattaaccaaaaaaattgcgttaaaagcatctcaaaatcaacttcaaaatcaagttcaaaaattcaaattttagcttattctttagctgtttaggccaaacgatggggcttgatgtcgtttaattttttttcttgcaatgtttgaccatttgttttatttaaaaaattagtgtaaatataaaaaagataaatcatgcttaaattttttataacaaaacaagtaacaaacaaaataaatgataattttatattttttaaataagataaatagttaaacgtaacgaaccaaaactatgattagtttttttttaacgtagggagtaatgtttccgtatcaatatgtcacaacgcattacacgtgtcaataaatcggtggtccgatgcatctataggtggaagggttacgtttaagacgaatccagaagcatccgcgccgcgacgcgaaccccatcgcagccagttcacacgtctgtctcgtctcctcgtcgcgccgcgccgcgccgccccgctccgcccgccgcaatgccgaagaagatgggagtcaacaccaaggcggaggcggcgcgcgagcgacgaagcgccgccgaggcggatcgccgcgaccgcgacgctcgcgccaaggaggaggcctactggcaggcggccgagggccccaagtcgcgctccgcgcgccgccgcgaggaggacgccgagaagcgcgccgaggcggccgcacgccgcgcggagaaccgccgcctcgccgagctcgagcagcagcagctcgccgccgccgcgcggcgccccgaccgcaaggccgcacgcgtcggcggccccgtcgtccccaaggtcaccgaggccgagctgctgcgacgccgggaggaggagcggatccgcctcgagcgcgaggctgaggccgccaagaagcgacaggcccgcaccgccgaagagaagaagtacgagcgcgtcgtgctcgtcgccaacaccaacagagacgactccatcatcgaggcacggtcagtggaggacgccatcgtcaagatgtccatcgctgccgagcctgcgctaccaccggatcgccaccccgagcgccgcctcaaggtctcgtacaaggtatggcactaacctatctgtgtgttttttttctttccatggcaactgtaaaatcctccttgtatttgtagtactcggggagaaattaatactgactatagtaaatattcttagaatcattgagatgtgactgcaattattgctggattcatggttcataggcagcagttgatgtacataaacacagttttacaaaggctgaaattctgtcctagttttagttggtgctatagtgagtttgagaccaattggcaatcactggcttgatctaaccaactggatttcttagtgtgttctatctagtaccctttttttttgtgctcttctgatcagcatatcctatcttaatgcaggcttttgaagaagcagagctagccaaactcaaggaggaaaagcctgggctgactctgcatcagtacaaagatatgatatggaagttgtggaagaaatctccagacaaccctctcaatcaggttcaaccttaaattcaaccttacttcgttagatcatattaagcaccttgttcttaagataaactgaaggtcttaaaacctgttttacgatgatctaagaagcaccccaaaactactaagtttgtagtgaaatgattgtgagttaatgatcacctcagtttgcatgaaggtgatgtatgtagtgctaagtgatgtggaaggtgctaaggagcctcttgaattttgccatcctaatcatatgaactgataaagaattcaacattcatcattggatgtacctctatggccttccttttcaaatatcgcaaatgcctattgattccttgaaggcttatagctttatgtgacattaaaattcacttcacttccagagctgagaaaattataacgcagctctaagggaattccatcagttgtgctcttagcgcacttgactgtctataacatcaaccttaattttgcaggctgctgattgatttcatgattaccttaccacattggagccaacaacctggcatctttcttttggttctttatgaacacaaggccacctgtaaagtatttacttttagagtcaaatctccttttgtttctgcatcattggtgcaatttagcaaatgtgagatctgtacaccggaagagtacaatgtaacatgctaagagtgttttttgataaagatatttgatctattatttattcattgaaggaataaacatatacttttatgtatgctaagagctgttcctttctattatcctgatatttggagccatcagactgctagatatgttcatgtggtcgtgcaaggtattggcactctgtcagactgcaatattgtgcctgaatcttatgcatcctgttgtgcagtctagctagagtcgttggcttcagaatgtcttccaattggatcggctgccttgatacgaggcaagcatttcttcttctaatcttgagagagtactgaattttgccatcctaatcatacttaactgatgaaggatccatatgcatcaccattttctgaaactcttcacattctcaaattgcaatctgaggttaaagttctgctcaactcaaaaattatcaaagcgctaatgatacattttgcagcagcacaaacattttatcccgttctgttaaacacagcaaaaccaggaagaatcgaacaccctccgtcgacggcgacacgctgtcacccggcgaccggcggcggcggcggagcatcaccgccagcagccaccccagattgccgctgctcgaactcctggaggagttcggcgtcgacgttctccgcgggctcccacgtcgcctcctcgatgtccacccacttgacaaggtactcccatttcccctccccttccgccgcctccctcttgttgacgacggcctccgcgacggcgtactccagcccggcgtcgaagtccttcaccaggtcctccgccacccacgccgccctcacccactccctgtcgccgccgtcgcgccactccaccaagtactcccgccacttgccctcgccgcggccgtccaccaccttctccacttcgccccactcgtacacggccttctccagctccttcgccgccgcctccagcgccagccgccgctcgaacgtcgccgggttgcccttgggcgtcttcgcgagcacgtcctggaccagctccagcggcgtccggccctgcccgtcgggggcctccggctcggcgcccagctccagcagcgcgcgcacggccgccgggcgcccgtacccgaccgcgatgtgcagcggcgtgagcccgccgccggcgcgctcgggtcgccccacgtcggccccggcctcggcgagcgcgcgcacgcactcctcggatccaagccccgcggcgaagtgcatcgccgtgcgcccctgcgcatcctccgcgtcggggtcacgccgcagcgtctcgtccgcgagtagcgcagtgatctccgccgcgtccgccttcttggcggccgtccaccacggcgtctcgtactccgccaccacgtccgccgctatggcctccgccgggatccacgaaggctcgtgcccgtccttccactcgacgaggtactccgtggcggtgaccgtggtggccgagccgtcctccgcgaacaccggattcttgatggtgcggctggacacaatacggtccacctcgccgtacgcctcatcgtcgtcgcctcccttgctcgctgggtttcttgggttggtctggtcctggaacaccgccgcggcggtgagccgccggttggggagacgaagccggaaagggacggtgatggagagggctggagttctctgagcattggggttggggggtttgaggcgggaaagggatgggtgtcgtaggacagcctccattggagtggaggagcttgtggcgcgagtggcagtggagtggagggaagaggatgatgggtttggattcgggagggagaagaggataaggtgatgggtctcttggattgtgtgcgatctgagccactcgttttgtggcatggacggtacagatggagtagtgctattcacatccgccaaacggtcgatgatgcccatttcccaccggagatcggggttcgggtccccgttgccgcgcgcggaaactagctactgtagcatttagatttgcagctataccgagagccaactacttaaaaaaaaattatgacaattgaattagaatgtgacacatcctctatatctaaattcgatattctagtactatgttatcttttttttaaacggaagtaagtacatattaataattagatgattaaatttgtataaatatgttaacatgtacaatcaaaagtgtactccttattggcagttgtgcgtttggttttatgcatgctagctcatctttcttaacccaaatttcctctctccgtttcttgctagaccagatcacaacaccctgttttagtttaaaatcgattgacaacataaacaaaaactagaagttaagcttgtgcagctaggcggtgcttgattcatggcagagcaaaatctatggtgggtcacgtccagaaacacaaagaagaagctccatccatgcatcgactggacttgattccggtcaaggagatcgatctggcggcgaaggcgctggttcgcatgacgagctggatccgcctaatccgatttgtagctctctccctctcttgaaggggaagttttccgatgctgaccagcatgccggcaagaaaccaaacatgccggatttgacacagaggccgtcaagcaagttatgtggcagtgtggcacagggggagctagagttttgccgtggggactgagcgaaaaaaagggcaaccaacgtgatggcaataatttagcaagcatcggcaaaagagattgagaggagtgagataaatggggattgttggaacgacatgtgctgatcttgatcttgacggtgtttgttggcactgcctcgtagacctgctttttcatctccaggcaatgagtagacctcgtctaaaaatctccctcctctttctctaattgggtagttagatccacacattttcttcttaagagcaaatttaatagtttttttagggacatgcagagagctcctacaatttcactatagaagaagatagttgatataagaaaaatcagacccaaaaactttacaacagcacggttaattttagaaaaaccggcgaaaacccggcattgacaaactgaacgcaaataagagtagtccaacaagagaagaaactcctaaaacgaagccttcaagaaggtaacgccgacaagacggcgacaacgtccgatcctaacgaatctaaggttttcactcggagaattcccttgaagtggagttgaaacaagggctttaaaagcaacgccttcaagaaggtgaatggcacccgagggcgtcgccgttgctagcaccggagcagagcaaggttttcacctcggagaccctgtcaaccaaagcatccacaacggaagctcccaaatgccacttgcacaccgaaaggtacctacaatattcacaccacctgcacgacgaccggactccacaccacccgaccccgactgtggatgcgctagatctggacctaggagcccgatccggccgtctttcttgcaccaccatcgccagccgacgccacaaggtagcatcgggcaatggaggccgtcggcgctgcacaatcctttcaccgccggacgccgcgccgtcaccggatccacgaacaaatg

SEQ ID NO: 10664 - DNA, 1664 bp, Oryza sativa
cccgcgccgcccctgggggaggacgatgtgagaggaggagggcttccgtgtctgtgtctatggtgcgtcacaagtttttcagcaagtttaatagtagagctcactaatagctattagcatattttaaagccaacataaataatatattagctataagattggtttcaatttttccctcctctccctttttctcactcatatatttaatgtatttgtatttgagcacgtgttaaattagctcttacatgagagttaacacattttattttttgtcacatctttccttcacataagctcactattatccttgctccaaaataccgtgtgttctatactacgtacgcctaacaaccttgtgaggccacttcttttctctatggcggcatctgaatctatgtggatgctagggcagaggctagagccacgcaccctaaatgtcccaaggaaaaaaaataatatctccaaccacgtttggtgaatagcctcattgtatcttcgtcggtcgtggcaatgccgggagtctagccaccggtgcgtatgaatcaagatcctctgcaatcaattgcaccgtatctttatcactgatatatagcccgattatgtagcctgataatctctgggttcacatgtcagtaaaaaaatacacggtgcagttactggagaggatctcaatccggtgcgtatacactcagcattgtagccgcccccatcactccaccggtccgcccccaccctgcttttccgaaaacgattcggcagaccggaaagcgggaaaggcagaaacacacggcagacggcacccaccacccaaactcgttttggcagtgaagcatcggtcctcggagccgccgcgccactgttactaaccatttgtagttgatggcacatgtgtcgccgtcgtgtcggccccattctccgggcgagatgctgcgagcaaaatggtcatcccccttcctccgcagctgcacaaccctgtcaaaactcaaaacgctctagcgcttctcgaagccgccgagattcaggccgcatggtgaccgttcttctctcctacaggtggttcaagcgcacgggtgggcccacacgtcggtgaccgattcacacgttagtctgactgaccgcacagtctgcgttcgatttcgcacatgcccgcaccgcactatccccacgtgacgacgacgatacgggcgattccacctgccgcaggcacggctactagtactactctactagcctactaccccacagcagccaggaaccagccacacattccacagccgcgacgcgacaccggaaacaaacgcaggtagcaactgcaaggggcagttggctggagctcggtgatctgtgggtctgatcgcgatgggacgctcaccggagatggaggtggacgcgcgcagcggctactgcgccgccacccgcacgttccggagcaggcgcgccgacgtgccgctgcccgccgacccggaggtcgacgtggtcagcttcctcgcctcgcgccgccactcgggcgttgtggccctcgtcgacgccgcgactgggcgccggatcaccttcaccgagctctggcgcgccgtggccggggcggcatccgccctcgccgcgcaccccgtctccctccgcaagggccacgtcgcgctcatcctctcccctaactccgtccactt

SEQ ID NO: 10665 - DNA, 4091 bp, Oryza sativa
catctccatggtccagatcatcatgacgcgattccgcctcgagggctcggacaagacagagacattcctctgcacggtgcccatgttccacgtctacggcctcgtcgccttcgccacggggctgctcggttgcggcgccacggtggtcgtgctctccaagtacgagctcccggagatgctgcgctcgatcaacgcctacggggtgacctaccttccgctcgtgccgccgatcctggtcgccatggtggcgcacccgaagccgctcccgctcgggcagatgcgcaaggtgctatccggcggcgcgccgctgggcaaggagctgatcgaagggttcagggagaagtatccgcaggtggagatcctgcaggggtacgggctgacagagagcaccgccatcggcgcgtccacggactccgccgaggagagccgccggtacgggacggccgggcttctgtctcccaataccgaggctaagattgtcgacccagattccggcgaggcgctgccggtaaaccgcaccggcgagctctggatccgtggaccgtacgtcatgaaaggtttgatgaacattgtttacatttcatttagacttggcagcatttttattccattagcgagttgcacgctagaaattgtctgtttgtggatcactaatataaacgcactaaacaaattaaagttataaccgcgtcatttggacataaacatataaattgagctataaccgtgttctgaactgtcatgagcttgctgcctgaacaaagttataaccgcgtcatttggacgtaaacatataaattgagacccctgcgtcatttttttttgactaaggccacatggtaggtgccagttcgtaggactttgtttaatttactatatcgatcgggcggtagctttccatgagaataaagttagtgttgggaaaagaattgaaatgcataatgcatatgtatagattatacattgtttacatctgattatctgtaggcttccatgtgcattgtgcagtcaaactattataatgttgagtgatcttttaggtgagatctttcgcgggtgctctctaccagaaccatcgactgaatgaattgcccctgacattaattcctgtttgcatgcatatgctgttcgaggcatttgcctttgatttaatcgtgaagaggaaatcaattgtgaacacagaattatgatttatatattttagttcggcaagtaacttcacctttttctagtactaaggatcattggcaagtagattggttcagtgagtggcagaattatgttcattatgtggaacatcaggttcttgttcaatgccatgaatatcttgctatgttgtggcattatagtacactttgaaatgagtcgtgcattcagttttccacacctcaacatattttagtgtatctccattctttcctttacttttttttaaaaaaaaaattaaggtaaaggatttgcctgttatattaacaaagcatgtgttcactacattcagttgcaagcatatttattcagaatgagtttcatggaatcagtaagtactacgtgataaagttatgcaatggcagagcttacattttacttgcttaagaaacaagaggtgtttcaggcagttatacacaagagatttgctccggtccaacaaaaagtatctcgagataccggtacctcacgttatcgaatcatttccgatcgttggatctaacaatgccccatgctgccagctagatccaacgatcggaaacgatttggtaccgtaaggtacacgtaccggtacctcgaggtacttttggttggaccagagtaaaaatctctatacacatgagatacccttagccagctaaagcttgcagtcaaaattggtgctttatattttcctgctatagaaaaaaataatgggtgtaactcaaagttggttctcctcaggctacttcaagaacgcagaggcaacacagtcaacgctgacaccagatggatggctaaagaccggtgatctctgctacatagatgaggatggatatctcttcgtagtggaccgcctcaaggagttgatcaaatacaaaggttaccaggtaaaaatcactgggtgatatgtctgatatgttaggtttcctgaaagacttttaggctacgcattttcttatatctgtaactctgaatataatttgtgtatcactaggtgcctccggcagaactggaagctcttttgttgacgcacccagaggttacggatgttgccgttataccgtaagcttcatatagatgccagttatcacttctatagaaataattatgctaggttctcaatgggttggtgtttggttctgttgcaggtttcctgatagggaggtcggccagttcccgatggcctatatagtgaggaagaaaggaagcaacttgtcagagcgcgaggtgatggagtttgtggcaaaacaggttagcatgattcgatcgtcagatccaaaatagaagttgaaatgaaacatcatgttcagtgttcagtgttcactgttgattcagatttggcttaccaatcccgcaatttctctgaacttctgttatataatatacgcaggttgcgccttacaagaaggttagaaaggtggcgtttgtgacggacattcccaagaatgcatccgggaagatactgaggaaggatcttattaagcttgccacatccaaactatgaaatgccaatcaattatctactactccacaatatattaagcttgtcaagaatgcattcggcaagatattgaatacgttttggaattggcatagacactttagttgttgtgtaccctctttctcaatatggtgggtatttgtaaatgaagatatcatcagtcatgtgcatttcttctatacatgatctggtagagttacactgtatccattcttgtataatcaaataaaaaataatttccgagttcgagccttcgatgtacactcatgtctgcccatcgcagaaagaaaaaaagaggaaaaacagagactcatatctgtccaaaatcctgttttgggtctgatcagttcggtgatcaccagctttctttgccttgatgggcctccagcctgtaatggcgtatcaggacgaccttgtttttggatagtttcaggcagaccttagtttttttttctcaataacgaaatagaacatcccggtctttactcaaaagagttagagttacagccaagacagaccttagttagggcagcgattctaaggtttgagcaattttgtttgcctatacagaacacaacttgttacagttgtttgaggtggattgatctacttgttctaatttggaggcgttcacacaattattgagtttttaattgccaacaactcgaccgttagtctactaatgacctatatattcacttgaaaatggtacggatgatggtaggtggtcgacacagccgcctgcatttgatttgtccgtgagaaatgccaaacgggaaaataagaaagaaaaagcatcagacctgagctaaggagtacattgaatattagccggccctgaccgatgctttgctgctccaatcacgcaaattctatggcccaaacattcttcgcactacaataggatgatgggctgagcatatatcgcacgcatgtctgcttctgcttttgagccttttttctgttcccattctccgaccaagataaaaggtgaaatcgattgggacggatctcttctagagaggcggttaaagtggcctctaggatgtcgacgcagagcaacctttggaacagcgaggaaaatgacttgataaaggcgttaaagcaggggagaggcattataggattcggtgacagggacaaacaagaccacaattcgaattgttcatcagtcagcccattaagatctcgtcggatcaaggagatggaataaaggatcaaactcggtacatgtgtgcataaaaggtacaaataatgttctgtgcaacgagccagagaaggcgtaacattttatttgacagttgataggagtatatttcaatgctagtagacggagcagaacgtatacacacacacacacctgacagctcgatacaaagatgtatcgcacgtatataggact

SEQ ID NO: 10666 - DNA, 10413 bp, Oryza sativa
cctgccgacctgagtccgaggcgaaaccacccgctaggtgcgcagcccgaaccgggtggaaggctgcagaaactgcggcggacgaagccacagccccacgtgcgccgttgcggtatccgcgcatcgcaaccgagcaagcagccatcccccgtcgcgcgcatcgcccgtgcaaccacgcaaaagtacggagaatcctcgtcacttcctcgtgtcagcctcatccacgggtgaccctgccgcatgcaggacgccgcgcccgcgcgtagtttggcctgcacctgcacgttagccggtcaggatcggagagcgaagtgcacgagacggggcagagtcccatgattaaccggccgggtggcgacgggtcgcgttgcttgccgcttgatttgctggatccatcggtgttcgcccgggggtacggtgggtcgccgctgctcggcctggtcatctggcgccccttgttcgcttgtgtcacgggccagcgcccatcgagctgcaaattccgtgacaaattgacagcttagctgctgcctcatcacagcgtacagtagtatactactactagaagccctctgattcctcgatgcattcattcgtgcataccctggctgaatgcgtgcacggctgttcgacaagggacggcatggaacggaatagtggatgccctgtggttatcaagtttttagacccaagtggggcagttctacatcaccatcttctaatttaaaggacaaatcttgtttttgtatgttgtgattcgtgatgatagtataagacttatattatatggacaagttaatttttagaaacaccgaccagaacgtgctagtatatatcacaaaggacgtaacggaaactgttgtttactggagctaaggtcgattaaattgaacaccaatcagtcaatggagttgttagcctttgtcaattgcgactgagttgcacgtcactccattgtgtagccatgatccttggacaccggatacatgcatgccattgctggcttatttgcaagtgaagaagaaaaggaaaagaaaggggaataacactgcacaaaactaagacttgagttcctctttggaattaagacctttctttccatagttgacgaaattataccgtcatgactcatgagcatcctggctagctcccaagtccctttctccattcctccaattatgtggcctacgaaataagaactcaaaaatgcggtacatgcttaacgaaattaaaagcttggcattatccatccaaaaacgtcgacctatcagaggggccatacccatacatgatgcatgcactcataattcacatttatgatgatattatatagaacaaaacggaaatgaattttcagctagtcagtcagccagtctcgtggtcgtgtggcgtggcagcgcatctcaccgcaccggcgttggtggtgcgtgccgtacgaacatgataagccctaatcttttatcggctttgctttgcttcctctccacatcatgcaaaggcagccacttctgttccgttcattcttatccccccaacccccactactcagcatcacctcagctcagcctcattctgcaactccattcaactgtctgatcccttttctcgcacgccctaaattcttcagatatcagacagttgcttctttctttgctttgtttttttcttttcttttcctaccatgtctttctgccatccgtcttatactttcctgtaggaaaatgtatatgtgcgtgcatggtgaccaccagtgttagtgatatgggtatactattagaaaagcgacgatcgacgagatgcgtacaagtacattattatctcttttattttttggattaacacatgattggctctagttaaggcatgcttggctcataaatttctgtcaactccactgattagttcgtgagttctaaacgaatataattaaaaccggtaggtgataaatcacaagctgatctgcatacttacgtaacatcacaagagatttgagctgggtgactgtgtactattgaggacttgtcaagtagcatgtgtcgcaacgtgtgaacctgcggttcgactctatggaataagcatgctagcagtacagaggtttttgtttttcacctttcaaaggtactcccttcgtttaacaatataaatcattctagcattttttatatttatattatttacgaaatactaaaatgatttatattatgaaacggataaattaggaatcatgtcgtaacgaccagtaagtaaaatctgctgaactgtgtgcgtacgtaattagtcgcagatgcagcgagggaaatgtcgattctgcgtcaagatgatgatgctggtgatcgctaccctgcccaaaatcttgagcctgaagggtctctctgatatttcttttctgctcgcacattcacctggagtcactgaacactggtccagctaaaaagaaataattggacacattcaccaacccccaacatcgtaatttttcagtagtgcgattgcgcacgaactcgaagatcatacggcgccactccctctagctattatactaatctttaattaattggatgccacaatcttatagtattaattaatttgtttgtttgtttgttcatggccgacttgaaacttttctgtgagtcacacaataagctgcccttttaattgtactagtagttttttaagtgatcaagaagcgattgatgcagaagagcgacaggagaggaccagaaactgaataaatccaacgctctacaacaagggaagctcaccggccaacaccagctagcaaagctaggcgacctactcgctcaatgttcatcagtaatactagtatttggtttttctttgcgtgggactcgacttttgtcttgagctgagattcgtgaaatgcatggtactaataattaaaatcctggggttctacacaaatagatctcgttcaacggaaacaggtgattctgaatgcgcacagatgcagagacaggaggggttaatccgttagtataaacgccccaggattagcaaagatcgattttcatatggcgtcacgtaaccgtcaatattaatttcacaagcacatgaaaaggacaaatagaatcgaaaatcatagcgattattaattattatttcctctccaatttgcaaccggctctgctagctgtgtcgtccacatccgtttccaggagtcgacgtccaaccgtactacgatgattctacgctcctaacggaaaacaatctaccgagctacgaaacgagtgcacaagaccacgcaaaatctactaacacgattacctcataacctcccgtgaattaatcgttttcagatggccgcgtatctcaaaccccagccgcgcccgtacgatttgacacgaaacttgggtacatttttcagcagcagcagcggggcgtggagccaaaatcttatgggtatctcccgtgcagcgtcgagagatcgaccgctcgatgccgcatcggcgcaagcggccaagcgggccacttcgcgcgcgtgccgcgctgtcgagtggagccggtggccggtcgtctcccgtcccgtgcgatcccctccttttcccttccattttgtcgggcgcggccaccgccttttacacacccgcctgtcacgacgtacacctcctcctccacacatacgcacgcagccgattcgcgcgggatccgtacttttttcttctatgtatatctctcgtgtgggattagttattggtttggttactaagtggcgcctaattacctacttacagttgcagatacagggttggctgtgtgcgcgcgcgcgcgggcgcgggcgcgggcgtgtgggggggggggggggggggtgtataaaaccagtcgtcacgcacacgaatccacctcggtctctctcttctccgaagcgacccacactccccgtgcccgagccagagagtatggccgtctctgtccgttgctgcttcggctcctcctccctttcgcaccacgcgcgactactcctcgtcatcgttgcgttgctcgcgcctcggctcgcttccggctgcgaccgctgcgtgcgccgctccagagcggcttactacacctcctcgctcacgctgactggtatgtcgacacgacggctctgtttttgttcgtggttttgcgtgcaaagggagcgtccggattatggatcgactgattgattctgttcgtttgttcttgcgtggcacagccggttcttgcgggtatggcacggcggccgcgaccttcaacggcggcggattcctcgccgccgcgggccccgcgctgtaccggggcggcgtcggctgcggcgcgtgctaccaggtaatcaagctcgatcgagaaggagaacacaaccgaagataggcaactagcttagctgcatatgccatgtccatggcttccccatcctgaccgattcgctgctgcaggtgagatgcaaggacaagaagctgtgcagcaacgcgggcgcccgtgtcgtcgtcacggaccgcgccaggacgaaccgcaccggcctcgttctgagcagcccggcgttcgccgccatggcccgccccggcatggccgcgtcgctcaccgagctcgccgccgtggacgtcgagtacaagaggtaagcaaagctcaccaagctttactttttacccagctcgctttcttttcaccaaccgcaccttagctcgtgttccacacatatatagataaatattaactttaccactgttcaacagagagagtttcaccggtccgttgctgtagtttaccagttgcaaagcgtacgtacgaaatgtttggcaagtgctaggcgaggcaatagatagtgaacacgtacgattgtcctaagccggaattggaagtcaggctcaaattcgtcagcgatgtgcatgtgcagggtaccgtgcgagtacaggcacaggagcctctctgtcagagtcgacgagagaagtcgcggacccaacgagctcaccatcagcttcctctaccaaggcggccaaaccgacatcgtcgccgtcgacgtcgcccaggtaaaaacacagcacagcacagaacaatcattaacaatctgcaagtgtttgtgtcgcagaatctaacaatcgtgtgttgggagctgcaggttgggtcgtcgagctggaagttcatgacgagggagcacggaccgtcgtggagcatggcgaacgcgccgccggggccgctgcagatgaggctggtggtgaccggcggctacgacgggaagtgggtgtgggccgaccgggaggtcctgccgaggcggtggcgcgccggcgaggtctacgacacgggggtccagatcactgacatcgcccaggaaggctgcttcccctgcgacacgcacgagtggaagtagaagcccagccacacgtacttctcctgtcgtcacggccattttggttgggctttgatgagaaagaagacgtctctcggctcgcctccagtagagatttcactgacccgatttagagtcctcctaatccctcggcaacttcagaatttcctcctccgtttcttcttcttcttttccaactttgtacatgagctactaactaatgtgtaaagataaaattaaagcaagttacaaaccgtcccgtcccattgggagcctaaacaactaacgaaaaacgaaccgaattggcgccgccgtgaagcaacaactctcctgagaacgtttgcaacaaccaacgtatcgcagtttcaaagggctcacatgctgttgctgcctctggcctgggtgtgttgcttccggcaacattcctctctaccctgagtccctgacacatggcttgctcggctgcctctgcctacggtgtgcttggtcatgttgccaggtgcggagctaaaacgaaatggaggatggtaccacttgcttaatttactttagtttagatcgaatttaagctgatgcggatgtctaagtttatattgagagggtacatacatgataagaatagataagatatagctaaaataattttcttaaccgggttactggcaccctcctaatatacagcccctgcacgttgctcgttgctgttggtggtcagacttgctgacggagctggtcgttaaaccttatcagaattctgcatgaaatgtgaggtgattaccgaaccgtttccattatctgaaaaaaaatgtgaggttgattacttacacgagaacaattacgagggatattgcaattcagagtttcagacatgtatgtggtgggcatcagggcacggtaggtgagtgggccataaatggcagtcacagccatcatggacaccgcaactccacaagtccatggtgcgaggtatgatggccagttgcccgactgaactgaatgtgccggtgaaagtgagcttttaaagtgagatttccctcgcattacgttgccagtgatcgtgtctacgtgatggtacagggttggatcaacacagcatcttctgcctttcgatctgaaactaggtactagctgcaagtgaaccagtgattcagacttcgaagcacttcatttcttcatttctgctgcccaaattgtccattttctttttcaaaacttggctgtccacgctccacggcctaggaccaggtcatggcttctaatcaaacagctcatgaacgcatataaaacgatacgtttgaactaattttttcacaaacaacaaaaccggtggtagttgaaatcaaattaaaatggagtacttgaaaccgagggttctgcaattctgctcagcgccaaagcaatcaaacatccgagcaacttagcaactagcacttgagaaggttaggtggtcaaccgtacaccatgcgtgcagcagcatggatcaatcgatttgcagcaccagcagccaacaatctgatccgatcactgaggctccaacatttgtaggcaagcaacacgatgatcactaaagcaagtatgtcatgtgtgagagcctcgagtgagacagagcggccggcccggcggtataattcactgtccccttgtgcttagcttgcagtaggaattcagtaacctccaacacttggcattttgctgccgtataatcaatcatcatacgagccgaccagcacaagaaagaggactcgaatctagtggttaggagaactccaaatgaacaactgaattttaatcacgaagggtagttttgaatagttcttgttactgtctctgtttgcttgtttccacacatgagcctttggtttgaggtccatgttcttgcccaattagattcagaagtacaattctggttaggtgtttcagatggttgctcatttaggtgcacagaaatactagtgacagtagtattgaagagctgttgccaagttagcagaggcaagtcttgtacttagtagatatatattaagtcttatcatgcattcagacattaggataatcctaagagccgaagctaataatgttctcgtttggttcagtgaacaaaaaaatggacagctgatttgtaatattctgattctgtttcggataacagaaatcacaggtcagaatcatgagtactgtgcatagttctgagcttcttatccattagtaggacagggcgttcttattattatttttctttatctaaaaatattaggacgcaactagtgaaacagatggggcaagtacgcatcagcttcatgagtggatttatttgggagccatgaactccatcttgtgacttgtgaagagaaattggtggcctacctaaaccaacggtatctccattgtagttttgtaattgtgctaacaccaatgtgacagttattaggtgacatttttgttttgatcatgacaagatagaaatatatatcatgcaaccccaatcgaatataactactacgaacagagccaagtgacaaaatggttgcaatatttctttttcactttgttggctaacgaatcaccagcataaaactgatagtttatttcatctgccgacgtaggttgctagcccaagtattcaagctgaagtttgcaaagatgctacttaaatgatgacgatagcaactctatattagattattgagacgatgtttcagagaaatcggtgatgttactttctgaaggatgcggtgtcacacaatcacgaataagtgggtcactgttgttcaagcaggaggagttggtggcgactgtattaacaaaacctgaagagaaaatatgaacagagagcctcttaatttgactgaagacaatatttagttttaaaaaattgactgaagtgtgaagacataaataacgatctgacgtttgcagaaattttatgtgtatgcatgatatcagtaaatactatgttgttatggcgacacatgttgtttcatcttcagtatgacttgggttcagattctcgggaccccaaccagtgttcatagcttgactaggtaatacttgggccagcaaaaacaaagtaacagtgaatagggcaatgattgattttaggtggtgtttatattgtaaaacatagtgataagtcaggctcagacgtgttacctcaagatgacatagccacatcatgataaatctcgcttaacctagacgctcggaaagaaagctttggtgtcgttgatcagcacgcaactaccttgcagaagatgctctcagatcacatcgactatagcctttgtgcatatatcggcctactatcagccacatggcagggaacaatttgccaactcagatgaaatttatatggaacagttcagttacctgttaccgcatatatatgaaacaaaatataaataccatgttctagacagtgcatgaatctccatttggaacacctaatttcagatgaagcagtttaatcagcagaagaatctggaaaaatattattgatctaaaccggaatctggaaaaaaaaaaccgggcttaggtttttctgggccttaatctacggattacagcctgcagccaggaggatacaaacgttttgacgtcagtgggccaagatataacagtaccattgagaggccaagaatccaatacttatccggcctttcaagatccttgtccgtttatgtgttgaggtttgaaaatgactggttttggctgtagcctgtacgcagttacttaccaccgatatgattcatccaaatttggcttgctcacgttagtaggaaatcagacaaaataagagtacaggaacaaaaagatcaattaaaaacaaagggatcaagatcaactatactaattacccatttgatttttgtgatgattttcggcaagtcagtcacgcatactttggcatgttgaacttttcaaaattcaaatatgacggacctgactcctcatggacaagttcgacccatcttgatgcattcgacatgccaagctactgatatgtgtcatcattgcctctattatgcacatttgggagtagtgagacgacagcaacaggcatcacatcaagaggaggaatgtgtgcgttcactccaggaggatttgaaatatttgaatcacttttcaccaacccagcatttccttctgttatcagttgaacgcccgaaggtgcagaatcatcccagcatagagcgaatggtgtgtcgagatcacccttggtgtaggttctaacttggtggaggtccagacccggccgtgcgcctcctaagccggcccctcgtcatccgaatagcctcctggatgagcgtatcttcgtctggtattgatgactgacgtgcgttgcttgttgatggaccagatggatcaatctgcatagcttcagtgttctgagggccgtcgctggcgttagcttgaggaggaccagcatgtgcctgtggctgggcaagagactctgcaccaggaggaggaacaggaactggagttgtatcctgcgtttggttccttggtggagcagaaggagcttgggtgggttgtggtggcagtggaggcaccgaaggtgcaggaacaggctgaggtgcagggttcacttgccgagtctgtgctggtggtgggcgctgctgctgttcacgtgcctgcagaatagaagggttgcagtgaagtcagtatgtcagtcacacaaatataaactgtcacacatgctcgctactccctccgtcccataatataagggattttggagagatgtgacacaatacatggtcctaggatgtatcacatcccttcaaaatcctttatattatgagacggagggagtaataaatatatagaggtgcaaacaatcttttgaatcctacaactggtaaacaggacattaatactagaacagtaaacatcacaatgtgctcaaataacaactctatcgtgcactaacaaacaaaaattgttgacgccgccttataaatggcatggttaaagagtgcaacatttagtaattcaataaggaggtaatccaagcttctcaagtcacctactgtagtaaaagatcataacaagaatgaggctagtgttaatataaaaaaaataccatgcacagatca

SEQ ID NO: 10667 - DNA, 6934 bp, Oryza sativa
gatacctgtgggcgagatgtttgggtttgtgactgtgaagcaacatattgcaagatttcataaagccttgtctgaccatagttggaaaccttctggaagtaaagaaccgccatgtcgcaagctctagtcctcaactcaagcagattgtgatcgatatcagcttcgtattttgcaatccacggtttaaagaatgattcatacacataggcagtcccctgaaatcaacctgtgttaccaacaaacaagagatagattcttctagcagtttgaaatactagagtaccataccagtgttttgggataccacaaaaatacgacaaatgccagctttgcttcactgtacattggcaacctacacgcaaacaaaattatcatcagcaagcaggtaagatttcccctttactgttacacctgaaaaaaatacaattccaaatggtcaacttaccatgatacaaaattatccccaactctatcaaaaacagttagaacagcaagtaaaatcctgcaaaagccatgatcacacagctgagatcaagcataagaaatccaagaatgatagtccaaaataaaacaaaagggcataaaaagcataccagtactgacaccagaaccgcaacttctcgatctcaggcttgttcagttccaccgtcttgtagcaatcataggctgggtatgcatatccaagaataagcctgcaaaataggtaataacaaacatgtagcagaccaaaaccattacctactgcagtacttttgtacaaaaactgctgctacttacattaaagccccagtaatgaatgagccagccatattgactgttgaggcctaaaggttaagaaaacaaacatttgttagaaacactgtttaacagccaataacagcatccataaacaaggatgtcctatgagcatcgaatctacagcagcagttacacataaaccctcatcaagctccttcacaacacaaaacatagataagcagatcattataccgctttggcagttttcaacttttgctccccttattaatacagtcatcatgcgttttaaaaaatagtattcaatcatgactgcatcgtagattcatagtagcttttcggacccttaatttatagatttcagattctctataccagatccgttccaaataaaaaaaaaactgctataccaaaggatgaagagagtgggggggaatctatatgaacaacctacttagtaaacactagtgctaatttgaggagtttgataacggatcgacttgaatccccaaataaaaaatcaaacgagctgccaaaattgcttcgctaaattgaggaactacctagacagtaaagcaaccccctacaaaggcaatcactacgtttgtctcgcaaatctctccaaaatccaaatgcaagctgcttacaccaacatggaaacagagtgcagaacatacagcaaaaggatcacatctcaactgcaacagcagcctaatcccatatctgacaaacaacctgatgatactcgtagcgtgtatggaaagttggaaacacttctaacgggccgcgaagctacggcaacaaatcgaaacgagggagtatacctttcctccggccacaagcaacggctcgatcgagcgagcgagcgagacggcggcgtcggtgctgaccgaaggacaagagggcggagaagctcgtgtcccctgggcccggggctccgacgaggatggcgcggtcccgcagcgaactcgagggaggaggatgcgaggctagtattccggcgtctcccgtactcccagccgccgccgccgcccgcggctcgccggcgtagtgcgcgagcaaccgcactgtttgcgcacgagaagtcggcgacggtgggtgtttcggccggcggctggcggcttgggctgctttatattgggccgttagtgggtcgttatcttgggccgttttagattgggctcttacttctgagacctcttgttgctcgtgttcaagcccacctgttctccgctgcttgcaccaatgccaatttcagtctcagaaattcagaatccacacacaagtatgttgtcatgttcagattactgaaaatgcaggtgtgcaattagccactaagctttaaataaatactaaatttgatactggtattagttaattctttgcactcatgcagattagtattgtcggttacaattgtttgcactcatgcagatctggcgatctcctgctataccgggataccagttctctagtattgtcaagcttgatagctgcagcacatggctgcattcatcgatagatttttccgctagacgaacatgctcacattctagagacagatgccgcagccgtgattaactaactcagccgaccaaatcggcggccggtggcgtttgacataaaagaatctgcatattcattctagtcgctctcgagaaatgcccaggggttttccggctagctttacaaggtggtgggctagacgacctgggttcaaagcctcacccctcctaattatttgatattaggttcttccctaatattctagtttttattctagtcgctctctcacagtcacgtactgcttctcaaactacatgcaacgacattcacgaaccccaaccaagtcaatttggcttcactgcaaacgatggacgatacgattggatttcttgtcgactactactgcagacttcaacgttcaggttggagattctatccactaagagtgtgtttatttcacactaaaattagaaatttggttgaaattggaacaatgtgaaagaaaagttgaaagtttgaagaaaatatttagaactaaacaaggcgtaaatgatctgaagctagaagctggtctggataataatcttcagtcatgtcagtaacttctgcggttttggctacgaaaagcatttgcaacttgaggtgtgtttagtttacatcaaaattaaaattttggttgaattggaatgatgtgacgaaaaatttgaaagtttgtgtatagaaaaattttgatgtgatggaaaagttgaaagtttgaagaaaaattttacaactaaacacggcctaagctttaattcgtgcacaatataaagtactagtactatgtattagtacataaattttgaaaagaagggtgtgtttagttcacgttaaaattaaaagttttattaaaattaaaatgatgtgatggaaaaattagaagtttgtgtgtagaaaagttttgatgtaatggaaaagttaaaagtttgaagaaaaagttgggactaaaccaggccgaagtagtacataaattatccggtctctagaatgctttacatcagcatctcgtgatccttaatgtgcgtaaagagggtgtcattaattaacaggtcgttcagctgatcatgctgaccaatttgatcaatgatcaatcgatgatgatgatgaagatagtatgtcacctgctaagtgacaaggatggatggcactgctggcaggaggacacgtcgcatgctagcttttaacatcgagagccccactctacaaaaacacctcgagatttgtagattaatcagagcacagttagcgttcattaaattatttgcagtgcaatgcatctgatacacgggtattgtaccgcctgttatgctcttcattgtccctggtaggccatggtgcggcaattcttttgttgcacgctttcatgtgtgtagatctatctgtttatctggagtatctcattggaatccctaaacaaaggtgtgatgcaggcaagtactaaaaatcacgagcataggttgtagacttgtagtagcacaaaatcgtagtggtataatataatttgatccatacataagagcaaacggcctttgtgttggtatatcagccgtagtctgcaaacactaacatgtggtcatggattcttccttccagattcagggggagtcaaatgcatcgtcagtaataagcaggacataggaaaacctggaaaatcttagtgcggacgtgcaaacggacgaaaaggatcgtgacagggcaacgggagatgatcagctatctagatactccaaccaccctgcatgcaggggagcttggaaacaagcctgcagcgaactaattctgcacaaataacaccaaaggaaagaacaccaaaggtcttgatctatagagttgatcacatcgacccagccaaataacaccaaaggaaaataatagtactacgcgagatgcatggattcagaaagggacaccaacccaaacccaatgattgatttcatcgtctcacagtccgatcgatcaatcgatccatgtagggatgaaccccacatggaactatcgaggacggtatggagtagcagcaaggccagtgccagcggctggcaagtcgatcgcaatgatttgctgctcgtacggccccgcccccctccatttgcattgcaccagacgaagatgagcattgaagtcgcgagatatggcgatcgatcgatccctctccttgcagcgcaggccaaccggtgtcaaacgtcccaatcgcacgagcccgagaggcaccgcccaagatggacgctgcgccagtgcggtgcacccatccgcatccgttccgcccccaccaatcgatcgacccgacatattggcgagtgcacatattggccgggacacggaacgaaggggccccggtgcgaaggagaagaagggaactaggggagcgaccgagcgaggaggcgttgtggcgcgcgacgccgacgcgcgcgcgcggccatgacggcattgaatgtgggacgggggagtgagctgtgatgagcaaggtgggccggcgcgcgcgagggggcgcgggtccccgaggcacgcaccggcgcatgcacgtgtccgcgcgttgcgccgtggggcgccacacgccaggtgctcccacaccgggtggcagggcccgcgccacaggtactggccctaaactaactttactctccgtgcaatgcaagatagatgtgctgccaatttgcacctgtatactactacctgtgtaatccaaacaagagtccaagacgcttggagcgagtttgaatttgttattggcctttgcgaatttgaatttatataaaaatatttagtccaaaaacgaaaatgacctatcaattcaagcatggcgcaagcgtggatctgaaatattttgaagtccggacaaacctcactataactagtactactatttaatataggaattctatttgaaaatttctaattatatgatattttaatggattatccctcgataagcccgggcatctgctcggggtggccggatggtaggattatcctacttcctcatataggagaatcatttacatctatggtagtattttctagtacatgtgagcaatttttacatgggatattttttatgttacatgtgatattttggtacataagagttactccatgtgctaatatagtaggagtatgtcggtcgtgaaaaaaaaaaggagttactccatctaagtagctaaaaaacggcattactgtttgcaagccacaggacgttggcactgacttttcaattttcactctccattcagttcaaaaaaattttcactctccataatgtactaccctgctgcacaagcaaaggaaatgaggccacagcaaatggttcgttaaacgagaaaatttaccctagaaagaaacaaataaacttattgaagtggcccacaacagtagtacgaaaaacaggcacagtacactatcttgtcctaactggccagattaccagaagaattctgtagtccgctgctctccctatcttgttgaacaccgtggttataccccttcaggacggacttcagaaccttgtatcgtaagctgatgctgcccaaagctcatggggggagtgaaaaatccaactcctactcgcgccactccgccactggcgcctggctagctgccgaacacagtatacaagaccacaccccctcccacccgtgcgggctctaccaatccacaccacaccaccctataaaaacgcccgcgatccacttgccacaccacggccaccaccaccaactcgatcgcacagcaaaaagcccatactgccaccgcgagcgccgggaagaacacaacagcttctcgagcaagccggaggtgcacgacgcagcaaatggcagcgggattccgccgacggctcaccgcgctcaccatccccaaggcatcgtcctacctccgccggacgaggcacaagaagttatcgtactcccgcgcccgccccgctagcctccccggccggttccacccggtcgtcaccggcctgcacgagtcggcgagtgctctcctcgggtggactgatgaggcgccggcgcaggctggcacgcagtggatcggcgaaggggtcggccacctggcgcggctcttggcgggcttgacggagctgctccaccacccgcaggcgcaggacccgctccggccgccgcgcaaggcggcgccgtggacggagcggctgctcgacgacctcctcctcctcgccgacgcgcacgggtgcttccgcgaggcgctcctggcgctcaagcagctcctcgccgaggcccacgccgcgctccgccgccgcgacgcgacccgcctcgccgccgcgctgcgcgcgcgccgccgctcggaccgcgacctctcccgcctcgcctccacattgcgtgacctctcctaccgctcctcttccgccgcagcgacgtccgactccggcgaggccgcgctagccgaggccgtcggggccgccacgtgcgcggcggcggccgcgtccgcctccttcttcgcgggcctcgcgtccgcctccgcctcctctgcctcgcggtcgttggcgtccccgaccgcagcctctcccgcaaaggtagcggtcgcgccggtgtggtgggtggccgacctcctgcggtggcggcggcgcacggtgtcggtcgctgcctgcgagtccggcgcaggcgcaaaggagacgccattg

SEQ ID NO: 10668 - DNA, 8731 bp, Oryza sativa
  unsure (1)..(8731): unsure at all n locations
aatgtctacacaacctcactttcatggattacctccaaattcagaggttgctttcctgattcttaagcgacaagcagcaaccatataaacttatgttaattagaccttgatttggatgcgagttaatgtcaattgctaaaataccaaatggtatctggattcagctgcaattttattcccgtctcatttttcagctatacgcagccatgcagggtttggctctgaactgaaagataaccgttaagctgagcatgtgaggcctctgctttttattcacatgcatttttcaatcgcaaagatgaatctttgttaaatcgcgtaagccgttcggtcggtttggcatcacatggaattgggtcaaggagttaatgtatcacgttggaatcgaacttaccaaattgtctttctatttaagctggcgtttaggtcctttgatgcaggctttgcggctgcattctatagttatgtcttttcagttatttttagcacttaatactaatatactgaaaggagcattgaacatttaactatgacattgtctcagtgcttaaagtagtagcagagtataatgtactagcttcggtttgcaaagaagaaacacaaatgcaggcaccgttcactgttcggaaacgcagaatcagttcctctttcatcttgttagatctttcagataagttgggtggttgtgaaggttaatgcacctaaagccagaatcaagatcgtcagtcaagagaagctgcacttttaagccggatctttactttgcaaccaaaccaatacagtgtacatgccccagctttagcgtgctcatcaaacctgtgcaacctataatttatctagctagaaggtcgcgatctaaactagaatcggaagcatgcacggatccgtataatttggcgcatctgaacactgaacttgcgtcggctctgtactgaaaatctgaaacccaacatctctaaagaactagtcatggttggtcactagttgtgttatcagaacttagaactagtacaattatttattttggtgactaattctccaatcattttgcaccacttagggtcgaaatggacaagctaacggatcggttgtgttgtccttcttcccaaagaaacaacaatgtcatcgctcgtttctgtcgtcgtgcatggaagcttggtgctactttcgttttcggtactattgggccccagcaagatgggcctggaagccccacttattggagcccactacgatccaatgaaccatcacgagatgcagggagattttctgcacgttgttagcgttagttcgaggacgtgacacggtgatcatttgggagttagtaggacggacaccggtgcctatctaatcggatcactcttaattttcgatgtgatcgttcaggcaaacaggacagctaaagatcggaaacgtatttcttatgtgattcgtactcaaccgtgtaagggggtaaagttttaacgtgttacatcagatatacagacacatattcgaaggattaaacgtagtctaataacaaaacaaattacagaatccgcttgtaaaccgcgagaagaatttgttaagccgaattaatccatcattagcaatgtttactgtagcactacattgtcaaatcatgattcaattagttttaaaagattcgtctcgcaatttacacgcaatctgtataactagttatttttttcgtctatatttaatacttcatacatgtatccaaacattcgatatgacatggtgtaaaattttatcaggggatctaaaaaaggcctaattcaactaactctcattttttttaattagcatattttaaaactactaaacggtatatttcgtgtaaaaaaatttctatataaaaggtacttaaaaattaaataatatattttttttaattagcatattttaaaactactaaacggtatatttcgtgtaaaaaaatttctatataaaaggtacttaaaaattaaataatatatttgtcaaaattttaataattaatagtcatttaattatatactaaccacttttttcgtttgtgagccgctaatcagcccaaattcatgtaccacaaagaacacattataattatttttttcattggtaggcaaggtatcaatcaagagtaaatcaattgtggtggctttatcaatttcaatatatcggttcggacatactcataaagataaggatgagcgcacgtgttgtgaacgtttgtatttgtgccaatggtatttttttaaaaaaggagaagaacacgccctttgctgctttgcataacttcgtgcagttttgagctaccaagaaaaggcccatgggctaaacctaccttgttagccgaagaggaacggaacccagaggtgacggcccacgaaacagaggagccagctgggacgacgccgatgatagtacaggtacagcacgatgtccgcagccgcaaggctggcggtacacagcacagctcagcgccaccgaggcaggggtcgtgtcgcgccgtccgactagcgctggcactgccagtctgccaccgcagcaggtacggcgcctcgtccggccatctggccaagttccccaccaccacccgtcttcacctgcacgctgcacgtacggccgcggcgtctctctctctcgcgcgcgcgccgtctcgtgtaaacctgataaacccacgagaccgagcttcaaccgcgctccggccttgcggcgtgcgtgtctcgtcgtggcgtggcgatgccgccgggggcggggggcaagtacgcggtgcagacggccgcaaaaacccgggggggggggggggggaacgcatgctgcgtgagcgaccgcgcggcgcggcgcgtcacgtcgctctcgccgtctcgcggaaacgtgtccaaccaaacgcacccaggggagggggaggggcacgcaatgatcgaaagcgcaaagcggcagcgaatcccgcgtgggatgagcacctggagccgcaactttttcgccttatttcttccggccaatgaagtagtactgtactactactattgtgcggcaggtgaagcatccatatgctaatctgtacttcgatgcatccgtgcgtgtgcgatcgatcgatggttcggttcatgtcgttatcatgataaccggattattcccctcttttctgctttaataatgattaacttgaattggtgctaaatgctaatcccgtgctcttccggtgtgtacgtatatgtatgtacgtagctagtaatgatttgggcatatgctttaataaggttttcgtgggaaaagaagaaaaaatggtatcgcaaatttcccaacttgtcttttgcacgggaatagtaatcgcgatggcgatggagaattggggatgctggtgtataaacattgcacatttttatactgataatgaccctatgagagtgacagcagctagccattatactattatctactagcactatccaacgatttcgttggcagttaacgcgatgtaatcttctgccacatcaggttattttatcctggtaagctgtcagtgcacgtgaggaggattatcttaactatgagttcgagaaaaatcttttgatggctctaaggcaggagaggagagctagacaatgcactggcgccgcagacgatgaattgataaacgaattacagtggcaccagcacagtagcacgtcataagtcatgtacttttagcagtaacaaaagctacatgtccccgttaagcagcagtaaattgtttggaactggctgagtgattagtaaacgacacggtgtcgtcgttgcccgggtgcgtgccagatcagccacaaaaaaaatggacagggtaagttgccaacttggccactttattgtcctctcttgctgttgtactggaaatgaaaaaataattatcaaatattaattaagggcaaattaaggatcaacagatatttggctcggctactcgtctgcctctgggcaaaaagcaggagcttttctttctcctttcattgttcgaaatgggaacggaagctaacagcatgcaactggataattccatcaaactgacgagtgatgactgatgactaacgactgagctgatcaggtcaagtgatgtcttgcgaggcagcgagggatctgaagaattctgatattctgttgactctgcattgagcactacattcaataattgctaaagtattctttgtataaacacaatgctagcctggatttctgaagaatgaagtctggataaaaaggaaaaaaatacgaccgagttgctccaatgagttaacactacttgaacccttggccaaaactgatttacatgtgattgaaccctcggccaaaacgagagctaatttattggagcatgcatttgcttggactaattcttactgtctgaaactctgactgtttcaccatattcattttctgtcagcactatatccagtagacactgtgcttgagtaattgagttcaagttcaactactttaataggaggtggagacagcgaatgactagtagtaagaaatacctaaacattggatttacccgttccaatttaggaggatactccaattttgagctgccacttgctacggcaaaagtcttctaccatgaattaatctacgggattgcttttccccgaaaaaggtctacgggatggcactgtttctgctgcttttcggctgccaagtgccaacacgtcgtaatcagttactgtagtgttacactaacaacagtttcataggactaaaacatcatcttcatccgtggaaatagtttcacgagaaaacgaatgtatgtttggatatggattatgagaggcaagactgaaaaatataaattaataggagattaagacgaaacggtacgtaggaagaatggatggtcaattggttgacatctacgattagaacttaattagattctaaaaggtgaaactttaaggttatttacttcgttgctacttttaaccatatcgaattaccttttcttgtcattattatcttatcaaagtttgacaattataaaatttccaattttataagctctatcataatcttggtaaatctttaaaccaaatacatccaacaccatcaaaattgaaaagtcatgtagcctagtggttgcagtaacctgagtagctacataggagtgaattttagattgggttatttgagcgctaatttctaacttaaaaaaggttgtatatatccggttggatttagaggccggataaaaatatcattctctaaaaaaaattaaagaaaatcaaaatttggcaacatcaaaacatactaaaatctgacattatcaagctttaatagggttaaaggtggcaacgaagtaaatgcacactaatttttccatcccatttagtcaaacatgttttgtgttcaaattactcgtaacaaatacttctcgtttttgggtagaaatacccttctctaaaaaaataaaaatcaaaatcaaaatttggcatcatcaaaacatactaaaatctgacattatcaagatttaatagggttaaaggtgacaacaaagtaaatgcacactaaattcttcatcccatttagtcaaacgtgtttcgtgttcaaattgctcgtaacaacttctcatttttcgttagtatactacccgaattgtcacgcgacatgttttatgtaaaaataatttctatacaaagagtgttttaaacgattataatatatatatatatatatatatatatatatatatataattttataatagttaatacttaattaataatatactaatgagtattctcgtttctaatctaccatcccaaactcacagatcaaccagcccttagggccacggtatcatcggcgaaaattaacatcggtgccctggtgggcactgatcaggaaatttagctttcgtgcctccaggtgcccgtgtgtcatgagactcgttgccgcggcgtggcagcgacatggtcgccgaattcacgggagcacggcgattttggcttcggatgcacgtcgacggtagcgacgcgcgtaaaccgcgcagggggtttcgcgtgactgtggctccgtacgtcgccacgacggacggatttattgtcctttcttttccctttcgaactcatcaaaaaaacaacaacaaccaaaaaaaaaaaaacgagagcacgagttaaaccgttgactcatggaccaaaatactagaggaacagagcaagtgtgggccaaagcatgacgtaacatcagaaattactccaaaccgttcgttttcagttttcactagtcgtttccgtatgctctgcttacaggttgatgccctcgaccatttcttatcaaaatttgacagagaaataaagtttgagctatggagcccatgactaataaccgaatcaagaaacgtaaaatagtttaggatgagacttttatatatgtgttattattggtttaaaaataatatagaaaatagacctgacgaaaaaactaaaataaaatccaaagttaggcctccaatttaaaattttgttgtctttagctaatatgtgggacaacctttctctagaaaaaaaaggtgaataacatactaaaaataattagaattggttgaaagaaaggaaacacataggtaaagggttatcatttcacatcatgtcctctccttctccaacactatgttttgaaaggcacatcaaagagaatcttagaacaccatcaaagcatctcaagcaatttatgtgtgtgttttctctgatttcagcttcaactaaactgttcaatatgaatcattgtaaggctcacacaaaacaattatgtcatatggttccatttattttcctatcattaaagcgttttgcgagttggatgaatgtttctatcgttgaattgaatatatggaacattttagaggagtttacctatgtatagttagtgttgtcgtggtgtaatttcaacgtgagagaaacaatgatttcaaagatatttaatacgaccaaacaaaaaatagacatccgagtaatcattgtagtatttcctttttttctgtgtgttgggaacgtactcatgggtgtgtgaatatagtgttatatatgtcggtgtagctacgcgtatgtctactgtataattgcaagaaaaaaattttaggatttcaacgaaaatttagtgagatcagatatgtatcattggttttcatttgtttggtgtgtcagaggcatactcgcgaggagagctgctaaacatacggtattatgtttactattgttttatgataaatgttctctcttagtgtttgttgacggttgcaagtttcggtcccacgctaaactacataagcagatggtccggcgttggatcgtactaagatcgtaataaaacatcgtatgtgcagtattttccacttgtgagtgtgaatgtagtgttatgttgtagtggtgcggactgcggaggaaataaaatttgttccaaaacgatgatgacgacatctccatttttgcttatcccctcgctagatttgccgagatgtgaacaggagacaaacaacatatcaccgtgcccacggcctagcctcaggccgtaccctgcactgcacacgcgcacgcacgcgcacacagcggcgtactccgtaggcgtaccgcggcagcgaaaaccgagacgaaacccaaacccccccattcgagcgagcaggtgtttgtacaaaggccgccgcgtcgaaagcaaccactcctcctactcgacctcgcgctcgctcgctcgccctacaggccaccgccgcaccagggggggcagcgagcgagcccgcaaggtagtcggcgacgaccaggagggggactgggatgggttgctgcgggtcgtcgctgcagcccgggacccacccggagaagccgccggggatggcggcgccgccgcagcgcccgtccttctccctgaaccagcaccaggcgccggggtcggcggcggcgcagggcgtgggaaaaggggaggtcccggcgttcgcggagttctcgctggcggagctccgtgccgccacgggcgggttcgccgcggagaacatcgtgtccgagagcggcgagaaggccccgaatttcgtgtacaggggccgcctccagcgcacccgccgcgcgatcgccgtcaagaagttccccaagatggcgtggcccgatcccaagcagttcgaggtacgccccgattcgggaagagcttgttgtgcctggagaattcgtctttgctgtcatcagtccgatagattaaggttatttgctttggttcgcaggaggaggccaagggggtggggaagctgcgccaccgccgcttggcgaacctcatcggctactgctgcgatggggacgagcggcttctcgtcgccgagttcatgcccaacgacaccctagccaagcacgtcttccattgtgagttattggaatatctttcttttgataagttcctttctgaatttctgatcaccaggagactttttttttccatatccgataaacactggtcgcaaaaagattggatttttctgccttgtagttcctgattagtgtggaagttggcaaaagaggacatattggtctgctttgagcaactgctggctcctaccggcttcctgcatttggtgtaccgaacgaatgattgggactgccctttgtcatatcttgttcttattcggttattgttggcaatgatcttgagtcagtcgaactgattatggcannnnnnnnnnnnnnnnnnnnnnnnnnnnnnnnnnnnnnnnnnnnnnnnnnnnnnnnnnnnnnnn

SEQ ID NO: 10669 - DNA, 722 bp, Oryza sativa
  unsure (1)..(722): unsure at all n locations
ggttttgtaaaggacaatggtacaattgttgaaaacccagttgcttctgaaaatgtgaaagtgccatctctctggaatgatatggatgagagccctgttgcatcttcgaacggtcacatcaaggctgagagacattacagagctggtgatcatgcagctgagagtgacttagggtatgattttggtgaggaatctgtaaggagccccagcagtgctggaagaagtgcatctgaaagtccatttgtgtcttcaaattttgcgatgcatgactcatctcccagcaaaaaggaaacctacaggtacaagttttcccattttggatagtgcacaattcttattctataatgtttgacttgctacctacatgatcactagaactgagatatgccaggcatagtttaattgaacagaatgggctgtatttacaaatttgaaacaagtcagcatgtttctctgcagtatagtgcggagccatctggtgccacaacatgggtccactttcagtatcctattctagtccacttgtaaatagttcatgtattgctctggctataagccttccatcttgcgaggctgtgacagttttctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10670 - DNA, 13273 bp, Oryza sativa
gtggaggatggaggaatcggccggagtggagtgcgccgagtggaggagccgattccgatcgaaggaaggatgtgatgggagtggcgccgcagcaccgccggcgtgggggacggagggaggaagaggagcggcggcgcaggctcgccggcgtggggaggcggagggagggaggggagcggctgcgcacgccggcgagcgctgtgaatagaggggaaaaacacagagagaggaagggagctgtgagtagctgcaagctgtaagccgtggcgtttcggacacattaagggcccatttgatttgtaggaaaaatgtaggaattttggaggatttcaatcctatggaaaaaaatcctatgaaggcctttgagacaaaggattgaatcctatccaatcctttaaaattcctatggaatgggtaatcctatgcacattttggaggaaagttagcaagatgtctaacctcttggaacatttcctctgagtctatctctctcatctgattcttgcgtttttcctgtggtccaatcaaacggccattcctgtgtttttcctgtgttttgtaatcctctgttttacaattgtattcctgtcagaatcctgtgtttttcctattactctgttttttcattcatacgattcaaagggaccctaaagctgtcccgtgaccgcccgcaccgccacgggatgccgtgcgatagattttctgttcgcaataaaaggcgaccttccgattctccactccaaaaccccaaccaaacccctctcgctctccccgccccctccgcatcccccgattcccccgccatggcttccggtgccctagcccgcctcctcctcgggcgccgggcggccgtcaccccttttctcgcgcgccccttcgccgcgaaggcccgcgcgtcgcgccggccgcaggagccggccttcccgtcggaggacgaggacgacttcctcggcggcgaggtggccgcgcccgcgcccaccgaaggcatcagcaagccgctcgccgaggtcctcagggagctcggtaagagggtccccgaggccctcgtcaagacgcgcgtcgaagatggcttctccctgaagtacatcccatggtgagcccgctcgatcactttcgatggcctatcgaaatcctcccttcctacacaccaacacagggatcggcttattttgggagatttccctgttagtttttaacgcgttgcgcgtatttgcggatttttgatgtggtttacattaatgtcctagattatacttgtagaatcgtgcttagcagctgaatgatgcttggacctaacacactacactgttctgcgaagtgtgaactacatgtaattgttggttcgttcgtgtaaaaatttgggattgattgatggagaggaaaaaatttggccacctgctgctttgagaggagctagattaaatataaaaaacttgaaggtcttgattcttgagagcaattcatcttctttttaattctcaatggtagcattatggtctcctttatatacatgtattcactaacaacttctccaataagaagggataaaacatacgatcttccttaaacaaccatatccacctagctaactttacaatcggtaatgccatgagcttcagcaaccataccattgtttgagttgggtaaatgacgctcatatagttgtatttgtgttttcacttctgatgacttttgcaggcacattgttaacaaaattctgaatatacatgctccaggtgagtttttttctggtcactactacattggctgtttacttatactcttgtagagggattagtttcaaagtgggccagaagttgagtgatcatatttgctgttttaattttagatttttgtatccattgcagaatggtctggcgaggttcgcagcattgtttattcatctgatggaaaatctgtatctgttatttatcgcgtgactctccatggaactgatgcagaggtacctattttccccaggaaatcatattttgtatagatgacaagctctctgcaactaaattactaaatgtcattccgaaactagaagatatggatgaattattgaatcccaggccttctagtatggtactattgacaatctgctgataaatttcaaactaagtatggctgccccctttttgatgcaggatttcttttgatgctgaactaggatttcatgccatagttcatcaaaatttactaggcatgctttgtgtcgtactgttatgtatggtttaggttatttagattcatatactgcattttctactattctcccatttgtaatcttccagtatgttactagttcttcaatcatggagtgcacatgctgatgcatataaatatactaatgaaattctattccaaatggtaaggcgaggatcctggagatcactcagcattcctttgttaaatacaaactcatctcaactcgaagcgttgaaatgctaggctttaacatactaacattacatagttctgtttaattaacatatggtagaactgacctatttgggatatatttctttcagatctacagagaagccactggaacttcttctgctgatgatacaggctatggagatcctgtgcagaaggctgaagcaatggcttttcgccgagcttgtgcccgtcttggtcttggacttcatctctatcatgaagatatgtcataaatgcttaatgtcaattgtctgcggtattaaactcttgcatgtctcatggtgcacagacccccttttgtgctggatacacttttcttgtgcatgttatgaacgtccagcatatgaagctaggtactttaggtggttgcgtagatcgctaaatgtaagctactaatgcaactactgttgaactattaccttattatgaaccagcctgctgttccaagatatatgtccctttttcgtatcaagaaattcctggttactgctggaattaaattatttcatatgaaattcctgcgattgaaaatatgcatatgctatttattccactgattcttatgggaatcggacttctattctttctgatctataacattcttttactatatatttcatttgcatgctcgctggaaggaaacatattgcatgttagcggttgttcccgtattaatggttttgcagggtgatcaggcaagtttttttgtacagttatgtttactatttgaatttcaatccaatagaattttttgatgacgcaactgttcttcaatatttatagcaccttcttttctcttgttaggtcaaatgatttatatgtacttacttgagtttgttctaagggatgctgagtcattctgacttccaaaatttccacgactgatgtagctaactagctatactaggcaataacttctgacaaaataacagtctaaactaaccttcatcagtattttgtatattacaaacaatctggttattgccatcttcgtatagaactggacatgcaaactgttggtttatatcgattgtagttggacctatgtgctgttttaccgtaataatttgagcaaattggttatttgtccacagcttaggtatgattcttaactcaggctccttttggaattgcgttggattatgataatatcatttggtgcaactgctttttagacatttccgcattttatgcttgacttctctctctctctctctctctctctctctatctttgttgcaaaagataatgttattattgtttcccaaaaatatggaactgatgggagagacatgactgttaaataacatatttcattctaaccttaattttataggtaaaacaaactgtagcgattataagttttcattcccacaacaactttaaacaataagcacaacaccacacagcatggaaactgcaaagcacgccttgagagtggcttggtactttgtagaaaatagcagcagctgaagtgatttctttaattgtaattggtgcatcactatctcactggataatttgagtttatttagctaaaatattactggatggtggttcaaatgaactgccttaactgagtgattttaacacatacttttcacatcagtaattcctgtttatttaaattctgatttctgagatgaaactaggtaaaagataaacgagcaagaaatttgcatcacggtaggtagattttacataacattatacaataaactacaacatcaggaatggatgtggcagaaatgcaggattgaatagtaaacagttctgcttgactgcttgtcctaaaagtgtcacagtactactttattattacaatcaccatgtccgataatagtacattaaaaagcattaaggcttctctctgtacacacagagagagggaagagaggtggggaaggagggaagggagcagaaaggagtgatcctggacctaaccatggtagtgacattggggaagcaatggacatctagatgagtggccgacccaagacaataaaatatatctatgggtccattggggttaatgaatgaaatacataggcagtgtctggcatttccaaagccttctttggggtaccatcactatgttagaaatgacaggaggtagcactaagtgccaaaaacaaacattagcactcctctgaacctgtctctgacaaggggcacaggctctccttagagccttaaccacctagatgcaagctataaactggaagataaaaaaggaatgttagttggagcacctaatagttgcttactaaaggttaaaagttggttacacaagttaacacgtggtgttagataagttgctgggggctaatttgcatgggaagaggttaaagactggttacatgtcaaattgatttcctctaggtaacagcaagactagaagattagggtctgctaaatggtttgtgcttcatccagaagcacatggcctatgctaaatacaatatagattccactgacgaaattttgaagtggcattcttgctcgatcagttgtttagatgtcacttttgtccaattggcctgtatcagcatgaaccctccctgggttaatgcttgattgttagggttacttttgcccatagccttctctgctagggttgaaattaatccatgaagtccttccttggactgttgttaaattggttggtttgtgcttctctgttagtacagccccatccatgggggcattaagctttgagcccatcctggggctgaagcttatctccaatcaccacatgaccatgtgggatatggagtgtgcacttttagctgatgagcatgaggtcaacaatagtgccttctggtgttagagatggatgcatggactcaacatgtgggaaataaaaatgagagtgacgatgagaaaggagaccatggttaggccaagggttgctctggagcagcagacacagcaaagtgcgagggaatgagccggtaaggatgagcagcctgagttggagtcggcaaagtaggagctgtgagagccatagtcatgcctgtttaatggggacacacactgtgaatgtattagtgtcactactgagcaagaaagaaataatgtaactatattatgagaaaatgatagctttcttagcaaacaagcgtgaaaaagtaaaccatactttgtatcattctcattacatgtccactagttaggattctttatgcactgactgattgacaaatgcgtaaaagacagctaatttgtccttagaaatgtactggggcagactgaaaagttccatattgaaatgcaaccttttgttagggttgaaatgcaacctagtaacagctgctggattgcttttcttgttttaatattcatgcaaagtaacctctgaattgcatttttgtcaagtgaagagaaaaaaaaatctaatgtacttttgaaagctctatattttacctaggaaactaggatcatgcctacacagaggatttgaattatgatggaggtgcatatacaagagagctagtaatacctgcttgggcttgaggactcgctgcaagagacaatggccctccatattgctgtgcaaaacctgttacagcagcagctgtagaagccacagttgagaagtgaaacatctgtgggtattgcaagttgtagccttgtccacttgcatagttggttgtagtgcttcctgattgcccaaactggaaatatggataaaaggggctgcttccagtcaccatgccagctgctgctgctgccgccgacgccgccgctccataaaatgggtattgagctcctccgtagatgttgtagtagttctaattaacagcacaaggagaagatagtcttgattccatgacgtttgttctttctgatataattctgtgatgtatgttaggaactctgttataattcagttcacattacattcaaaacatacctatatgcagcttgaatctgttaggtttgcaagagatgcattttagcatctgtaactttatgtaaaaagttgaattaagtgcttgcatattctgttaagttttcttgcttcttgttgaaatttactaatgaatttgaatcaagtgactctgatagtactatattaaggcggctaaggcgtaagtgcataaccgttagcaactgttaaagtaaaggcaacaatttggtttaattgtcattttaatattttggatatgccttttacagtacataaccaataatctaattctgggtatcacagtcactatgcagatgtacaatttacctacttttaaaaggtgttctgttgcattattctagaaaatatcctactatatccaaacaagtaacttattttgttttttcctcgctccaacactagtaaatggatggtgtcaaaatgcatggtttggaaattggaactgatagagagaggagggggagaagggggcaggctatagtcccgttattagagtggtatacctcaaatagttttttttttctagctcatgtaaactatcaaacagtattgaaataccaagtttctgtgcttcctatttgacttcatgaaaatcatgtgcctctgcaacagattacatgttagacagacacttgactgttcctgtcatatgcagtgcatcaatctgggacaaagctaaattggcgcactaactgcaaaaacctgtattctggactacatttaggtccatgcatcaaaggcccaataggtgacttaggtctttatggagccaaacagaggtatagctttgaatagaattgtggacccacgcatgtgctgtcactaagtttatttggctaacaaaggggtctagctgatgggaggatggacccagtgtttaacaggtttggtctggacaagctagggcccatgtcatgtgcgcctgtaccaggtaagatagaagctgctaggaccataaggcactatacttgatggaggctcaggatggataattgatgattttttttaatgcaggcatggacattgtttggactgggctcatctcatatgggacaactgtttgaggggggttggaaaacaacctcatatccattagcgaagctggactcagaaattcaacattataatacctgttacacgtgaagggaatggttttgaaaggatgcatggcttagggcctttcagcacaatagcacataatattgtcactgaacatggaggaagctaggcaggcgatggatattcttaagagctgctaactcatgccaactgacaggtaaaaactactggtaaaggaaaatctttatcagcctgtggtatttcaaatggttcaatgtattgaaattgctaggatttttggttttctagtagcaaaagtgattattttgatagcttttctttttgtatattcatgttattatatttatataggggtactggggtagtgctacacactaatgtttatttggtgtggggctgtgggcttgtattaactagttatgtgctttccattagtaacattttaatgggatctgtacatgatttacaagtttgagtgtttgacaagcatgctatgccagtttttaagtgacggtgcatgcaggatgtcagtttgtaagtaaaacctgtgtaggatttgctatgaagacagatttcatttagtacactagagtatggagacaaaccgtccaggttggcttgaaagctcgcggttgaagaggctaatatgcttagcatttctcaccttctttgggttactgtttgctatagcagtatagtatatgttcctgtagcagcatttaatttcgtgcaatgtcttgttttgctattagatgtttatgtgctactattttctatgcagcatgtatcatatcttgattgctattgcaaatgcatactacaaaactaatttctggtacacctataagcattgtcacaatggtatgttagcttaaaattgatatgcttaatatttgtccccgcacccacccccaacacacacagaaactgatctcagttaaataataagaacatcagcatcctattatattttttatccaactaatagtacttgctggatttgcaagaggaacttactgtgggataactgtagtctggagaatagggagagtacctgcagtagttaagggaaggagaagaaataatatcaattttgtatcaatcatggttatgaaatcatctactcgactaagcatctaatagcttgcgccagagggagagtagggcgtgcttgcagtctaagggagataacaagactgccctttcatgtgccactggatcagcatgcactgccagtgccagcctgccactgtgtgtgtgtgagagaggaggggttggggccttgggggtgcaagctaaaaagcttccatgccattcaccattgaccaaggcggcatgtcatgatgcacatgtcatgcatgtgataagccccccgtcatagttggtccttgggaactttaaggggggagagagagagagagagaacttacccatagacatggtaagggagaccttgtgggatagcataatgggggaaggtggcgtgagaaggaaaagctgcgcccagaccaccttggatccctgcctgctggctaaaggacttcatcaccctaaagctcctagcccctcctgtagcaacatcgtcaagaaaattagagcaaatttacccacattgccttgctagcattatctgcaaaaagacacttgaaagcagccttgcacttgttctgatgcaccactaatgagtttattcacagagatggtcaaaccattcttcggtcgctgaattgcaagacgacataatagaagtaaaagattctctgaatctgtcccgattaatttagggttaaggtttgatcctatagtttattatctgagcctaggatttataattagtatagcgcattatccgaaacaaggcacttatttcaaggataactaacatctttgtactgctaatgttgttcgtcctccttatctacttttccagtaactaaattccaagataatatcgtcaagactatggatttttttgctgctaggtaaaagggcagtcctgtcaaaatgtatgctctgtacttagtaaaaattagttagcactaagctaaaccaatgcatttaaaaggtcctcatctaacaaggcttagccaattagcaaagttaggcaaacttgatgtcgtgttctttaagctcttatttattctattggcaggaaggaacttttttgcgcataaaatcataacagctaagtttgcgatcatgaaactatatgtggaaatcatagaaaatgccagagttagtgcatctataatgattatcacttctctttttcaagagcttttggtgttgggctgttttcaactcataagaagttgtcatcgaaggctttcaagcaagctagctaactgtgtgttctatgttgcttttgttagctggtgagataatggcaaatgtctaaccatgctgtggggttggaggcctagatctctgaaccccaagggaagccagattacagttagcccttctcccgtcgatcaccggcgcgggatcaacgcaagccctcatcgccgcatccgggtcccggaaggtaacctacaatacgaatttgtggtgcataatttaataaaaattaagcattctttgcatattgcagcaaaccaaaaaggaaagaaaaaactcgtggactagaactgaaaggtttgcaaagtaaactgctgcaattaagtgcacgtaaaggaaagatagaactgtaaatgatcatacaaatccatagcccttggatctgccagtgttcttgtcagtgataacaactgcctccaggatctccccaaactgctcaaagtacttcctcatggtctccttctgggtctcccatgccagccctcctacaaacaccttggtgtaggttgtgtccccaaattgccctatcacactcggtggactcatgatactaacttcaactcagcagcaagaaatctagctcagaaaaggaacaagaaaaaccagcaactaaggatctgaatttagctaggacttgttaggggaagattaggagatggaagagaagagaagagaagagaagagaggagggaaagaaggagggaggcaggaaaagctaaaggttagaaggaaaagggggtaggagagaggggaagggagagtacagaagggcaatatatacaagtgtctgctataatgcaccactcttgtccttttggtccaaaccatgctcgtataataatactacacaccgggagacacacccaccccggccaaagcatcagtagaatgactcaactgtccttattggatgaacagtagttacagggtggcgttgagctgtccttgtctggatagtggcaaaaacggaacggagttagggagggattccgtcgggaattagggaacttaacagaatttcgtaagatgcaggccttgtgagcgtatcccgattttgtttgtttagattggaggtaggtcattatagataatcaagcgtaatcagtctagcgctgttcgtgctctgaatgcaattataacatagtagtttgattattatattctagcagaacagaggacataatggatttatggatgtactctcttgcgtaattggaggtttatggtggacagaatgggtttatgggcgcatcaacatatcttctggtcatacttggtacaatctaataccaagcagaatatgatgtgtagagatcattttgagtactgttttgcttcaaagtggtagataagcatgggttgaggaagtgggcagaaagagtttaaaggtaaaatcactgcaccactaatataggttattttgtgctatatttctaggtgagaataatttatgcctgataggactgcaattgcagataagttctattttataaagcccagggctttttttacctgaacaaatcctttgtgcaaatcttaggctagttgtttatccgagttatatctcatgccccatttccaacccatgttaaatatcctaattcctatctgagacgttttgccaacaattgtgaaggttatattacttcactcaataaatatatgctacattaaatgaactaatcagtagagcaatatagttagagattatcagcatcactctcactcgtgatcctaggctgctagccgctttgagttggagcaaagctgtggtggaggctttcttccttgtacatcaagcacgtagaaaaatatgccccaccaatggagggagagatatttgatgatgtgcactgcctggcaaactgagggaatgcatgatgtgccatcagatctgatctggagatggacggctggagttgccaccccaattggagtggttgggggagtactgaactgtttcgaggcttgacaaggacgcaggtgccaaagcttttgcctgtctctctagctcctcctaactctagatctctcttggcctgtaagccacctctgataacaacagcctcctccatcactttgtcatgtcccagacaacaacaatacaatctttggcgccccgtgtgtatgtacctatccatgcaatatcttgctgctgactaatagttgtccctttcttttcaagacgaaaataaagaatatgcggaaagtgtatatcatgtaacatgtgtctgcaactgcaaggttagatttattaacatagaaagcatatgttcgttcatacttgtgagtacaagtacttcaaacagtctgaagcacctttggaatctgacatggtagcgtaaatactaatataataaagtaggctagagtgggttctcatatataatagtgtctaagcgaggagactctccttagctttagatactcttgcatgagattaggagtacctgcaggagagattagtatattacagaaatccatgaagaaaagtgtaatgtgcataatccgagaacattcgcttaaattatatgaatatcagtgtgagggggctatcacctcgctttagctgactgaaaatggatgtctaatgtggaatttataatctcgtagtactagctggctagctgcaagtgcagtattcacatgaactagaaataagatgtatgttatgaatcattgaattacatatgctttgatattttatcacttttgtctctttcattccgatggatgttgtctactaatcatttggctacatgcttcattgcaaggggaatcttttttaacaaccaggggagtatttctctctggagaagggaggaatcttagcttggtccagtatacagcctgacgtttgtatcagactacagtatctgcgtcctagattaacttctccccaggccggctgtccttgttgactggtcgaggtggactgaccctggacaagggggtcttggctaattggacatgtgaagcactgaggcgtcagtccattggtgcctggtcctgtatgcaagtgatcactgttcacatccaattctgctcttccaccagcgcactaaagtttggaactttggatactctctagtctgaaccagaatccagaaaacttggtaagctgctggcacatctcgtagtacaattggtaagttctactgcacgatgtttgaattatgggattgaatgggggaattatcggctagctcaatcactcaccagtgatatactgtagtagggtttttctgccttcctttacatgatttccatcatgccgcatttggtacgtatgtatttcgagggattttcactaacaaatcaaccattttttttcaggaacagtagaatctttgaaaagaaaagcgcaactgctgcttatctttgaaaagaatagtagcacttagtagatctgttgtcagcgtgtcgtcttccgcccgatgaatatttgttgagacttgagaagggaacgtaaac

SEQ ID NO: 10671 - DNA, 65321 bp, Oryza sativa
  unsure (1)..(65321): unsure at all n locations
ccgtatggtttcgcttttgcatgctactccctccgtttcataatgtaaatcattctaacatttttcacgttcatatcgatattaatgaatctaaaaatatatatctatctagatttattaacatcattataaatgtataaaatgttaaaatgacttacattgtgaaacggaggaagtagtatatttcctgtaattcactgtaactattcttcggaaccttgctatacgtacgactactccattcaaccggtgtccgactgaaatggcacaacaccataccacgtaacggcgtaaggcttcgtatgatgttctgcatgttaccgacgccgtgtacttcgcagtcgttggaaagttggacgctcaggtcgcgtgtgtagcattttcattttctttgttactggtagatttggtcctgcagctcattttattaatattttttaggcaactaaaaagtcataataccttattaagtcacctagcacactagtagctaggagagttaacttctgccccattatcacatgaagctcttaagtcctactgttagcgcggacaatgttgttatggtttctaccgctataaaatcgaattaatttgcaagcatatataattcatagctatccctagaaattcatcttgcttgaatcaattcatattgttcctactagtttccatgattgctacaggagaggagattatacgggagagaagacggtggcacaactcataacacaagtgaggcagcttgggtcctaaaaaatgttgagagattttaaaagttaagatggctaccatgataatctagagataaccgcgtggttttatccgcgtggttttataaaccctgttagaaacttcagagccattatgataggtgtggatactgaggcagctcaatttgttatgctaaaagcaagctcatgaaccgagtcggaaaaccttagcgagctaaaagcctgattcaactcgactcgcaagttggcttgttaggtttattaatatatctattattattctttttttgccgagaaagaccgaatgaggccatccgagtatattaataataaataaagttacaaacaaaacacgataaaaactatcgaggtcggaagtgcaccaaggtacatgaccagatagccacgtgctaaccacacaaacacaaccaaccgaaggtggaatctagcaccgaaataacccctgctaagtgtgaccgaacgcggtcaggcttacgacaacaccaccaaaacgagactctaaaaacaatgctcccacgaaggtcacaacatcaaggatgtcaccatcatccatctaagaagatgtggttttcacctagagaaacatcaagggagaggggtatcataatttcaaatctataattttatcatatgcataaacataaataatagatattaactaataaagaattcattatatacaaaatagtctagatgtaattaaatgatcaagcactatttaagaatttcgagcagctcgctagattaaggttagttatttttctcaacttcaaactttaattttatcgttttccgttagtatgcttttcaaactgttaaatgatatgttatttaaaaaaaaatctatataaaagttattttaaaaaatcaaataaatatatttttcaagtttataattattaatacttaattaattatgtgctaataagttttctcgttttgcgtgagttaaaaatctctctctaaaaaggagatataatgcaaccaagtatagtttgacttgacgtattaagacttcgacttcaaattcgaggtgaaccaaatcagattagaatcctctacagttgaagtcacgtgactttcttactctaatgatctatgggctcacatgtcggtgataaagacatcgtgcatttaactgaagagtatcttaatctaatcagccccgttcgttagtccaacaaaagttggataaacttttgaatactcgtggcacgtttttcaaactaataaacggtgtgtttcgtgtaaaaactttctatataaaagctgctctaaaatataagattaaattatttttcaagtttctaataatcaaaacttaattaatcacacgttagtgccacctcattttacgtgaaacacttaatatttattttcatcttcaggagattcaaacaccaccacatgagtttcgtatttttgttcacatgtcacaagtttgcactcgctcgaacgtttcgacggtataaacaggggttaattggatcaatgccactgtaaatgtggcaaatcagaaaaatgcaactactatttatgttatcggccaggtaccactgaaaatttttaaaattagaaccatgccactcccgttactatttccgtcgttctctctcacgtcgtcatcctcctctctcacgatggcacggcgagggcaaggcgtcatcctccgaggacgaggcggttgccggcgaggacgtcgcgagcgcggggagcaggtgcggccgcggttgccgctggcgagtacggtcacgggaggtcgcggaggtcgcgggcgccgccggcgaggacgggagcggggagcaggccggacggcgaggcagtcgtcgtccccgagaagctccggtcgccgccgatccagctcctcctccatgacgagatccgagcagcaccaaatcctgtcgacggaccagtcgaggactgggctgtcttgggcatgggacagcactggactccccgtatggtcgagcaaggtgaacttgcaccgcgcgttcatgggaccatcaattctatcttgaagaatgagcaagaaggacatgctccatggtgagccagaagctgctatggtattggtaggtgatacgccagaggggagcgggcgtccgccgccgaggacggtcgcggggaggtcgcagaggttggggagcgggcgcggccgtcgccggcgaggacgggagctggcgcggctgcggccacggccggcgaggacggtcgcggggagcgggcatggccgccgccaacgacggcgcggacgcagccgctgtcgccgccgaggacggtcttggaggcgggtgcgggcgctccttccccatccgtcgccgtgctgcactcctctggcagaagagctcgtcctctcgccgctccttccccatctcgacgcctctcgccgctccttccccatccgccgccgtgctgctctcctccggcgccatgttgcccaaccgccgttgagaccaagatgaaaggtgaagacagagacggcaaaaattatgacagagaggacggaaatagtgacggagtggtatggttctaattttagaaaattacaatggcattaactcgatttcataaatagaagtgacatttttttatttgccatatttgtaatggcatgatccaattaaccctataaacagagggccgacgaattggggtaaaagtgggaatggggtaacggagatcggaacggacgcctttcaccctttccggctttccccactggttctacaggcatccgcgcggattcaaatcaaatccctcgtcgttacccattccagccttcccctctcaccttccccaatctccctgcggtagaaccctagaggaaccttctagaacccccgagcccccccccccccccctgcggcccccggcgaagccagcgagatgattctccggactccaccgcagcggaagcggcgggcggactccgacgtcgacgccgccgccgccaccgccaccacccggagccccgtttccgaccgccgcctcgtgctctacgaccggcccaccgccctcgtacccgctggcgtccccggggagcccatggatgacatggtctgcacgtaccactgccgtcagatggtgagatcgcttcgcccctatcttctactgctattgttgtcttagcccaatggtcggtggaagcatagcgtgtctagtaatttcggtgttactccagcctcgagctcccatttagctccaggtagtctcatatttgatatgcttagctcagttgattccacgcatgccacatcaaaaatgtagacaattatcgattgattgatcaatttgtaaggaaatagatggcgtggagcgaataattgtgtgtggctgttgcagtaagcgttattacatgccagtgtaccatattgatatatacatactggtgtgttcttttttcttgtatgtaattctcgtaggtgaaatcagaatttatggtggcattggacactgcagagaagcaagttcaggagtatcgagccacacttgatgatatggaggaacgattatccaagagtggtatgctgttcttttttcgcatgtgtaccttcttaagttcgatttgctatatccgttggtcaagatacatttatgtatcacttgaagcatgcacggagtttgggcctaccttcttcctagttgtgtttagtttgatttgccgggcgcagaaagtaggaaggacacgtagtattgaatcagattcactgctctaagcaatctactgttagaaataggtgttagcttattacattcgaagcaattgcatgcacatacttaaaggtaatcaataaacatttttttactgcttcagaggatgagagggcaacatgccaggacaaactgaattatgtcgagcaagaattggcagcaacaaaaggtcgggaaagtgcaatgcaagagcgattattaaaggaggtgggtgactttcaggaacgctactgtgatcaaatcaagaagataggggaacttgaggtatgcaaatctcctttggcacatgacctccatcccgtcacatagctggtgacttgcctttaatgtacaccccccatttcttttggttagttccttctgcaccactgaatatttgcaaaaggcctcattaactccctaataaagtgggtctggacgtacacacccactgggacattggcttgacacataagtgatgaggcaaacattcagctcctttttttaatcgtatatctgctcatctattggcatgactaatgaagatcttggtgctgcagacgcagctgaaaaaagagattgattctcgaattgctgctgaatcatcgtcagcatccgcaaaggagtcagtcaaggagttggaggggaatttgcagcgtttatctgaaaattcagaaagggagaagaaagcccttaagaagaagctttcatacttgcaagacgacacaaaattatccatttctaaactaaatgcggaggtctgtattgttgaactcttgtgcataatgatttattactagatattggcttatctgtttgaaaatgtctgatgatagcttgaaagaatgagactcagggcgctaaactctgaggacgaagcaaagttgctgaatgaacagttggggggcttaaaaaagcaactagatgaggtcagcttatctctaatttgcatgcttggcagctcatattttaatttgcatgcttatttttgtcaagcaatatttctgatctttccctgctaagaataggctatctcattagatcatctttctcatctattttactatttgtttgatatttttgttcaacatctatattgatttaatttgtttctggtccttgccagagtgttcgtgaaaataatgagatggagcacaggctattgaattgcagttctttatcttatgaacgtactccatcagacgatcagaagttgataaagcttttgcaagaggagctccggaattatgtgagcattataaatttgatatctcccagataggttcatagctgattctatctgactggttatttttcttgcttctttcatgcacttgtacaaactacaaaatgcttctttggatacacgtggctaaacagcgaaataccagctattgatgactggcagaatcttatgtaactaatcagtgtcttgccgatataagccttacatcgttattaccattacctgcttagtattattagatagcatagggccttcccattcatagtgcagggtaataacactgacagaatgtgtcatattaaagttctgcccacccacccccccctcgccccccgataccgcaacattattagcagtgactagttttttttcctcgagaacagcacttgctagtaattactgatgcaaaatttatgttttagttccaagggagttgtttttctatggccagctaccataaatgtagaatgttcaagctgtattgaaagctctaatcttcgcacaagtgcgctaggctgcttgttcttatattcttcttcttggattctagatacaatgctttcctgtagctgtcttaaaattggatattgtacaagtgctgcttaacttcgttcatcaagggaccctttctccatgcaatgcacttagttacccccttcccctccattcttcagctttaggcatatctgaagttttatttcttacctgtcattatattaggttgtctgaaatgaactattgtccaaaatgaatgcatttttacctgtatggttctgtgcatttaggaaaaagaagttgatgaagctagaaggttgaagtcttcccacacaaatgttgagttacttaaagaaaaaatattggaggaacaggggtgcagggagagagcagaaatggaattatctaagctgcaggaaattgaagctaaagcacagaagttggagcttgaattagcatcatgcacagcattgctcagcaacatacctgatgtatcttcttttggtgatatacctcaaaagatcgcagatttgcagaagtgcgtgtccattgttacaatttcaatttcatttgtctgctataggcgagcgctatcaattatctgtgcttctttctttctttatgtaaggtttatatggttattttgatttttaacaggcaagcattgacaaatttaaataaagttggtgaggtaacatcacagttgaaagaattaaaggttgcattggaatttgctgatcttagcaagcaacgggcagaaggtgaagcaacccttgccaaagagagggctgaaagtgctactagggagatcaagcggcttgaacttctggtactgttgtttattgctatttttataattactactgtgatgctagtttctactccccccctcagtgcaatgcaattctgtagatccacttgtggcaccatagcaagttcataatctgttcatgcaacgataactcttcctctgtacattctgtaattacattgataacttgttctttcataccccatgatttcatgctgtcattccatttgctgtttgttttctgaacagcttgctgccatcagtgaagaaagggatagattaagaaaggaccatgctgtgtcgaaatctagggatggagatgatgcatcatccaaggtttgtgatttttttaataaaattgacagttttgtgcctttatcattcttaatggaatgcacaatatttcttgtgaggtgacaatccagaatatggaatcggatctatctcgaatggaaaaggtagtaacagaactggagagcactatacgtgaccagagagaactaattagtcaacagcacactgagctcaatttgatgaatgaaaaattgagcattgaatcaagaaaagcaaaatcattggagcgagatggagatcaactacgctcacaggtggctttacttgagtcaaaggtaagggttaagatgaactattgaaatggtatctacatatgctcattctgttgtttagagtagtttcatttcgaaaaggcacccttacatctcatgtttatcatggtcccattttcttcatattgcttatatctgtctggaacatcataagtttggattaattgttccagtccgggcaacctttatttatttgtttatttgtaagcaaactatcaagaatttggctccatttatagagtgtactgagaaatgaagctttattccttttagtaaggtagcatgtctatctatcttctctcatgagctggtgtgaggctgtgaggtactggacagggatgcttctcctgcttctgtgagaaagcatgattgggaccattattttttttcagcttcaaatgaagcttggctgaatgtttttgtgcttaatttctgttgtgtttgttgtatgttgagagttaccgtttgctgctggtgcagtgatatattgttggagtctcaagtgaatgaatcttcttttttcaatagagttgtttttcacagttgtcagaaatgccactgtaaacaatactaacttagctgttgattaaaaccatgtttgtaccttgaatgttcttgttatgtttgacagctgggccatggagattactctgcctctagcacaaaagtactgcgtatggtaaatactcttgcagtggacaatgaagcaaagcagactatagaggcattgcaagctgaattgaagaaaacgaaagagaggctacaagcagttgaagaactaaaaggacaagctggtgagtggttttattcatcttttcgtccttgtgacagtgtccacattttttgttggaaccgtgtgatagagttactacctaaaggattgtaggctgtagcattcattaatcagttgtcacctactcagtttttttaattattcaacaatatctgataactcttttttttctagtcattgctccatagtctagcaagatgtgagaatcctcagatcttcaacgcttcatcaaactttaaatagaatatttattttactgcagatgttggaactgtggttgatgtgaatattgctgaaaagctagcacagcttaaaaatcaaattgcaaccctagagaaacgtgaagaaaggtacccactttgttatctgtatgttataagcttctgttcatactgatttgttagaaaatgaccttacagtttgtttgaaacagatataaggcagtatttgcagagaggatctcagttttccgaaaggcttgctgctcgctctttggttataaggtattattaatatgacacaacccatattacacagtggatcaaccctatctatctattactgctatttgtgcattctccacctctttttttttagagatgagggattcatgttagcatcttgcgaatcttacatagtgaatctgtatgcattagtatgccaagtcagtgttttgggatttcatccaatgtgaacctcttgaacccaaattaaaattgactctcgatcctggtgtttgaagctaaggatgaaagagtacatcagtatttgtgttgtggagtgtggacatggttagtttgatacttctcaatcatgctgtcttttggtttgaaaattttgattgccttcgattgttgcattggtcatgcctatttcagataaccgtgctcatcattttctagcttcaacatttcgtttgattttttctcatgcctttatgtttgatgtcaatactatttgacgtaaccttttcaattttatggttttagatagtgatgaatgatcagcaacagtcaaatgggatccctgtaacacgttttattctgcattctgtttacgcccaaagtgatgatgagaagcttgagtttgactacgaatctggaagcaccaatattgtggtaggattattaccttgctgaaattatcattcctataatttaacagggcattatttgatgttattaatgtatatacaggtcaatgactacacttctcaacatgaaattgctcagcaggtattcagcgtattggttgcatttgactgtatttcttttttctgatgcatggatgaaataactaaaaagtaatgttacagatgtgtataggaggaaagtgtggaaacatcgttatttattcttgtctaatatgactatttatttatgtcctctagttttgcatctaggttgtatgctgcacaaatgaatagtctggttggtgtcttagtgaattgcgttaggatgcaatagataaatcccagtggctagataggtgtacatttacttaacacatcacatttcatttaaggcatatctcttggggtgctcaggaaccagcaaccaagatgtttctaatgagaatgctgtacacattttctagacatcagattgtttgaagttggaacaaacatttgatctggacacccataccatgatggtcttacaacagcaaattacagaactgtttttaaatcttgtgttgggccacttggttttactgcttctgatgatgcaactatacattttcaggtagatattttcatacgaaagatgaattctatcccggccttcacagctaacctgacaatggaatccttcaacaaaagaagtatctgttgaagataaaagttcagtgagaattcatattgttggattttgtgagtatgctttcttcgagtcaccgaagattggaaaatgtatttcattttggaaacactctgggctcatgtctttccgatgcattatcacagcttctcgtagtaactggagatgtccaaattgttatgttgtggcagccctggaccgtggtcgagcaagctcctagatatagcaaggttccccccaccctttttcatatatactaaggtgcaattgatataccttgtggttttttatatgttttaacgatttgttcaaatgtcaaaagctgaggagcacggcgtgttactaattggacatgagtagagagttgatgccgggctgtcacatactcacatggattcacctctgttatgatttttgacaaagtatatatgaatgcgagcgttacttgtactgtggcctggactgaagcatgagcttttgtaaactgtagcgaactatcatatgtaactgagccatgtgaattgttaattaccgcaaaccagaattggttttcttaacatgctatcatcataacgtaatgcacgcaacgcgtagatcccagccgaaagcagttaacttaactttaccccgttcccctgcattttctgggctacaccgatccattcccctgcattttcggggctacaccgatccatgattggtacatagtacgccggtgaatccgacgtacaatcagcacacgtaaattcgttgtcatgcatggatgaactctcccaggtcaggtcccatgtctcacacgctcagcatgaggcgcctcacacgaaatggccgccccaaaccgaaccgaaccccgcgcggtgcaggcgcaggtggccgcggctggcagataaccagcgcgtttcgctcgcgcgccggcacataaatcgcgtcggcctccggctgcccgagagccgtacgtactacagaaatacaagtgctaacttagcttattagcggataatccccccagcgagcgagcgagcgaggctgctgctgcgaaatgatggtttgtgatttatcctgtcaattggttaagttgttgtgtttagttatttttgggtgaaataccgtatggatcagtggctaaagtgaatttcttgtagacactgtcgacgtcggagcggcagccgcagccggagaagaagccgccacggacgaggccgccgctgccaggcaaggccgtggccgcgctgtgcgtggcgagctttgtcgtgggcttgctgctcagcggccgggtggtggtgccgttgctacctccgggctcgtcgtcgccggcgagcaactacaagacgtccttctctactggctgcgagaacaaacgcgctgtaagttgcatatacacagagtccaaactgatctctaatttcaaacggttgcatgcatgacaactgagcttgcacgtacacaccctacttttttttttttttggaatccccaattgacaccctatatattttttgtgtcctggtcggctgatccaactctggaaaatctctcagaagctaggcgagagcaatccaacggacatcatgaacgaggtgtccaggactcaccacgcaatccagtaagcattttccttcgatcaaagcgaatcataacgtacgtatctcatgcgagcccaatggtgatcgaactgtgcgagctccctccggcctataggtccctggacaaggcggtgtcttctctggagatggagctcgccgtggagcgcgctcggagcagcgccgccgtcggcgccggcacggccgtctcatccctgggcccacagaaggccttcgtcgtgatcggcatcaacaccgccttcagcagcaagaagcgccgcgactccctccgcgacacctgggtccctagaggtcacaaaaacttacaacaatttttcagtgattcccaaaatgcattttttttattttaaaaaaagagattaggaggagaaacgtcactcaaaatatttttttaagaaaaaattatgagctgctgaggattaaatacggaatctcgaaattgaaataatacatcctctcatcactgcactatcaggtgcatctcccaaaatgttttgttttggggaaccagttccaagtatcgatgtgtatggttgtgcaggggataagctgaggaggctggagaaggagaaaggggatcgtgatccggttcgtgatcgggcggagcggctcggcggcggcgggcgacgggccgctggaccgcgcggtggacgcggaggacgccgagaacaaggacttcctgcggctggatcacgtggagggctaccacgagctgtcctccaagaccagggtctacttcaccaccgccgtcgccacctgggacgccgacttctacgtcaaggtcgacgacgacgtccacgtcaacctcggtaatgcaccatgcaaacacaaattaatacaccattattcatgctcgaataaataataatctcgatcttgttcgtgaatgaatgaacaaattttcgttgcagggatgctgacgagcaggctggccaagtacaggacacgaccgagggtgtacgtcggctgcatgaagtccggacctgttctgtcgcagaagtgagcaaatggagattaaaatcttgtgttttgtttgttggtagcctgatgcatggatgaatttgtcggtgttttgttgttgttcgttgttgcaggggagtgaagtaccacgagccggagtactggaagttcggggacgaggggaacaagtacttccgccacgccaccggccaaatctacgccgtttccaaggatctcgccgcctacatctccatcaaccagtacgtacgcttgatcctagcttgtgtgcttctgaaattgtgacgtgatatgctctgaatttttcttcttctaggccgatcctgcacaggttcgcaaacgaggacgtctccctcggcgcgtggctgatcgggctcgaggtcgagcacgtcgacgaccgcagcatgtgctgcgccacgccgccaggtcaatctcagctatcgattcttttcatgatcatcttcctagctagtggtactactccagatcagaatttttcagggttttttgttttgttttgaactttctttcgcatttttcactggcagattgcgagtggaagaagcgagctgggaacgtgtgcgtggcgtcgttcgattggtcgtgcagtggggtctgcaagtcagtggacaggatgaagcacatccacagggcctgcggcgaaggccagggagcagtctggagcgtcgctacgtgatgatcacatcatcagctttaatcgtagcattaatctttggttttatgatggtgcaaagcagctagcgggcgacgaggggactagtttaactgaatgatcgattgtttcagatgattaggaaacgagccacgtagaatggatgaacgtgcatgatggtggaaaatggaaatgcatgggtggtaactgtaaaagtgtaaaggctttagcatccaatttccagggggagttgggtcatgccatatgcttcacttattaatcacagctctttctgcatttttaagggctccttcagaacgcaagtttttttttatgattagttgaattcttatagtcaccctttatatagttcgtttacctttcaaaaagtgcagccgtgagatgtaatttctactctcaaactaaaaaaaggctgaaggatgcagaaggaactttcacatgaatcaaaatatattggtttttaactataaatctataatgaccgaataattataaggttagcttttaacaatatcaactaaaacagtcaactccctccatcccaaaattgctggtcatcccagaattgtagtggtaaattagcttaaggtgaaaattaccacgatgccccacattattactagttgcatgttgtcatttcaattaggggattaccacaaaaggcactagccacacaaggaatattttttaagtatagagttaactaaggacatgttcaatgcgtacccctggaccatgtccctgctcacgccgtcggtgcttgtcgtcaagccgtctcctagcagagggccacgaccccaatacaggggacgcggctctatgagctcctcggttgggggaccgggcgaggagtcgcactgggtcggccgtggctaggggaggagcctgtggacatcgctttctccccccatttttccccttctaccctcgccagccgccgaagagagagagagagacagagagtaccgccggcgccggcgaggtggaaggcgacgagtcaccgttctccccggcaacaacatcggcgcctgcccgccactgtctcctcgttgcggcgcggacggcaccgctccaacccgatctagccgcggagggccagatccacccacgacagcgccggatctgccgctccggccggtgacggtgcgagacggggaggtcagcgacggtgcaaggcagggaagatggcaatggcgcgacgggcagcgacgtgggaaagagagggagagagaggcggcgacggccgacaagtagcacgagagagaggggcaaatatgaaagagagtgagagatagagtgagagagacggatggaggtaggggtaggaggggaaaaaagtctatgtggcttcttgggttgggatacccgttgcgggctggagtatctccatcaagtggcatcaaattttaaagaacccattaggggtatcctccattggaagatgagttccccagagaatacccttagttagtgagagcactctagaggtggcttcggttgtatatgccctaagtagtgtcactagtacaagcgttactactccaatgccaaaacaaagcatggaaggacaaacgctaagaggtaaagcgttaagcaatctgggacggagggatcggagtaacatttaacctcctcctcaacaaacggttgtacttgtctagctaccaaccacatgagatatcttaaaatcttagtacatagggctttgttcgactgcaattaatttcattgttgcgcaaccaacacaaatagtgttgtgtctgcagctgcatgcagcggctgtatcggccagtcgaacaggccctatattacctttggatgtgcatccaactgttactactcatcttctccaatcagcaaagctattgcaggggggagtctagtacgtgaacgttcgtgggaggtgaatctggcgatccgttttgataggttagcctttcttcgtactaaatcacgtgcctaatcatgatttgcatatattttatcgtttttgttataatcaaatctgtgaatgcttcgtcctttttttttctctaagtttgtttagattggactcttttttttaagaaaatattcactaaaatttctaattgcagatataatttatatatagaaagtttttatatataaagtctatatatatataaagagtttaaatacataaaaatttatatacataaagtctctatatataaaccttttatatgaaaaatctatatatatataaaagggtatcagaaagtctacctgtgaaaagttttcaaaaaatagttaacataaaagtttccgttaataagagtaagaaaatctgaaaaacaatcggcttgaaaaaaagaaaaagaaaaaccagttctcgtaaaagaggaaagagagaaaataaaaagaaaacttaatcacgtaaaagtgtaaacagataaacaaatacgcgtgtgaagaaatatcgatcccccacctgttcgcgagatcggctatccgcgaacgttcgccaactagctctttcggtttttctccaactagttgtcatccaattgccgaataggatttgacgattatccgttttatcaccttacatgtaaaatcatctatggaatggctaaatgtacttaacaaatagcgaaactatatatttataattcctctgtttggttttgactttgagttgtcttacgatcaggggtggatctaagaagaactgatatgagggtatgaacaaaatataaaaaactatatccctatcttataatgaatgtatgatagaaaattttagtgataacttaatgggggctccaatggatacaagggacctacggatccgtcactgcttatgatcaccaatatatttgaataatctatttaacatcaaaggtgtacgattaggttcataatctaaaatacattactagtatcttacattcaaatctattcgcattcacattgtcgatgagtgatcctctctagcgggagatcgtgagacccccctttcgtgagttcggctgggggaagaagctcgcctctagaaatcgcgtatccgtccccaaggctcctagctagctcgcacacaaccaaattatacaggtttgggccgctatgaagcgtaataccctactcctgtgtataggatttagactgagagttacaagggttcctaaactcgggagaacactcttacttccctcatccacaagctcagattttctgagagtcgtcccctttctcggtgggcaaggtcctccttttatacctcaaggggacaccacatgcaccgcctctacctactcttctttcgggtggggacccaccctatcttgactggaactcgacccgtgccttcgcctggaagctaaaccacagcttgtccttgagcggggcccagcgccgtccctcgcctgacacgggggacagccctgtcattccctcattaatagatgaagacttgtggtggccaccgtccgaatgaccctccgatgggacgggtcatacatacctccactccgccggaagcagatgcgacgtgggagcattgttgtccgtccagtcacacgtgaccggcgtcaggccggtcacagaccggtcattcttgaccatcgcgcgtcagtttagcacgccgcacgtctgccccactgcattaaatgcgacagagggcagttggggcgctgcgcgcattaaaggaagttcagtctaggccccttcctcgctgctccccccgccaaacggcggctgggtgagggcctcggggcaaagcagtgcaagggcccgaggggcatgacgtggcaccccgaggccccgaccccccgtccgctcctgcggttcgcggaatgcggggacaggaccaggctgtagggacacgtgacaggatgggaaggtagattcccctcagttcgcatacccccgggcccatatctccgacagtagcccccggcaccacatcggacattggcctcctgaggtcggtctgacgtggtgcctcacgacttccaccaggtatatcggaattgtttcactaagtggatcaaaaatatttcactcgtttaaattgggtgttgtttcaccttatataaaaacatgtttcaacaaatagcgaaagaatgtttcagttcactgcaacattagatctatacatagcgaaacattgtgagtacactaggtgaaacatttttcggtggaacaaaaaataaaccaaattcccttaatagggggtttccaaaatatgtgggtttttttttgcaatggaatgtttcgttcactgcaacattagatctatacataacgaaacatttttcggtggaacagaaaataaactaaattcccttaatagaggattttcaaaatatgtaggttttttttgttgcaatagaatgtttagattatttcagttcactgcaacataagatctatacatagtgaaacattgcaagtacacttggtgaaacatcttttgtgaaaaaatgggatagataagtggatgggtccagataaggagaggtgagcgcacgtatggggggagggggagcgaccgatttttcccacctcccccggtcgcccgattataatccatttcctattaatatctacgtttatactgtatttctcgtaaaaaaatcattgggcagccagccgtccatagaagagggacaacgaacactacctaaaattgctagccgtctgattgagaatcagggggcaagatcggcatgacaagagagacagcgacccatcatcattagcacgcaattaatggttagatgatccgaacccggagttccagacgctgctgtcgtgtccttccaaccttgaggcatggccccaccaccacgtcactagtgacgacgacccaccccctttccttcctccctttaccagttttgcaatttcctccctcccctaagaacgaatacaataacagactataacctagctataaacacattctaaataaataaaaaaatagatagaagagccagtaagatcgctgcagcacatattacaagatacatagatgtatgataggtgggaccaaatattaattgtgtactactccctctattccataatataatacacaaccacttttcttaaatgttccataatataatacatgcatgcaagcatgcaattaactatgacatcttttttcattaaattatcttttttaaatcatccactctcatattatctaattctattggatacatgcattatatttatgaggatgatctaaactacaagatgataatcattatttcttgttctttaggttaagggtggttgtgccttatattttataatagagaaagtatatgtttctaggtacctatgatatgaattggctattagattaattaaatataatttgaagccaatagttgtttatactattaaacttgctctaaacccggtccagaaaagacggcatgaaatccctatcctgacggatcattatccccgggctgacggccacgtgtccctccaaatttaggcgggcgaggtggagggagaggagaggaggcgaagcggccggaaggaaaggaaagccgaaagtttttgttgctctcgattcgattgactggacgcccggctacggcctcccgcggtccccgcctcgcgttttggggagggcagtttcgcccatccgcgtgccccttgcttggttgtgtttccgtgtttccgtatttgcccctcagcgtccgtttgattcctctatgctctgctgctctgctctgatctgctgggatctgccgttctgctctgctttgccgcagccagagcagggttagtactggagtggagtggcgtgcagtgtgctactgtactgacagccagtgctatgagtaccattcattttcgtgccgtttcgttcctattcataatttaaatatatactataatgtatattcctaatactccatcctttctaaaataactcaacctagatggggtataatgaatctggattaccctttatccagatttgttgtaataggatgtgccagatctatttaaaatctcttatattataggacggatggagtactagatatgtaaaacatgtttgaaagagtttaaaactatgagaatatactggttgataattagattttgagaatctaaagaagttaagttttcccggttctggcttgtaatttatttcctaggttatacaactatatatttttagaatttgggtcacaccttgaattgttaatggagttgaagactatgtggaaatttatagtagctgctaaaaactttcccaaacaggtccgcgatactaatctcatggcttcggctttcaaattctaatactatggtatgtcacattttgtattatatttttttttactaaggtagagtttgataattgtgctactccctatactagggatataatacctctatctcacaatataacaatctaaattatgacgagaaactatataatataacgaatatgtactccctccgtcctataatataagggattttgaatttttggttgcactgtttgaccactcatcttattcaaaaaatttatgcaaatataaaaaacaaaaaatgtgcttaaattactttggataataaagtaagtcacaaataaaataaataataattctagctttttttaataagacgaatggtcaaacagtacaagtaaaaatcaaaatcgcttatattataggacggagggagtatattatattatactaaagagtagtatagtagtgagaaaaaaaaaagagtagtattggcttggggtgttgccacgtcatcacctggtggcccaacatagcattatctaaccggatctactactgtactggtggaatagttcaaaccgaggggaggggcattccgggaatttcggcgacacgaggacacgccgatttccccgcggaccctctcctccgaaaaccaggggcctgaaatgaccatcgtacccccaagcctttattccctcccatttctcccgctcactttccggaaagtaccccctcggcccgtcgaacccaacccaacccaaccacccacccaacaacgcttaaccctggttagcgctctgccacgaccctgacgagcccatcccgccgcgagccacctacacccgttccaccatacgccggaggctgaccggtgggcccggaattcattgcagagcgctggtgttcaaggacccggcgtacggggccaggcttcccctcgaaggaatcgaccccatcaccttcctcctctttatctcgtagccgccgccgccgcaaaccctaacccgagttccgatctggttcgacgacgacgacggcggcggcgagggaggaaggcagatctgaggagatccgacggcgggggagaagggggagatggtggtgaacagccggccgctgaagagggcgaggacgcgggtggaggccagggacttcgctgggttcccgccggcgggggacggcggggctgccgggacgttccgggaggcggtgagggggttcctcgcgaggtacgcgcggctgctgcctctcccctctatcttctcgccggcggccgccgcggcaccgccgcatctgttgacgtggagggtgtcgctgcgggtcggcgaggagggggacgaggagggcggcggcggcgccgtggagctcaacgtcgttgaggaggatgtgctccgatcgcgatctgtgtattgtgaccagtgcagagtcgtgggtgagtagctttcctctccttttatttttctttgtcttttctttttgggttttcttggaaaaacatttcccccgatggaaaatattattttattattttgcctttatttttttgtgtgatgattgctggataatgtctttcttatagagtattactttagttttttttagcgagttcggaatgcaacttttcttcgaaaaatgttacagaataaatgttgtgaatttttttttgggaaataacggggtgaaaggggcaaatgacgccgtgtctgtttccaacagcaatttctcttgaatcttctcgcccccttctgtgactgttagcctatgcaagtattgttggcctgttgcttttgatgtacaatttccacatttgattgctgtcacaatccttttgcaaaagagaagaaaaaaattcaatcctacagaagcagtgatgtaatcttgcgcgatgccatttgtttggttgcaggatggagtggtcacccggtctgtgggaagcggtaccatttcatcatcgagaacgacaacaaccaggtgtgcggcaagcgccacagctgctgcctccgctgcgggactcccacagtcgctggagaatcaaggtgggaagaacaagcaccgttagtttcagagaagataaatatagtcaactgtaacaccacgattggtttcgggcggaaggatgataatgtgcctagtttatttcatatcgtggtgtagttgtcgagttgttcttatcgtgcctagatgcaaagattaaacttgtgagagatttggtgatcgaatgatgctgccctatgctaattgtggttcgtgctaactttggatgcaatgttttccagatgcctcctatgcaactttgatatggatggcgaggagctggaggagtgcgggtacatgcatctggacgacaacacccacctgctgcacgctgtggtgcatgcaaatggttatggccaccttctgagggtaaatggccgtgaaggtggctcaagatgtctcacgggccgtgacataatgagtttctgggatcgcttgtgcaaggtgctacatgtgaggtataaattgatcgatatgttttggttcatgtgtcgttcctacaaaaagagggttattcagcatgccataaccctgaaaatttcactaacctcactgcaggaaagtaactgtcatggacatatccaagaagcatggaatggaatacaggcttctgcatgccatcacaagtggccatccttggtatggtgaatggggatacaagtttggcgctggtagctttgcactaacctcagatacttaccaagaggcagtggatacgctttccggtatacaactcgcgttgtacttctcacatcgccagcccattcggacccctctgcagaacacgattgctctgtactgggcactctctgatcgccagcttgtgactgttcgggacctcttccggttcataatgcacctgcttcatcaagcacgcaagaagaacgagacatcaaaacccacaactgatgaacacaaagaagttgcatctaatgtgctctgcaagtggacaaaggaagatattgatcgggcagaaactgcaatgctcaaggtcctacgggttgttcagcctggacagtgggtatcatggcgtgcacttcggggagctgcatcgaaggctgttgattcacaggagctacttgactattctcttcgaggactgggtggaaaactgatggacgatggccatttcatagctgtccgctgcaatgctgagacgagtgcaattgaatacaggtgagccctatgttcagaatgttgctcctatttggctaactttgttataaactatcatgaccctcctcctatatctgctgacaagcaggctggaagataactccaaccagtcagttgatgcggctgcgtttgggccttctgttgatcatcttctgcacgatctgaagttcctctataacgctttgctgaacccagaaaccatgttggcttcacagccagaggttataggtgcatcatcacacagtgcagcagcaaagattctcgactgcaagcagttcatcaaacattacgatcagcacaccccacgggctcctttgaacccattcctactttctgtgaggtgttccattgaacttcttgatcacccaaaagactacactgcaccaccggtggaactagtgcttttaccagcaagtgctacccttgctgaactgaaaatacaggctacaagggcctttcaagaaacatacctcatgttccaaagctaccaggttgaacagctccctgacttcccaaattttagtgacacaaccctcgtgaagcatgtgcttggctcaagccagctcgtgagggtaagaggaaggtgcactggggataaccgaagaattgtgcaattcaggatggaaagggggttggagaactggacggtcgactgcacctgtggagccaaggacgatgatggcgagaggatgcttgcatgtgatgtttgtggagtttggcaacacaccaggtgttcagggattagtgattttgatgatgtccctgagaagttcatctgcaggaagtgtgctagtccacgcagagaaangggtcgtgtgggtgnaggtgcaatgtggggtagcagaatgaatgtgagcgctgcaggnaggtgcnaagnattagatagantcatctgttgncggtgcaggcaattttgggcgcatggcacntgttgnatgactgtacataatgtgtgaaatgtaaatactganggaagagtggggagtagcacctgaggcctgtgtgaaccttcatggaatcttgtctttctgaccagtgatatgatgttaatctatcctccttggaagcaatcctttctcagaattgttcagcacgctcaattctgcatgcacaatcaagtatttttgccaagcttttaagttagaaatataacacaagtcaacaaaacgtacgtaatgatggatcaatatgagaatatatgtcagtgacaaaactaggcttctgggcgttacatttcctctagaatattgctatcaggatatatgcaaatgcagaaatggctaacagtaagcagatgaacaagcagcatcgcaaaaaagggataggaatgatctattatcacttgaagattatactaaacgagtagagcttccgaacgcacctgcaatacaaaaatgaggaaggcttagtagcacatgtttgttagggtagtttgctaaagacttactgcaaaattttcataacatgattgttaggcagttaactggtcaaaactggcttgcaaattttctttacccattcaagtgcagcataaagagggtgggatgaaagatgacaatcttgaaatgaataataagatatctaacgaacactcattaaattcttccaggcttccatgtcgtggctttacactatgaaaggcagccatatagtagaaagtggtgtcctgcaattttaacacagaagttccgttgatcagatcaactagatgcagcataagggagggcaggatacatcgagcatgaaacatttaataagagtcatgaaaggtgaacccttttccaggtaacaattgggatgttaaattcgagaaaactacttatggtgaacaagagcaacctttagtagttcgaaattcaacagagccagtgatgttagtcctagttcaaggcatccgatgtacacattttttttgtgttagaaatatggattcgcagcaccagtctgcaatgtttgcaaacctaatgctggtttgtataacttattccagtaagctggtaagtgatggacatatctaaaacatatttcagttagcactaccgtaattacccatgcacccatgcgttcgatactaaagaattgctgagctagttagtggcacgaaaaacaaagcatgtgattagcacataattaatcaagtcttaactatcataacttgaaaaataaatttatcttgttttttcaaaaattatatatatatatatatatatatatatatatatataattttttgcacgaaacagataatttggcacttcaggtagtgtgcccatgataactgatgaagtagcctagcctgtatgctagaaagaacgcaacctaaaatgtctaaaagcataggatgttacaattctgcaagagtaaggtgactttgtgattcattctttctcagtgttaggtccttactgcataaaacagtgatattatgcatatactacagcactttgcacactcctagtcctatatcttaaacataaagaaaagtagagctaacgagtgtagggagcagtgtacataagaataggccaaaaggcattcaggcctaaaccctattgaaccaagaatgtgtaatcaatcacactcagaattgtcaccagctatttatctaaaattatcacccaaacatgatagaatatgttcacattgagttacggatagatcattgaccgctaatttcaccagttatccattaggttgagcaaggtaacagaataatggcacagatgcataatatgatgttacaaggagtatatgacattttatacatggaactttcaaaagcgactatcacttatttgcagtttatgaggcttaataaaagcaaggatctttgataaccagttaggattataaactaagttgattaacctgtattgggaatttggcatgccaattttcacttcagcattgtccatcaaattcctaggaaggatttatgaactctacttagcacaactagcattttagttaaacagagagtcaatgggttaaatacagaagtttttcagtgttaggtctttatccctaggtatgatctatgactccacttgtttactaccagacacttctataattatcatgatcacacaattgctcttcacccgttgagccatgaatgaaaaaccttagacaaggttagattgccaaataagaccatattaactacatcaagcattgagagatttttaaaccaatgaataccaaactcaaaccctgtgaattaacacttgatcaaactactaccacattattcaataagatgtggtctgacatagcaatacaaggatctcaaaactaccaaaacaagcaggttcaccaaaaaatgaatacagattacctgaacagagctgctgcctgctggccttacacctaacaagtaacgagaatatgaggcatcacctttccagcacctatcttagcacataagacacgaaagtagaaaggtttagatcctaagaaaatatgaaccatgtaaaataaatgtaatcacgatttaagtatacagactagtataagaacttctaatccagccaaagtataaactgtataatcatcaatcaagtatgcaataccgatccaacaagcatcaaatcccatagtttgatcagaaaaacaaaattttgaactctaggccaaaatgtgctgctaaataacgctcatttgattaattgaagcaccataaattcaatacgcagaaatcagagggaacccagaggtagactgccaaactgagtgcagtataaacaaattcagctctgacgactaatcgcaaaatggaccgaggtaccaagcaaaaaatctagccacaacgaagcaccagtaacgtaaaaatcacgtaagcatcagagaatttgaaagatcagacgttctagccacgccgccaatcggaatcccagcgaacggagccagccaaatgcatgatatcagcacaaaccaaaacagaaacaatcgcgcattggatccgaacaaatcatggaaccctcgacttacttactatgccctagccacaggacgcaaatagagaggggaaaacatgggttacgcttaaaccagttcatgaggtcaatacataagtcgtagcgcaaatccaaaccgcgaacaaaccctaacacggatcgaaacgaagcattaagcgcgaataagatgaattcccaatccgcagcgcaaagtccaatcgcagcgaacacaggggagacacccaaatttccacaagcgcacaaccctataacaactaaaaaaaagcgacaaatcgaagtcaaatcaaacgcgaattcgcaaccccatcaccgaaaaatgctagagggggagggcggctacgctcaagcatagcacgactcaaatgatcgaacaaacgaagcgcgccgagcaaacccaaaattccgaccccaatcgagcatcccagcccaaaaatcccaaaccctaagcagcaccatctccaccgcatcaacaaccagaaacgcgaaagcacagaacccctaacccaccaatcagagcacataatcaccaaacgaaccaaaaacctaaccaccgacctggccgcaatgttgcgagctcgaagcaggcagctgaacaaaccaaaaaaaatcccccccaccgccacgggctccgcatcgcgcgccccccagcagcttcatcggatcgagcgaggcgtgggaggcacgccccctccgcgaggcggaaagcacccgggaggatggcgtcgctcatccgcctctcctcgcggtggagataccagcagctcgaggaggggggaaggagcggtgcgaagagagaggagagaagagagggggagaagggggcgaaggaaagggggtcgcgcggtcgcggcgaaccgaaccgcggtttggcgactcggatgcaagccgcgggcacgcacaccggtaggtattgtggttagggttctcgcgtggcggccgtgtggctgcgccgtggggcccgcaggtatctctctcttcttctctttttttttttgcccttttaccgcgcccttttcggtgccctggactggtcagcgccgactcgcgtcagagtccgtcccgggttgcgcaacgcaaaaaggccaggctttgtgtgactcgtcaacgcgagcggctacgatttcacatttcgctagctgaaacacggggcgttatcttcccacatttgggtggtcgttacgcatcgttgtaaaggaatggagttttgcctcttccgtagcctgcacagtgcatgtacgcatggcaaacgcaatgcgtagttgctataacttggtagcgtgttttattcgtgcatgcatgcgaagaacggaacaagtcaataataatggctttccacccggccgggggcaaagaactgaataaccatctggttcgattcatcgtgtgtactgtactgcatccaagcgtcaggagagttcttcagccttaccgtgaagtgtagtaactcatctcaattctcaacagcattactactgtactagtatctctccacagatgagtccatcttatcctgaacttctgcaatcttgggctcttctgttctgctctttgcaaacgacgattttttgccatggggaagaagggagcggccaaggagccgcgcgcacgggcgtgctgttttcagggaccatggcgcgagaatgaggacatgtgccggtggggaattctcctcactctgcaatctgcatccacccttgctgaaaagtggaaaaaaaaaaggcatcacctttttgccgcttatatatctcatcagtgcccggtgaatcacaagcttgtcatagaaaattagaaatatagtacaaatttgcaattcgtgctctctaggtctcgttaagcttgtatagcacctagatcgagtaactgagtagtaggttctccaggtacagggaaagatggcaaattgcctgcttcgtgatggtcgctctcgaccacggcgttctttctctctggtctcatttgcaatcttgtctacccaacaaatagcttagatgtgatgtttacttttgctttaacttttggaaatgctgagtgcatgtatagtagctagtgcagtacttatgataatggtgtctgttttgacatgtcgccactgttattgctttcagaagcagtgtcgttttcatcacgtgtcaggttcaagagcggagcccccacccactggaatcaattgtgagctgataattttccttcagcgactgtcctttgtaggagtaagatcagagaacagccaccagctactgcagggcctgggtcacgttcaaaagcgctaggtgccaactagctagcttagaacaggtgacgcggtgaagaatcaaaagtgatgaagcggaaacatcactataagcaagtcagatccaaaattgctcggtgctcactcatgcagtattgctgtcaatacgatgtttctttgtttcttcctcctcctttctctcctttcccttgctatgaacacaagcaatacgttttatcttgagttcacctgcgttccaatttgcacccccacacttgtctttcttgcctatgctaacgtgttggaatcgtaatgtcatatcttgcggaattataatacttctgtagaacaagtgttgatgaggcatggcctttaactgagtgcatatacatggttagcaaacaggtctgattatttcatgtttcgatcttaattgttcaacacagatgtactacctctgtcccaaaataagtacagccatagatatccgtgtttaacgttttaaccgtccatcttatttgaaatttttatgattttttttttaaaaatagtcacacgtaaagtaatactcatgttttatcatggaataacaataaaaatactaatcataattttttttaaataagacgaacggtcaaacgttagatatgaaccgtgctaaaactgtatttattttgggactggtggagtactaaatcaccgtgccaatcacgaaactacctttgtttgtctgcaaaaggacatgatatgggcttacacgagtttacatgctgtaattattttcctgtcgaactggcgaattgcaatttaataacgagcatttaacaggtctggaaccactgcacatctcatcaagagagagcagagtgtatatatatatacatggaacgcaaaccgtcagtgccagctcttgctctcctcgtcctcttctccttcgctaggggcctagggctgatcttgacgccgacttgctgagcggccgactccggcgaggcaaccctgccaaggtcaccgacactcgtccgagctttcatttcatttgccggtaggtgacaaccatcactctgttcgggccagagagcctcgcgttcgacggcggccgcagtgggcccgtacacccagcgtctccgacgagtcgtattatcctcaagtggggcggcgtcgtcgccggctggaccacctccgcttacagcggcaactaccggtgtacgtgcttccgctccaatacgtgcgtacgaacagacaggtcannnnnnnnnnnnnnnnnnnnnnntgaactccgtgctggtcctccaagaacccagtatgcaacttgtaacggagagcatgtgcaggaggcctctggcccttcggtcccatttgaaatccggcgacctctacatcgccgattcgtatgccgttcatgctcgtcaatggcgtcgtcgacggtcgacatcgaccaggtcactaccgcgatgtctacttcacaaacagcagcagcacacggagtatctaatttgatttgattcgtagggttgtatgtcagttagtcgtcgaaagtaacgcgtacgtgcattgaacacgagcgatcacgacggggcggctactgaagtttcgaatgggacttggaggctgtacagagcaacggagacacggagtatgtctcttgttaattttatcactgtaaaatgtgtggcatgactaagggtgagtttgaggaggaggagattgagaagatacgcaaaacgaggtgagccattagcgcatgattaattgagtattaactattttaaatttgaaaaatagattaatatgaatttttaaagcaacattcctatagaaaatttttgcaaaaaatacatcgtttagtagtttaggaagcgtacgcgcggaaatcgaaacaaactcactcactttctttagctgccgaacgcagcctaaatgtttacataagaaaacctctcacgcttgacctgaggaatgaaaatgatcatatcattcctcgcaccattttactgtgcagttaattcaagagtggaaaaccatggaagagttaggccaatgttggctactccagtttgaaattagttgacgttttagctcttgaagcattgtgtgatatttcttgacgttttagcttttttgttgcatcttggacctgcttgcccatgcatgcatgcagccggccattactactcccattatttccaacgtcatgcatgctttgccttctcgtttcctgttcaaccattgctctcccacgcgctgagtaatttccttcttctatgcctgcttgttggctctttgccttctactcgcctccttgtactacattcgccattttcgccatggagcaggtcatggcttcatgttcaagttcatgttaaacagatggagtatgtagggagttggagcgtcaaactagctagtattgcacagcataaatagatggagatggcaaaggggattctgctgcaaaccagcgccaaaatttgagttattggcggcaaacgcacttggcaaaatttttgttagcagcgcgcgagtgaaaaatctttcccggcgactgcgcgcatgaacgcctgaaaaaaagtgcatgcatgccaacagtcacgcgtccacagtgccatgcaaaaaaatgtggccaccaagaatcgaactcaggactggtagcttcacttttgcatgagatggccactcaaaccaagagcaggttatgatttggtatgcctcaaaaccatatttattaggggtaaaacaggaagtaggcatactaattaatcactcattggtatgtgtaatcctgtctaaaacgtcaacaagtatgggctaaataagctttagtcactcctatccttacaagtgaggccttctttgtttgccaaggcccatcctaacgggacaggaaatttgggctaaaattgacccatttgtaaagatgggccaggatttctgccttcagaaaaaggaataaggttaccggaggtccctcaacttaacaacgagattttttgagatcccttaactacaaaatcataaatgtgtacccctaaactttctcaaaccgttcaccggaggtccctcggcagtatttttgcccggttttgctgacgtggcatcctagtcagcaaaaaaaaattaaaaaattgcgtggggcccacatgtcagctgcacatcttttttttttctcttttgttcttctcctcttctctcttctctcttcagcgagtgcggcagtcacaggcggagcggcgtgatggggttctcctccgtggaggtgacgagcacggccgcggctgtgacggcaggttcccagacccggagccagcgcgttcagccggagcagcggctgctacaccgacgccgcattctccggcgcgcgctcctcgccaccgcccagatgctgctgctgcgcctgcgtcgttgttgggctcaccgtcagcttctccttgatcgctcccgtcaataaaaatgtggacatcattattgattgctaggagcactacgtgcttgcagacggcgaacgacacgacggcgccggcgaagcccgccggggccgggccgcagctgaagctgctggtggacaagcgctcgcgtcgcgtgctttacgcgaaggcgcgcaaggacgcggtggacttcctcatcggcctcctccgcgttcgtctcgttcgtcgaggccgacgccgacatctcgctggaggagttcggtgactcgctgtgcccgccgatcccttgcaccggcgaactcttgaccctgccggatagcaacttcgccgtcgtcaccgaccggccactactctacgtgcaggtacgtacgtcgtcataaaacttgaataaactttgcaaattttgcaccatttgtattgtacgtgatttacgtgttcatgatgccatgcatgtaggtgacgaggctgaggtgtggcggcttcgtgttcagcacccagatctgccacaacctcgtcgacgcggcggggatcacgcaattcttgcaggccgtcggtgagctcgtggaaggcgcggagcgtccggccggtgtgagtgagggagcccctcgacacgcgccacccaccgtgtccggcgtacgaccaccccgagtacgagccggtgtccgatgaggccagcgacaagctccgtccaggcgatgagctcgttcaccgcaggttcctctccggccccgacgacgtcgccgcgttgcgcgaccagctccccacgcgcctcagccccggtgctcgcgtttccttctcctcgagtccccgggcccagaccgccgcctacagccgccgacgccgcccttccgcttgctccggccgcgggccgccgcccgctgccgctcgcctgccgcttgccaccgctgcagtcgcgctctcccactgaccgccgcccctccacctgctccagccgcgctcgcccgctacttgccgcgtcggcgtcggcaaccgctggctccgggtctgggaaccttctgtcgccactgcggccgtgctcgtcgcctccacggaggagaaccccgtcacgccgctccgtctgtggctgccacgcttgctgaagagagaatcagagaagagagtacagaaggagaagaaaagaaaagggaaaaaaagtgcagctgacatgtgggccccacgtaattttttattttttttctgactaggatgccacgtcagcaaaaccaagcaaaaatactgccaagagaccttcggtgaatggtttgagagagtttagggggtacacatttctggttttctagttaagggaccttagaaaatctcgctgttcagttgagggacctccggtgaccctattcctcagaaaaatgcttaattttggggaaacatgttttgatcaaggtttagcatcttaaatagcctacctaaattaggctctccaaacatctccacctcttcgatctctgctattataaaaactagcatggtggcccgcgcagattgcgcggctagcataattatattttctctcatataatagcatatatgttttctcattatattattaaaatatattacaatgacaacataattttaaattttgcaataactttacgaaactactaatgtgtaatattcatattgtattttatatacgtgttagttattaattatttttaatatcaaattttagttatttataaattatatatattcctatatggactctagactcgtcttttaatatttctttttttaattctgaacttttattatttctaattgtatttctatgtggactctaaactcatctttcaatattctttaatttttaatttcaaatttcagttacttctaaattgtattcctatattgactttaaactcttctttcttcttcctatgtttttcttaatttcgaattttagttatttgtaaattgtatttttatacggactctaaactctacttttaattttatcacgtttattctgaattttagttagtttcaaattcctatatggactctataatctacttctaatattcattattttttaatttcaaatttctatttttttcgtaattgtatttctatatggactctacttctaatatttcttatttttaattctgaatttcaactatttctaaattgtatttctatatggagtctagtctcatcttctaatgtttcttatattttaattccgaatttcagctattgctaaattgtatttctatatgtactctgcttttttctttttctccaattaatgtgagaatttcttgatcatgagagcgaacgcggaggctcctttttattccaaattttagttagtttttaaattcctatatggactctatactctacttctaatattccttatttttttaattccgaatttctatttttttcttaattgtatttctatatggactctatactctacttctaatattccctgtttttaattccgaatttctattatttcctaattgtatttctacatgtactctatactctacttctaatattccttatttttaattccgaatttcagttatttcctaattgtatttctatatggactctagtctcctcttctaatattccttattttttaattgcgaattccagctatttcataattgtatttctatatggactctagtctcctcttctaatattccttattttttaattccgaatttcagatatttcctaattgtatttctatatggactctatactctacttctaatattccttatttttaattacaactttaagttatttcctaattgtatttctatatggactctagtctcctcttctaaattctttattttttaattccgaattttaactatttctaaattgtatttctatatggactctagtctcctcttctaatattcattattttttaattctgaatttcagctatttctaaatgtatttctatatggactctgctttttctttttctccgattaatgtgagaatttctaggccatgagagcgaacgtggaggctcctttttctattcctttaataatataataatagattgaagatgtttccgctaatactttggtatgttgttcgtatttgagtctgtttttaagtccgtttactattggaaatatataaagagtcgtatacgaaattattttagaaacttgcatattaacttgggacgagagatggactcctaattgcttcaaaatccatgccagaccataagaaaacaacatacagggtatggccatcatccccataaaagttccaaattagatattgtcgagggaagatcctcgatagcggggaatcatgagaccccctatcgtgagttcggccgggggcagaggctcgcttcttggaaatcactcgctcgtccctaagattaccggcaagctcgcacgccgtcggattatacaggttcgggccgttatggagcgtaacaccctactcctgtgtttgggattatggatgagttttacagaggtttcttcactccagagagcgcactcgctttctttcttctggagttcaggttttctgggagtcgtccccttatctcagtgggcagggtcctccttttatagctcaaggggataccacatgcgccgcctctacctaccctccataggagggggatcccactccacttttttctgggcttcaaactgtgccttctcccggaagctaagcaacaaccggttctcgagtggaacccggtgccgccccccgcctgacacgggggacagccctgtcattccctcataaatgagtgatgacttgcgacagcccttcctcgagtgacgctcggatgtgacgggtcataccaacccccacttcgccgggtacaggggcgacgtgaggacatgattgccctatccatcggatgtgacggtaacaggccggtcacacactggtcacatccgatggacaggagtcagctaggcgcgctgcacgtctgccctaaccgcattaaatgcggtgagggacagttggggcgtcgcacatttatggctgttcagcctgtgctcccctctcgctctctccctccgccgcgtggcagccgggtgagggtctcagggcgaagccgcgggagagcccgagggggtgacgccatgccccgaggcgccccccccccccgccgctttcatgactcgcgtgacgcgtgagtggggccaacttgcagagtcacgtggccggagggaaggtaattcccctctacttcacatacccccgggcccatatctccgacagatatcaatactatcaaaaataaaattcccatatacttgttagacaaaaaatctaacaataatatgattaaaatagcattcacctgttgcaacgtacaggtattttttctagttaatataaaaagtcacactgattgcttactccgacaacctctctatttaaccttctttaaaataacaacgggacccgtatgtcagcccctgctcctcctcttatttctctcttccttcctctctgttgcccaacaaacgaacatcatgaggagccgatgcggaggcagcacggggaggggccgaaggcgggacggcggtggaaataggcgatgggagtcctcttgcacagactgcagcacgacaagccactcaatgtcgtggatgacgtcattggggcgcactatcgtagtcgatgaaggcgggtggcactggagagtgcaagatagacggacagcaccacaggtgaagcgggaggcactggggaggggccgatggggaaagtggatgggtggcaggatccgcttagttagcaatgatggctcgggaggtggtgttagcaacgacggtggtgctaggtagaggcgacaaccgcaggagcagcgggacaaggtgttatagtgtcatggtgacgaaaaacaagcaacgatgatcttgtctttggatagtggcgacacttacctcggacagacaacaatgcatcgacggatggtggccttccagacgacgcagaaatggtgatggtgcacaaccatgggcaccgacgcttgtggggagtgcatggatgggagagagatgggggaaaccggcgcaagcccattttcggcaagccaacttgactgtcaagtttggcgagcagactagtttggttagctggatggcttggcaagtcagttggataggttgttggatcacaattttttcgctagaattgtgaaattttagcttgaagagttatttggagtggctctttgagtatctctaatagtcctaattttgactcttaataatgtttgattggagccataaaaattattaagccacatgcatgttgtaaagtccaatggaacccatcaaagatctagctagctcacgtgaggcaaatacacaggcaacaccgtcccatgttcttgtcaacgaaatcaagtcttatttactccaaacgatgaacatgacaaaacagaaagaccaaaaaggggaagcaagaactacaagtacaactttgatctcaacgtgtcaatcagaacccaagaagcttcttgcacgccttgaagatccgccctttcttcttcgtgatcttctccttctttcccgtcgcatgatcctgctcttccctccgtttttgctccccatcctggaacgccgcctgctcctgatgctcgccagccgcgtcgtcgccgtccatgtcgtcgtggatcctccagtacccatccgcgaagctggacggctgcctcctcatggagaacgccctccgcaccacggcctgcaggccaccgccgttgccaccggccgtcgacctgctcctctccacgggcctgaacctctgggaggctgacgagaagttcctcaccagcgtcgccgccccgacggccacgccttcccatttggtctcggcctccacggcgccgctggccaccggaggcgacgaggtgaggttgcagtatccattcaccatctctccaccctcctgtgtacaccaactcaccaagtgatgtgttgctgtgcgctagctagctagctagctgctgatatgggaggatttgggcgtggttcgtggagttgttcgccgcgggggccgggggtgtcacgtttggattttgcaagcgtgctgcgtgtgagaagtggagttgatgaggctggatgcgatcgagatggtgcgtgcgcgcgcggtggcgtcgggagcggcagtagtggaagacctgacgcaggggagcgtggtgaggcgagggagtaggaatcaagccgatcgatcaccgactgtttctgtctgcgagtggcggaaaacggtggccgtgacgagatcacgcgatcaaaccacggaacgcgaaatcatgagccgttgagtggtgggtgggtgggacagtgggacagtggaattgaagcgtccagttttgactgccacgccgcacggcaagcacggtttggctccaggaaaatgtgggttgtggaaatggatttgtagtcacgagagaacgggacgaaattccgtgcaggaaattatcggcccaacacaaatcgcatggaatgtttgcatcggtccatttgtccatgcatatatgttggggaagcagcgaagccttctaggcccgtgtacctgtggttgttccaagtacatgtcaagttatgtagcactactaactggtatagtattcgtacttctggctaatggcatgtatgtttaaatcttgcccatattttatttcggagttactaaaaatatggcgccacatgctatagtcgatttttttagccacttacacagtagttacacctcatttacaccccacttacatatgtaattagtatataattttcgaatttacatatgtaattttagtacttacatatgtaattttgagacttacattgtaaatacactaaaattacatatataatttagggacttacaatgtaaatacatgccgactattttttgatgaaaaatatagcgccataaatatagctatacccttttattttggattttccaggactaatccggcaatgctacgtatcaggccacagatgcgctgagtaattcatgtttcagtccatgtattcagatgttttattagttgaatcgaaatattgcaatgaatttttggtggtgtttcgtttattttcttcaatgtatttggatctgttgatgtttcaatacattttgaaaccgatgtttcatatgttgtagtaaaatgtttcaagagtgtttcggttctgtttcaccatttcaatagttgaaaacattcttttattaggtactgaaacattttggtaaaacaacaccctatatgttagaaaaatatcatactccgatttgtagtcgcataaggattaatcccgtgctttgtttagaatgtgggagttacccctattgttttggaaatttaattattattttcgtaaattcactgttcttttaaacagaagtgagctttgctgcttaactttattcaattatactagccataccattaaaaaaattttggagcacacattgtgaatctcaagcctcttggaccatgcatccagctttgattgactacaactcagtgttgacatgggaggtgacaccgggcgcaaatttctcatctgaattccagccatgtccgacgggcagggcacaccgaaccgttcttcctcctctttgccgctgccaaccggtagacagttatggcttcatcgctctcaacctcaagtcctcaaccccaagcggacgagtcacatggcgtgcttgtgatgcagcgtctttccttttcatggcggcagctttcgcatgcagagagcggcaaactcgaaggaggcagttgggccgtcccctcaaagatccacttgattgtgtactgcacgaattcaccggtgatgagaccattgcctgctatggcgatcgaaaaactacacgatctcgacacacctgcgagtgccatgcattgcaagcatacgacgcgtacgagcaagaaccacgggcatgcaaggcgagctactaccagcgacaaacgaggacaagacaagacgcccatatctatatccaacaactcttgtcactctcccctgcgtttattatttacagcgtctccgctatacagcaattcaatcagcaacaggattcgatccatcgatcgatcggtcggttggttggtttgacagcgtgtgtctctaacatgttgttccactgcaacattgtacgcgagatctcgatcatggcggcatgtaggagtggtggacgtcgtggtcgtgcggcggccagtgcaccccttccctcgggcacggcgccggcggaagcggcgccggctgcgccaggtacgtcgggtaccgttgccccggcatcaacaccgacaggtccgccgcctgcagcaccgtctccacctgcaacaatttcagagcagcaaacacctcaacattggatcatttcgctctgtgtaagtggttggcgacgtactacgtaccatgggagggctccggagcttgccggcgggagagacaccgtggcggcggcgcgcggggcggagcgccgcgctggcgaggggcgggaagacgtggggcttgatgaggtgctcgaagatggccatgaggaggaacatggagacgaggatggcggtggccgcgaacccgaacgagatggcgtccatcgacgtgccgaaggtcctgagcgacgtcgacgcctcgccgcccgcgtccgccgttgcggcgacgaccggcggctgcggaggcgccggcgacgggtcccctggccacggcctcgaccttccgctcattgcttgcctgcctcggccgcttcttggcctcttgcaggttgcaaccagcacgtctcctccctgcacgccatgtatatatgcatgtgttcgtcgtcaagaaactgtgtcgaattcaagggctacaattcaacgttgacttcttttgaactgtaatctatctacttcatgcatgacagatggatgactcatgaggaatcaagaatcacatgagaacaggttggtgagctgtgtactacacttgcacaccggtacacacacagcaactttatttcagcatcttcactagtaggaaagctgaaaagcaaatgcaaaagggaggagaaacaacaggagaggaggaacagaagaaaaacagttccaaaacagctcatttagaggcatcgaacatgcacattgcaggcaaaagaggatacacaacacaccttcagagttcagattagcaccggcaccctgcaaattgtcctccctgaattgaatgcagaaactagcaaccgtcttgatgtgcctctcctgatggaatcatggcttcatgggacctattgccgaatgccaagaacgggagaacacacaggaggatatctcagcttggctgcctctacttaaagacagtccccgaatcaaaagtgagatctcagctgatttggtggtggcaatgtggagagaggagaagaaaactacaggaaaaagcttggagtaacaaaaaggagtgctgcaagaaaggctgccacacttggcactcctatagaaataaactaggagatggatgatgataggggagtcttcaacagttgatgggaatggaaggctgcaagattggtacaaaaaataatcttggaatcatgtttgggcacatcaaaagagtggctccccactcccatgcaagcacactcacacagtaatagcagcccacatgatcctccaaagagcgtttagtgcagtgctgtgaagtgtagggaatgattcaaagaggctatgttagccaaggccaagccaaagggaaaagcaaaagaaatgggcaaatgcaaggagggaaaaagcagcgctcgtggaaaggagggaagttttgtgtggcctttgtgcagggaccaatcaacctctgatgggcatcatgctgcaatgtcagttaactggctgctcacaagaagtttactcttttctagtacaacaccctcacatgcgatgtgatgtagtatgtgtgcttgctctcgattatcaggattagcaatgcaagcttaattacgctgttaagcatgtgtataaaagaaaaagactgaaactgcaactctcttttgcttgcaagggagtattcttctgtttgttgtgacggggaagaagaaagatgcttatgtcatggctaagcgagtgactgtagaggatgcgagacccctactgccggacggctgtggatcatctgtgcccacacgatgtaagatatttgtacgaacacgacatgccgttgcctgtccatatatgctcgtctgtctaaaatatatgtgctgatcgacagtgtggtgataaagagatatagcgtgagacaagccattttgttcccttttgtacgcttcattgtgtacagataactgattgagaaatggtttgtttgtttcagaaaaaaaaagggtgagcttctcttcacacactaaagaagaaaaaaaaatcatgatttacagtcaattgtaataataccctagtactatggcacaaagtcatcctgaaagtgtttgtcacgtcgattcagtataaattcagtagcatcggcttgtcacaagtggcagaaaagattgagaatccaatccagcaacatgctaataacaatgtctgtggaggaaatgaggaatgattaacctacaaaaaattgtatagcagctgtagaaagtactactacactactactagccattaagttacagttcccatggtgaacactaggacagtaggagtaagaaatgtaagatactgatccccagttcacattccaatggattgattatgcgtgcagtaaaatccttcttaggtgctactaagatccacttaggaaactacagagttaactaatcttccaaaagttgcgtgtcagcgtcagtatactgtctagttttagctcttttcttctttctgttactgatagtctggaacagcaaaactgcatgtgcattcttgtttctgaatttctgaccagatgatgttcagacttcagagacagaggacttaatttttttacttcgttaatactaacatagttactactagcagtaaaaatcagttaactgttaactgatgattacactaatgaatatattaactcctttctcaggtagtcctcaacgcgtcatgtatggaatatgaattatctttgtccctgactccatccccaaatcatcttgtctccttgccttgagcaagcatcaatctaagctaaagagaaggctattaaaatcactaatgcttgcttccaaagtaagtgcttggtacctgtgagttgggagccaactaataaagtgtcaggtccattacttaattctgagcatcatcgcagtggctggcaaggaggagagcatcaacaagggccatggatagttattagctgcactttttttttcatctccagaacatataattctgtgcatttgacaaactataattcacttccattcttggcatgcatagaacccacatgagtgttagagaggcaaagacatatttaggaatgagagaaagggagccaaattatgaaaaggaaatcttaatttgaacttcttgctcctgctttaagttgcagcattgccccaacagaagctatcatccaaaggaaaacaaagcgaaaaggcatgaagtagtagtagaaagcacaacacaagccgagaaaactaatcacctagctatgggtattattctggagtagaaaaggcttaatgataatgcgaatgagatgcatgaaagattagtgaggtgataggaaaagcttagaccggatgaaaccagctcaaatagagaatggggaataccttgaaaggttaacaagactgcgtcaaagataatcgtaatgctggacgatccgtactgctgtatactgttagataattgcatcgctatttggcgagatctatcattgtaaagcgtacatcgaaggaggagcagatgatgatagctaggcaacctaaaaaggggaaatgaggaaaaggccttttcccgagctgaagaccacatgcttgatgcttgtggaggggctcacatgtcctcctcttcctcggctcacagtcacagaggaagaagaacaaaggagatgaaataggctgtgagctggtgtgatccggctcagataagaacatcggcaccaaggccatgttggaaatataaaacgagatcggaatctcagtaaaggaaaagaaaatttgcagagaaatgtaaaggagcaacctcatacttgtcgattgctagagctgaaatcttgaaccaatgttttgagtatttaagcatcaataatgtgagttaaagtatacgaactgatcgcatggagataatttcgtttgattttcttgcaattcttttcgcagtatatcttctcgtggtagagtatgaaaagttacaaaagaaaaggcttacattttgtgatggagggaaacagaaagtacaaaggtggcagtgacactgtccatggagagtagagcacttcttcctgggagtggattctaatccctcgaaagaatatcctctcgtatatctttttctttcaaattcgatgtaaatagttgtgaaaaattctaaaaaaaattagcaatgtagagtataatgatacctactaatccaccaaaattcaagttcaaattcgatctacacatcgagaaacaaaaaagacaaatttagatataaatagtacgctactatttatacactgaatttgtttttttatatctcgacttgtgagttgagtttggacttaagattttgtggagttgtatatatgagttgtatgaatgttgtcaatttttttcaaaatttttcataaccgtttagatgatttttaaggaaacgaggaaacatcttgagggattagaatagtttccttctttttttagaaaaagatctctttctttttccagagaagtgcagttcttaactacggatgctgaaatagtaggatacgcgagaacatcagtgtgaactgggccgtcagtttgttatacggaatatctgggccgtgcgtaatcaagtataggagatctcagctcgttttgaaaaaagtacaccaaaggtccctcaacttgtcatcgaggtacagaattatccctcagccgtaaaaccagacgtaatatctctcaacttacaaaaccgttcactttttgaccccggttttatccaacgtggtggttgagttagcgtggaatacacgtagaccccatatgctaggtgtccacgtcagcccccctctctctcactcatcttttctcctctctgcaaggcgacgcacgggtggggaggtcaccggggcgaggcgggagaggagatccggcagtcggcgatgcggcggtggcggctgcgacactggagaagggaggcagctcatggcggcggccgacgacgatgcgggagaagggagagcgtcaccgcgcgtgcgacctcggggtcggaccatcaaagaggcccgggaggtggcggcggcggcgacacggtagaaggggaggacgttgccacacgggtgagctcgaggacgaagatcccagtcgcagcgaggtgagcgacctcaaccgcatcgcgcccgccgtcgacgacccacgcaagcacgcactcgtcttagcagtcctcgagcttcgccacccagctgccgcccacgactcccgcgcacggttgcttcctgctcgcgccgttcccactttgatgttgcctccccggaggagccaagcctcagatggggatggcgatggcgaggtggctcgagggcaccacgacgatgagcaacggggacggggagagcgaggacgctaccgtcgtcgtgtcgcccgtcgccatgggaggaggccctctcctctcttcccccacctcatccccgctgccgccggaggagccaggcctcgggatgaggatgctggcgctgccacggcgacgagcagcggggacggggagtgagacgggagagcgaggacgctatcgttgccgcgtcacccgtcgccatgggaggaggtcctcttgctcctgtgtcgtcatcgtcgccgctgagtcgcccgttgtcggtcgccggccgttggtagccgcctcggctcgccaagcctccttcctacccaccggctagcctgccccagatgaggataaaattgggagaggaggaaaggagagaagaggggaaagggaaagaaggggatgacgtggtcacactgacatgtggggcccatgtgggtcccacgttgactcggatgccacatcggataaaaccggggtcaaaactgcctgaggacccaaagtgatccggtttcgtaagttgagaaacatatatctggttttgcggttgggggatgattttgtaattcgatgccaagatgagggacctctggtgtacattttgcgcttgttttctaaggcagcccaaagcacgccagcccatcatgactccatcgtccaagaggaggccgcaaagttcacggcccatatactgaccgggcgaagcggcgggggcctctgttacgactttaggccggtctagcacgcgcacggtgcaccgtatgccgcggctccgctccgttcgccgtgcgcgtgcgcggtgcctctgccggtcaaatctgccacggcgccaacccacgcgcgcggccgaggcgaagcggacggaagaacgcaggcgcaggcgtgcgtttccgcaggatttgcttccgtcgcgtgatccatcttggccgccgtggcacgcgtggtggcgatcgacatggagaggaaaaaacgtacagccccgcgccgcgcgacagcgtgatccaatcggtggcctgcgccctgcgccaccggtcaaccaaaggccaggcgcgcaccaccgattcacgtaccgatcccgactcggcggtactgttttttcctgcgcctttatgtcagtctcagcgcctttgttttacgccaatgcgaaacacgagcgcctgacgatgttactgttgaccactaggcactaaccatcatcgtcgtcgtcctcgtctatgctattcctgtgaaagatcaatgccatagaaatcaacatctgtatgtctcataaaacatgctcctagggttaaaactgcgtgccacgagtgacggacgaagaaaccaaacgtgcgagtacggacaagagaagttgcattaatctgactttgggaacacgggaggatcatgaaagaaacgtaagaggccagcctgcgtgcgacgggagaagtccacctctgtctactggctaacaggacagtaatctggttggtgtaccgtactaacagctagcctgattttacgttttgtcatggcgaaggccggatcgatgcagccttcaccgggcgaaatttcgcggggagatggacagctcgttcggacattgtcagcaaaaagtccagtggatcgccgagcggattgctcgatcgatcgcgcgatgctgcatatccgtggtggactggtggtctgatggagtagccgctgggacgccggcgttttccgtgatttgctttcttcgcctctctcacctatcacgcaccgaggcccgcatgcactacgctccggcggcatgggcggccgatgagtcggcgacgtgcactgcagaggccggcccattataccttttccgaagcagagacgttgctggctaacgcacctttgttcttcggtaggtcgtcggtttccacatccgcgtgtctcctgataatgtggtagtgactgttgaattagacacgttttgctatacatacatgctccctggctaaggcatgggctataaccctacaactgttgtgtacactgtcctaagtgcgctcgaaggtttggtcaggccatcgaactgatggcacactagtactgtaggtggtgcatgttggagaagaacaaatcatttggtgccaataaatcattcacatggaattgtttttggaaagaatttggcatggaattttgggccgtccatcgatgaccacgagcaataatttatgcattgggcggcttgagatggagatcagacgttaacttgtttcaatcacgagttcgtgatagcttgccgccccaaaacacccggttttgtctggaagcacgcttgcagataagcgcatatatggtctaaccgcagctcgttttgaccccctaatttatagtggtaaacagctacaggttgcatcatgttacggccatatgtgatagtagtatatcaaaggaaagttactttactactcacgttttgttgttttggtgcaggttgtccgttggattttgcaggttacgtaggcttgtaaccaagcttcgtagtaaagatattatgcgtccataacccatggcgtcatgcctgaatattacgcattactcaaaaagtgttatccgttactactaaagtgctcactgaatcatctcgagtatgacctgtgaagaagcacctcaatggaacattgaacatatcccatacgctgttgaggcgctgactacaactaatcatcctgccagtaacatccctgggcgtccatctcacagatagaaatgcagaatcttgagtgttgagacctctactacacctagatacctagccattcaggcaattgttaaccacgagttctcaattatcaaggaaacagcaacattgttccagcccttcagcaactactcatgcagttgcacgatcgtagtggctgcattgactagtgatagtccaaacctactggcaccaaaagacactgtctcctcaagttgcaggccaaaagaggctaaacgctagtatcttatcatgtccttgacaagaacatgagaccgaattccctggtcattcaagtggatcataagccagaattgtcactgcgtgagtgtaataatgcaggacaggtccccaaatgtatgaataaacgcattctggccaatcagaaagatcaagaatgagtgtcccttgacaatgtagcttcaggttatttgtacttggagatggacagattccactgttcatcaacagcttgaataattattaaacaaataattccattactgtctgcctcacacggtcacaccagggacaggtcaaagctcacatgcaaaaagcagcatctgctcgagcagggacatccagtgcagcaataattaaggtttgatcttaacaacagatcagcactaaatcgttgcactattccgggctaaaggtgatgtaatggcagttaacttcagtgatcctatgcctatatttttgaactgtacaatgcagagacaaagccaactggtacttttcaatcagacagcgcacttccctgcttgtgccgtagtctgctcctgtgactggaattatgctgcatatcagttcacggggctaatgttgtgccaagaaaaagaagaacatctcaatctaatcagtcatgtgtgtacaaaactgtattatttcttcttgtacaaaaatactagtatgccgacgtgttcgagccactccgtagttgataggaatactttacgtgccacgcgtacatcatgaggaagaacacatatgacaaatgaatcggcgagagagttgctcctgtggctgggagccaggggcggagaccggccaggcagctttcggttttgtgctcttgctatctgaacttgtagcgttgtccatgtagggcacgggggtgaatcagcagatctttgaccccaatttctgtttgaatatttgtcatgccgctcttgtccccttgcatgcatgcctgtcgagacgttatgattgctgcggtgtttttttttctgaacctgagttacttgcgggcagcggtgaacgaaacagagacggaattctacccatcacaggttcagaaaacaggagccttcttctcctttcgttttacaggtgaggattccaaactctatgcatggtacacactgcacaagaggctactactccagcccatttttctgaaaaaagaaaagaaaaggaggctactactcccagcagctggtagtgcatgtacgttagcacattccacggcgaggggatgcgcgagagttgcgaaatatctcaccaccggatcggcagatgtacgcgggcaaagtatctcgaattctcgatatctaaagaaaagtataggagaaaaaacgggagaggattgcagcaacaacggtaggccggtagcggcagcgggcggtaggccggtagcggcagcgggcggtatctcctctcggtgtgttctagtagaatcaggacacgcgcgcgcgtgtgatggtgcgcgcacgcgggcgcgggcgcgggccggtccgcgagagagcaagcgggccgcgcactcccgtcgtcccattgcgtattcgcggcgcggtcgctttcgccgcggcgggcaagtggcgtggcgcgccgccctgcgcgatccacaggatgcgaagattccgccgagggggctcgcacgcccgcgtacgtacgttcgcgcgtgcggatcccgagacgcgacgaattgggtcgagattgtgcccggcgcatcggacggcgcgggaggtgggggctcctcgaggcgggcgcgcgcgtcaaacagaacaagaggcgccggcatctcgtgcccgcgtggcctcttcctccctccgcctcccgccgcaccactacttgccccccatatccatccataataaaagtacgcacctcgcgtccgcggccgcgcggctatatatcagtaccgcgcctacgcactcctctcctctctctcctgtgtgctagcggaggcggagcactacacggttaattctgcggttgctgctgctacctgcgaccttctagcaggtgcgtttcctcctcgctttgcctatatatatatccacttacatttctcggcttgatccatggattagtctgtcgatctcttccatgccatcgatctcgctggttaagattgcgctctagtgcttagcttgttgcagagccttgactttctttctctgctaagaactgaataacttgactctgagtaagagcttgcatatatagctcttagtatattcttcagattttgtcattgatgttatgcgacttgtgcatttctttgactgatatcatgtagtaatcactaaacttcatgcctgactctaggttgtgagttgtgagacagcgagagttagtcggtgtagtttcatcaggaagggccgcttagacagtgagaactgagaactgagaaatacagcagtaggaaataaatacccgttctactctggtgtcagtcctagatataatttaccactgtgtttcatgcatgatccgattcttagttttctcgacaagaggtggtaaccacatgtaaatattgttgtttagcatagctcttgtgatcaaagaggatggaaaattcctggtagggtcagtaagggaaggaatcagcattgcgttcccattgttcatatatctgacaaatgataatgatgtcttggtgtccattgctactggacaaaatagtacaggttagctgagtcagaagggttcatgcagaaagtgtagaacttattgcagataaaaccctttgcaaatcatgtacagcagtagagcttcatactgtcaccggcttactgcgcagtccccaacgtttgatcatgtggtccataaggatcaatcgttcaaactgcatcagaattcagaacctaagcatgaagaaatactacctcgatctaccactagacagccatatatgacattgacaacggcaataaggaccgttgctttagaccaaaatagaatcagcagtgcatccacttcctggatgggttaaatgctgatacgaagtatgaacagacataacctaatcttaattaactgacaggctgaaaaaggtatcgggtatattcaatgaatctggtaaaatatctggctgatttattgcgttagtatcaagtgattagtactatgagatttggtattgctactcaagattctttgtttcttttttcatgaaagaggtcttgagaaaattcgtagtgtaagcatttgttttgctgaagagaacaaccaaaaccataagcccaggcaaaagtgtgttcatttaactcagtaaactagtctttcctgatccgaagtttggagcaaactttaatttttctaatacacttttgttttaaagagagaacaaaaaagctgatatttgctaaaggaacaagtatctaattactcttttattacttggtccccatgattattcagtaactggctttcagtataatgatacaacttttggtcttttcacacttcactttccttcaatcctattcaactatcactgcactgggagctaactacacatagacatagctttcattctttttctgaagtttaaataatgtttacttttctgaaaatttcaacgtattgatatcatcatcaaatccagtatgacatgccccaaactaacgtaagattcatacttttcaggtacacagtgctaacaagtaacaacacaatgttgcctcagcaacttcagatatatttgtgcttcatccttctgtctctgaagttcggaatatctgcatctctacctcttgaaacagatgctctcttggacataaagagtcatctggaggatccacaaaattacctaggcaattgggatgagtctcattcaccatgccaattttatggcgttacatgtgaccaaacttctggtggtgtcattggaatatcactctccaacgcctcactatcaggaactatatcgtcgtcgttttctcttctttcccaactacgtacgctggagcttggtgcaaactccatctcaggcactattcctgctgcactagctaactgcacaaatctgcaggttcttaacctgtcaacaaacagtttgacagggcaattacctgatctttcaacatttatcaatctacaagttcttgacctgtcaacaaacaatttttctggaccattcccagcatgggttggcaaattatcaggcctaactgaactaggtctaggagagaacaacttcaatgaaggtgatgttcctgaaagtattggaaagctgaagaacctgacatggctattcttggggcaatgcaaccttagaggagaattaccagtttcaatatttgatctggtctcacttgggaccctagacttctcacgcaatcagattattggtgtgtttccaatagcaatatccaacctgcgtaacctatggaagatcgagctctatcaaaacaatctgactggtgaaattcctcctgaacttgcacatttgacattgttatctgaatttgatgtgtcccagaatcagctaagtggtattctgcccaaagagatagcaaacctgaagaagctgaagatctttcatatttaccgaaacaacttctctggtgtgcttcctgaaggattaggggacttggagtttcttgagtcattttcaacctatgaaaatcaattctcaggaaagttccctgcaaaccttggccgattctcaccactcaatgcaattgacatatctgagaattatttttctggtgaatttccaaggttcctgtgccaaaacaacaaattgcagttcttgttggctttggacaacaacttctcaggtgaattccccagctcctactcttcttgcaaaacacttcagaggtttagaataagtcaaaatcagttcactgggagaattcacagtggcatatggggattgcctaatgctgtgatcatcgatgttgccaacaataaatttgttggcggcatatcctctgatataggcatttcggcttctctgaaccaactgtatgttcataataacgtcttctctggtgaacttccaatggagttggggaagctttccctgcttcagaagcttgttgctttcaacaatagattctctggccaaatccctgcacagattggaagtttgaagcagctgtcattcctgcacctggaacaaaatgctctggaaggatcgataccacctgatattggtatgtgcaacagcctagttgatctgaaccttgcagacaattctttgactggcaccattccagacacactagcatctctattcactctgaattcactcaacctatctcacaacatgatctctggtgaaatccctgaaggattgcaatatctgaagcttagttatgttgatttctcccacaacaatttatctggaccagtccctccagctctcctgatgatagctggagatgatgcattctctgaaaacgacggcctttgtattgctggagtttcagaaggttggaggcaaaatgccaccaatttaagatactgcccgtggaacgacaaccatcagaacttctcgcagagaaggctatttgtcgtgctgataatagtgacatctctggtggttctcctatctgggttggcatgcctgagatatgaaaattacaagcttgagcagttccacagcaagggagacatcgagagcggcgacgacagtgactcaaagtgggttcttgagtccttccacccccctgagcttgatcctgaggagatttgcaacttggatgtggacaatctgattggctgtggaggcactggcaaagtttataggcttgaattgagcaaagggaggggtgttgtggccgtgaagcaactatggaagcgtgatgatgcaaaggtcatgagaactgagatcaacacacttgggaaaatacgccaccggaacatcctgaaactccatgcattcttgaccggtggggaatcaaactttctggtgtatgagtatgtggtaaatggcaatctctacgatgcaatccgccgtgagttcaaggctgggcagccggagctggactgggagaagcggtaccggattgcggttggaaccgcaaagggcatcatgtatcttcaccatgattgctccccggccataatccaccgtgacataaaatccaccaatatactgctggatgaggagtatgaagcgaagcttgcggatttcggcatcgccaaattggtggaaggttcaccactcagctgcttcgctggtacccatggctacatggctcctggtaagatatgaacaattctgctcttgtatgttaaatgtttatggtagtagttagtattgcacatgaattccttaggaaaaaaaacaaaatgcgtaatacctcttcttccagcccttacccattcctctcaaccatctcgcggatgaattcgccatgccgctgctctcttgctcggccgccgccgccgcggcgccaccttgcgagcaggtcgaccgccgtcggcggctgtgacgcgcatcggccactccacccccttcttccccgacaggcgcccccccccccttctaccaccgccgcggtgctcgagctcccacctccctcccattccctccccgcctgccgccagcaacctccccttcaaccaccgcccgccgcggccgtcgtagtcgaccgctactggccgcgccatccgccgccgccatcctccagtgcctccgatgcggacgaatttcttggcgattagccgattacatgcggtgaatgagtgggagtcccaccgggaatggtcaggctcatatgaagatggtatctttagaaataactgaaaataatttattaataaacgtttaactatatttttcatggttttaaaccgatgctgaaaaatatactactgcaacgataaacaaaaacactgaaatcaaacttaaaattaagtttcagaattcaatttttggttgggctaataaactaacaagcaacgagggtagaattgctactaggtattctggaaaaaaagagagagaaagaattgctactagtcatggacaatgttattaaaaaaaatattcatacatttttatatgaaagcaaatggcatccatcataattcttcaaaaggtgtaattctgacatgcatattatgcgtagttctgtagatttgacaatctaacatcagctcgtctcaaaatgcagagcttgcttattctctcaaggtgacagagaagagtgatgtttacagctttggcattgtgctgttagagctgcttactggacgcagcccttcagaccaacagtttgacggtgaactggacattgtctcctgggtttcatcccatttggccaaccagaatcctgcagctgttcttgatccaaaggttagcagccatgcatcagaggacatgacaaaggtcttgaacattgccatcctttgcactgttcaactgccttctgaacggccaaccatgagagaagtcgtgaaaatgctcatcgacatcgactctatctcagcaaacgggaaggcaaagaacaagaatgataagaagtaagaacagatgccccgtttctttgtaagaaactgctgccagaaagatcaaaaggcacccagtagcaacagtctgggtgctgccgtgctgccaattaggaccttaattagaatgcctgactagtgaatagtaactagtaggctggtaataaactgaggttttagcagcctctgaaaagcttgcacatatgtacaagctaccctgtacaaatttcagtcatgtactctgaagtttctgtaaaaatgatatgcgaagaattatgatgtaccagtaccacactgcaatgccagtagaatatgaccataccgttaaaaatggaaatgtgctgattttttttttagacaggaacaggaaatactaaaaggcaaaggccgttgtacaggttattccaatactactacatattccaacctctttctgctatgttccaagttccgacctgtttaatcagataggaacaacctaatgtgtcaatatagctgatccagcaaagttcagagttccaaatctttcaggaaccggccggatatccgagaaaattgatacacagagacacagaatcagagtccagaatcctacattgttgtacaactcgtagctgttttctgtttgtcactgttctacaatatactgcagcactgcttttagctgacagttttgaaaggggttgcaaccttcaggctatcaacaatgtcagtgacagagccaatgcccactgccaccgagatcatcaagcacaccatgctcaggccttgcaggagataccacctccctcccctggtgatcttctcctgcgcaatgtgcatgctgatggggaagtaaacagtcagtggccagaagctgaaggcgccgaggagccccagcaccgcgttgaagaacggtatcatcatcgccaccaccgtcgtcgcgatgactacgacggtccggaggacgagcttgtacggcgccacggtcaccgatcctcgctggatcagcggcacgtttacggtgtactcgctgttgatgaacttggcctccggccaccgggaggagatccatctctccattgtcgcaaatatgggctgtgcataaacctgcattcagaaatgcacccggtttaagaataatttcacggtgatctctactaataatattttactaccggggctcagttacgaacttatgatgtactgacctgatatgctccgatgagatggaggatgaggcacatgttggcaatgtcgacgagccagaagggccccataccggacgccgtcaggatgttgcccggagcatctgaaccgaacgcggcgtacccggcgcagccaacggagatgtagaagatggtggtggctccaatcccgtacatcgctgccttcttcatggtcttgttctccggtggtgacggtttcagtgtgtcctacaaaagcaaaacagacggaaaaaagcgcattagcgttaagaacgtactagtaccacattgctactcgcactaaaaaaatattggcacgaacaaaaagaaaatcctgttcgtgtatgttggttcagaggtagtatctgaatattgtgggtgacgaatcatcatcgatcgtgcatgcaaacctggatctcaattagcacttctgcaaaggtgtaggcgaaggcgatgttccccagtgcgagcagtacgttccagagcttcttgctggaggacgccgcggtggcgccctggatcctgccgctgaggtggccgccgtgcgacacccactccgccacggacaggccgaggccgatgaaggagtaggcgaacgacatgacggcggcgacgacggacagccaggtgatgtgctccaggcccgggaactgggacagcaccacctgcacgatgctgaacgccagcatgagcaccgtcgccgacgtgttgtcgcaccgcgcggcggcgccggcgccgttccgatggatgcaatccgacctcctgatcgcgcttcgcaacacaacggaaagaaaaagaaaaacagacgaaatttagtagcctgaccgatggcgaaaagttcagttcggagggaagttggagtgatctgttcggttactcacaccatgcttatggttgcggtgattgtgtagccgaccatggtgccccacaggttgacgtactgcgcgattccgcacatgaacacctctctaggacctgaaaatatttttggcattgcgttcagtttaaccaacaagatggagatgagagaaaaaaaatgtgagtgtacttactgaggtatgatctgacggcgtccatgtatgtgcggttcctggtgccggtgacggggtgcggcgcgcggtaggcgttggcgagcagagtggaggtgtagtaggtgacgcaggcgaagccggcgagggcgagcggcccggccacccaacccagctgcgccacgctccacgccagcgccagcacgccggagccgatcaccgccgtaacaatgtgcgccgtcgccgtccataccgtccctgcaaaaacaaacccagttaaccggaaccgccgccggcgcaagccaaccaaaacaattctcaattcttaatcccagcccaactcccatggcctgtttagttggagggagttggcgatggggaatgtgagtttatgatatatgggagtttaagtatgtagtttggttgaaagatttgggaatttgagtgggtttgggatagggaattaaaaggtcgaattcccactaatctcttacctaggggaggcatgttaattcgtgagacttgaagagaattcgatatgaaaccacaatagatgaggactaaaaatgtaactctcatgaccaatccacccatcaactccctctttaaaactcccattcctcttctctcgccaaacaggccgccaaggtgtcccaagaaaacaaatagtcgatcacccatgcggcacgcacgcccgcacgcacgccgtaccagtcaaagaaaaaccccaaaaaccgggggaagaaatcactaaatcaggaacaagaacgaacacgcacctgtccgctcgtgctcgccgctctcgacgtcttccggtgcggcgttcttgttcatgttgtcggcgagccccgcaggtgtcccgtgagggagagtgggcgaggagggatgcggccgagtcctgaaaccgtgaacgaatctggacggtattaggccgtatatataagggaggcagctgaaagtgggctttaatcagggctcctgatagggccggcacttggaccagtagagagcgccggttcggctcttccggactccattgggcagagtccggatgcaatgcgtttgacgagcaaggacctcatcgtttgcccaaaatttgaatttgattttgattttaatgatatctaagttttactcacatatcaaataagctgtaagcaaattgttaaaatgaacttgtgattggtataaattgatgtgcaattcgttttgataaaagaaaaactgattttttttaaaaaaaaaaaactaggcagacttagctggtgttatattaagtagagtgaaaaatatttacatgttcactaacggcgaaacaaacagagaaaaatgaaaaaaagctgggcgatgctatgacaattaacgttctcgtgatatctttactggcttgtttaattcgtgcacgattttggatgacgggctcccaatacgcttcatcatgcataataaatttgtacttgatgcatgcatactccctccaccagttccatattaattgatgttttagataaagtcgaggtcaaatttttataactttaaccatcaataacttttaaaaatatttagtttaaagtaactagaacaacatgtatagatttatctttcaaaacactataagtaaacatacatttatttattatatatattataatagaaaaatatggtcaaagatatattttgtagaccgtattattatccaaaacgtcaattaaaatgaaaccggagggagtactccattttgcttattttctctcatgggggttctgtcaataagaccgtgatattttctttttaaatttttatttagacaatcattttgtaagctcaaatgttatggttacgtatatcctaaaagtagaggttgaggatgcaatcatctttttttatcttaaaaaatgtctgggttataataccgctcagacatgcccctgctacctgattcagctcgaacctacaaagatcctactatggtataggaataaaatgaaaggaaaaaaatatttactcggggttgagtcccaataatcaaggaatttaggaacacatgaattactcaattgagttaattttacgcctcatgagagaaaatagtacatgtttgtttagtaatttttttaccaccttttctgtccgtagcccgcgtagcgacccaaatcgttagccccggtacaaagtacaagtgattgtaaactttcatgttattaaataaaaagatgaatgttaaaggacatgtagtatagtgattgcaatgacctaagtagtactcaagattctgtgttcaaatctttataggaacgaattttagattgggctatttccataatgaaactatacttggaaatcaaaaaggtaaaccatgcatcgatttctgcattattttttttcgattacacaccaatacacacgtgcacacctgcaaatatattcctaatacacactcaaaagatacgaagactaacgggtaaatctcaaaccttgtcaattaaattcctactaaaaacataaccgtgtatgtaaagcatttagagtggatatcatgatttaaaccctaactaataagtaaaatcatatagtaataaccatgactttaccatcataccacaaatacttcttaggtttccacgatccaagcattccttgttatagtcaatcaagtacgcaaaatttatctccacggttgttgtcattgttaggttgtagtgttaaataggaggaattaagatgtataatcaattatctggagtgatgtcctcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacaagtttcaccaggatgaaactctttccttctctctcatccccatttcatgcaaataatcattttttattcagtcttacccctattaaatgtgcatgacacaccagtgaaacccccattgtgactggccttagtactacatgtagggtgacgtcctcagtactcctctccgagaacaaattaaaaactactttgctgccggttttgtcaaccaagttgaataataataatcttctcaaaactgaaaccattgttatatgaacccaaatgattgttacttcctccgtttcacaatataagtcattctagcatttcttacatttatatagttgttaatgaatccaaacatatagtatgtgtagattcattaacaactatatgtatatgggaaatgttagaatgatttacattatgaaacggatgtagtatatgagatcaaatagcatgttgttgacaccaaaaagtcttgaccggcatccacacacacacagggtcatgcagaaccagtgaaccacacacacagaaaccagatgagatgagtgcagtagtgtagcgcaacagaaaaaggcaaaggcaaaggcaatgcatatacatacgttttcgcagctgcgtcatcgtcattcggttggagagacgtatcagagtagatggatggatcatggatccgtctcatggacatccactcggacagcaactttgggttgggaccttgctttctgcttcgccgtcatctgctacgactgccctcggcccttacatccaaaactgaccacgcaaacttgcaacaaatgccgcccgcgatagccgatcgataggtttgccggacatgtgcgcgtgtgtggtatcatggtgcgcgctcgatcgacgcagtgcgcagctgcggacacacacgtaccaatttcccggtcagaatgtcagctcgcagcagggtagtgataagtactgaagagactaaaggctggcgacgtatatatgtccacgtggggagaatgagatcgatcgagatggcatgccaggctgagtgcccgacaccgggccggtggttgccggccgagatgctagcttttttccaggattgtgaggaaaatgcgtcgcgctgatcagtttcggtttctctgcttgctacattgcaatagtagaaaggcagtgcgccagtgccggtcacgggccgctggtgaatcgtgatggttcgctggatggtttgacatgtaattccatatatgtatgctaagatgtcaggttcttgaaactgttggtaggcctatgtggatagagggaggtgaagcttgattgtgatatttgtttttttacggacagaataaatgagcactgccacattccatctatctgtccagaataaatcatcattccatctatctgtccagaaaaagatagatgctccattattcagttgcactctttgcaattgctttaaagagatcaatcagtttgaggttctctctccactaaaatgaatcatttaccagtaaatgccagtgaggaagttggtttgtataatacagttacaatatcatgttattccaaagaatatcatgatgcttgtaaaacttgtgtagattcttgagcaagagagtattgttttatgcatataaattgatctctcgaatacctctatttgactgtggcatacagactttatctcagacaataagagggtgtgttttgcttcccatatcggatcccactaagatgttcggttaatatcctcataggagagagattaaggatattttttttcacacctattatggtgtggaattattccccatcaattctctccaatcccttttaacgctcttcaaaccgaataaagcctaaaagagaatgtcttgtgtatttttcgattcgctgcaccactcttacggttagtttcaagggtagaaagttgagagtgcaaaaagtatcgacttaaccaaattgagtctattcccataaaaaatatgcttcctatgtttcatattataagtcttttgattttttctctagtcaaacctttttaagtttggccaaatttatgaaaaaatagtaatatttaaaatatcaaattagtttcattaaataatatattttgatattgtatttgttttatgttgaaaatactactatatttttctataaatttggtcaaacttaaagaagtttgactagaaaataatcaaacgatttatatgttataaaagttagtcgatatagcggaacgacgactagcattctcgatcgcttcagtcattgatcacccatgacacgccagatgatgacacatgaatacacaatatttgttaacgaagttcagccgaagcctacatccccgaggctctaattatgggcgtccccaaccaacataacacctacccggtacgagtccatggccacgccgccatcgtctccttgcgtgtctacgctatattgtagtcgctatagttacattgtggcacctcctctctatttaagagagttgtcgatcgggttatagagtccgactctaactccacctccatcacctattacaactccaaatctaactgtaaccaaatagaactggtatattcaaccactagtacagatccttctatgtgtgacgggctctaacatgcctggaaatagcgggccgtcacaagaaagtcatctcaatcgggctaaaaaagtgcccgattaagatatggtcgcacagacatattagatggacataaaacttaagcccgtcacagatgacacctatcagtgacgggccgtagtttagacccgattgagataatattccatatctcaaacgggcttgaagttggggcccgtcacagatgaccatcattcgtgacgagcaccaactttaggcccgattgagataacattccatatctcaaacgggccttaagttaaggcccgtcacaaatgaccatcatccgtgacgtacactaacttaaggcccgtcaccgatgagtattttttctatttttcatatgaaatgtttatatttgtaagttgaactatagcaaaataattaacttgcagtataataattcattttacgagtcaaaataattttacgggtagtaaataatatcaaatggaaaagtcatcaacaacaaaattgtataactcatcaagatctataacttttattttggtcatttttctatataacattttttgaacagtttgaatttgaatttgaaaatatgacaacttcaaacaacattttcaaatactaaatgatttcaactgaaaaagttatcaacaacaaagttgaaaaactcatcaagaactataacttttattttggtcatttttctatataacatttttttgaaccgtttgaattt

SEQ ID NO: 10672 - DNA, 6087 bp, Oryza sativa
tacatatatgtgtatagtttataaaaccagataagagatatgtcaattttgtgaacaatgttactatcactttatcagatgaataaatgatcaaaataaaagttatagatcttgatgagttattcaactttgttgttgataactttttcagttgaaatcatttagtatttgaaaatgttgtttgaagttgtcatatttttaaattcaaattcaaacggttaaaaaattgttatatagaaaaatgaccaaaataaaagatatagatcttgatgagttattcaactttgttattgatgactttttcagttgaagtcgttcactaacaaaaaaattctatctgaatttctcaaactttgaatttaaaatatcaaattgtttaaatagagttagatggagaaatgaccaaaagaaaaattttgcacctcgatgatctctacaactttggtttcggtgacttttccatctgaaatcatttattaaccctaatttttcttcgaagttgtcaaattttgaaaattcaaaatttgaattgttcaaataaacttatttgtacaaaggaccgatacaatagttgtagatctcgatgagttatacaattttattctttatgatttttgatggttgtgtatgtgaatgaatgtatatgaatgggggatgttggggtgtgacatatcctggcctagggcttaatagaattaatagaatgctcataccaacaagctacaactactcttccggaagtagttctccacaaaaaactttgatattaaacgtgcttggtctggagcaattttaggatgggtgaccgatcgggaagtaaacttcgtgcacacgaataaggacaaaaaaaaaggattggcctgagaggggctggacagcatggcaaggctagccaaaaataaaatttattttttttaggattatactcatcagtgacgggcattaacttaggcccgattgagatgactcatctgtgacgggctatagtttgacatgtcgtcagggtcaaagctatcagtgacgggctttaattagggcccgattaagataggttcatccgtgacgaccgtttgcccgattgagataacttttcacattagtgacttctagcctgtgacggatgccgtacccgattgagatgggggttgccgccagattgagataatggtatccgttctagtgaacacatattctaacattatagtataaaacataagtatctttttttctttataggaatagactcaatttggttaagtcgatactttttgcactctcaactttctacccttgaaactaaccgtaagaacgggtagatggtttatccatcagttcgtagctaacaagggtcgttgcaatttgcaaaaaaataatatcctataatagtaaaaaatagtgataattaatagtattacgtacgactgtgatagttcaatacgatggacaggaagttagattgggacatggaagcagatcatgcatgaccgtctcaatcgcgcgcaacaataatctactctcttcgtccttaaaaaaaaactaaagtaatctagtcatgagttataatatttgactaatttgtcatatcatgggcaagataaagctactagcagatgggattgtacgtgattaaaggcacagaaaaatgcttcatgaggtggtagtgctgagctttagcaagcttgcgtgcaacgctctctcctttgctcgacgagcaccagatgaccccggcaagagaattgcatagcacctggtaatcccaccaactctatcgtccttccactagtgaatatttcctccatttttctttcagtgtgggttggatcaaatcatattctctacactttcttggattaatttccgcgtaatttccaattaaaaaaactgcagcactctcagctagccagcttgatgaacactactagttgttcctacaattttcatgcaaatcatgtagtaaatacagctctataagagacaaataataccaccggcagacagtagatccaacgcatctagacggtttttcgcagcatcaaagatttgcttccaggtttcctagtgcctctcgagtaagcgcactatatggacacttggacagtgatgcagagcgtggctaaaaggagatggtatgattcttatatttctgctttttgttgtgcaacacattaatttggtctttccatctaaatcgcgtcgatgtaacagactttttattttccacaaagatgaactttcgctacccaaggttccgaccaatttctatggccacagtatttaaaagttttcgcttggtattttatatacatataaggagcatatgtaaaagtgagagagtttgctatctatggaaaacagtagttaaatttactagcatttgcaagttgcaatcatgcatggaaggatggaattgcacattccatatatatgagtaaatttcacagaactacatgtactttaaatcaaattatcgtaaaactatatatttaaggtaatgtgtcacacaactataaatttaagaccaagtataaaaaaactacaaatttaataacaaaattatcacaaaactatagggtatgtagtttacatccttacctctaatattatgtttgagttataattgttcaaattttgtgattaaattggtgtaaaatctgtagttttgtgataactttgttactaaatatgtagttttgcgatattctaccttaaatatgtagttttatgataaatttagtgttaaatttatagttttgtgatatatgttaaatctgtagttttgtgatagtttggctaaaatccatatagttttatgaaatttactccatatatattgaatatattattgaatgttggctcctatcgtgcttttctcttctgagggactcttgtaatgtatatatgtctagattttggagtaagataagtttaaataactctttctttttcgccttgatcaagacattgcatcaattttgtaaaaaagaaaggatataaggaatataattacatccccacgctatatagctataggacacatataaccataatgtttgaataaggtgaatgaagcaaatacattaatgctttccatgaaacacacaaaaaaaaccatgtattttttatcacaataattgaacaatttctgcactatttctttagaaaatcatgcgatccaactagggcctacacgcacatttgcaaacggtgacatctattgccatgtttattctaaacaaataactcttgtttatcaagaatctatgtaacaccaatatttttttaaggcaacaaaccaaacatccacactttaacgaaatataacggattataatgtatcccccctaaccacctctcatttaatttttactcaatattacccctaaaggcccttccactcctcacataccccttctctaataagtggcattatagttttttccctttaaccttaatctctcttagatgagtacaacatagtatttattaattctaaatttcaaaaatattaaataaaaaatataagtaaggcttcaagttgaataaaactctatatctattattataattctagaagttatttaaaaactaaatttagagtgcataattagtcgacatggtattgttaattaattactaattactatagtaaaacgctggataccacgaagggacatggtagcgatcaagagaggaatgagcgctctatgagtcgaacatgagacgtgcccgcgctccacagcagccccttttgccacctgcactagcacgcagtctcacttcctaaagtatcaactatcaagtaaatacattggaacattaaaataataattgataaaggtactaggatgattctatatacaatttagaattagactacatttgagttttgtatctataaatgcaattatattgtttattatatattaaatggtatttaaatataatccccaataaataagataactgattaacaactaatattgttgttaacgcgaaaaacacgcaatggcctaagagatatgcttaactctagtgcaggtccaaagaaattgccttcaggttctcagcgtgctagctggtttgattgtgcaaccaacaagaaagaaaaaggaaaaagttaaatccaccaacgatagcagatcggctggattgccgatgacgtatcttccggagccatgccgatgtgacttgcatcggaccagcaagggaagataaaacgtagagattattagatctacttgattggctgtagatgtcaatgatacatagcctatccaacgaaacacacttagatcgggtgattgggatagatcggatgttatgccgagacagtataaatcactcaatatctaactgtacctcaaagcagaggttacgtaggttcatagcatagttgatggggcaaacctaacgtgtatcggctagtactccgataccgctttatactaagatatcagcgcagataaaatatacaaaacaaagatcaatatggcaagcagggtgcattaacaaattgatatatagaaagcctaatatgctttaagcgaatgagatcttcatataaagggcagatttagacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcgatgcgccgaagtattattgaactgtcgttctgtgattacaaggtgtcaggtcatatttatacccgaagtcagggccggcccttgccctatgcagccaaggcgaccgccgggggtgggggggcaacacctaatactagtaatctagtaccttatccgatgttgagatcaatgatttttattcagaattaaaggtattgcaagtgagttttctaaattcttcgatatgatgtccgcgcctgagattctgaaatttgttatgaatgcatatttctatccaaatgtttcagatgcctattgaattctcttaaccgtacctgtgacggtagcttcagctgagaagtttttcaaaattgaagttgttgaagaactatttgagatcaactatgtcacaagaaaggtcaaatggcttggctatgtgctcaattgagaaggatatatcggacactattgatcttaattccgttctggatgattttgcatcaagaaatgcctgaagaagtatctttacataggaagcaatggatacgatggggttctattcttcattaagttaatgaataatgatattagttccaagtttcaaatatattgttattttggtcgactttatttcttaataattaccaggcatgttaaatttaatatatggatgtattacaagaatatgcggatgggccaaaaaaataaatagtttgggccagaaggaaaagaaacagatgtgagaaaaaggaataagttcatctaaggtcccttaactttcaacgaatccgattttcgtccttcaaccacaaaaccagatacaacgggtccctcaactatcaaaaccggtgcagattagatccctcggcggttttgaaggcggttttggctgacatagcacctatgtggctagtttgacttggtcttgatctgacgtggcattgacgtggcgcttacgtggcaattcgatccggaaaaataataaagcccgtgggacccacatgtcagtttcacatagaaattaataaaaaatg

SEQ ID NO: 10673 - DNA, 11112 bp, Oryza sativa
ccgcccgcggcccgccgccgccgtgctccgctccagccgccccactccaccggcccgctccggctgccgccgctccgcctgccccgctccgctccgcccgcggacctgctccgctccggccgccccgtccttcgcccgctctagtcgtcgacgccccgctccaccggtcagtgaggaaagagaggggagatggggagagaggaggaagaggggtaaggatgacatgtggggcccacgtggggccacgtaagcgccacgtcaataccacgtcagatcaagaccaagtcaaactagccacgtaggtgccacgtcagccaaaaccgccttcaaaaccaccgagggacctaatctgcaccggttttaatagttgagggacccgttgtatctagttttgcggttgaaggacgaaaatcggattcgttgacaagttaagggaccttagatgaacttattccgtgagaaaaatatttgggccaggagacaagaacatccggatgggccaaaaatacagtttgggccagaagaaaagaaacggatgtcaaaaatattaaaaacaaattggcttcgcccggactcgaaccggagaccttcagtgtgttagactgacgtgataaccaactacaccacgaaaccgatgttgtacttcgttgaaaaatttgtttttaatattattttagtacccctaactttagttgctttcagaaataagttctaaatacaaaaggtgctaatactcataattgaattctttcacccgaaattcctatatgctatgcttgacgatcccaaccggaataacgtacacagttttgtccataggataaccatactcctcaagtcccatttgctaaattcagaggtataaaaacagaggggcttgtactagtagtagtagcttgtaacacgacagccaaattacaccagcaactagtacgagtacagcaacaaaagtagtaggagtagtactacatgcataatctcatcggctgcatgcgtccatccgggttcagagctgcgtttggaagatggtgacgtggcgcaggcgctgcgccatgtcggccaccgagcccaccgccgcgagcagcgacacgacgagcgcgccgacgttgagcgcctgcagcgccacccacttccggctgcctctctgcaccttcgcctgcgccatgtacatggtcaccgggaagtacaccgtgagcggccagaacgcgacggcgccgagcagcccgagcacggcgttgaagaacggcagcaccagcgacaccaccgtcgtcacggccacgaacgccgtgcgcagcaccagcttgcacagcgtgaaccgcaccgcgcgcccgccgcccagcggcaccgcgtactcccggtggaagaacgccgactccggccaacggctcgccagccacttctcgtagcacgcgaacaccggctgcgcgtacacctggtacgctccgaccaggtggatgacgacggcaacgttggcgatgtcgacgagccagaacggctcgaggaagccggtgaggacgttcccgggcgcggcgttgccgaacgccgcgtacccgacgcacccgatcgacacgtagaagacggtcgtgacgccgatgccgtacaggctcgccctcttcatcgtcacgttctccgacggcggcgacttcaccgtgtcctggatctcgatgagcagcatggagtaggtgtacgcgaaggcgatgttcccgagcgcctgcaggaagtgccacgccttggtcgacgcggtgacgcctccggcgccgaccctgacgccgaggagggtgccgtgcgccgcgccgtgcgacgcgaccttagcggcgctgaggaagagcccgacgaaggagtaggtgaacgacatgacggcggcgacgacggagatgagcgtcaccccctccaggctcgggcactgggacaggacgacctccgcgaggccgaacagcaccatgtacatcgtcccggacgagccgcaggtcgcgtccggccccttgtagtggtggcagttcgtgcgcaccactgacctgcattctcacggcccaaatcctagtacatgttactgaacaaaaatttgccaagatttttcagggtggccaagaagctggagctaagcttacatgatgctcgtagcggtcgtgatggtgtaacccaccattgcgccccagagaatcgcgtactgcgcaatgccacacacgaccacgtctcgaggcccttcacacgatcgatcaaagcaacagtcttgtcagaaatcgcagagattttgcaggagaaaatgcaggtaagtctcaaaggttcttagctaccgaggcatgagcggacgacgtccatgtaggtgtagttccgcttgccgtggacggggtccggcgtgcggtagcagtcgcagaggaggacgccggtgtagtaggtgatgtaggcgcagacgacgagggcgatggggccgagcacccaccccatctgggccacgctccacggcagcgccagcacgcctgacccgatcacggcggtgatggcgtgcgtcgtcaccgtccataccgttcctgtgaaaaggaaacaaaattcagtttcgtcagtgccattcttgcgttcttgtgagaaaaaaaaaatcctgtgagaatgtctgacaggtcactgtcatttacattacgtgtgacattcttgccttcttggtctcttggaacacctggctgattaagcatgaacatcaataaagatgcagtgcattgaagagattgccatatcagcgcggctaaaaagagatcgccagatcatagatcaattacagtgggcatgatgcaacattgcacaagtcaacttcccagtagtgtaagaagccatcattttttcaaaaggatctccaggattccatcatgtgtcataaacaaagaatccgtttgatctactgcccatgcgctggataccataacgtaaagcagaccaactaacgagtacaaatagagcaacaggttcatatattacgcatgtgatttaatcaccatgtcctaaagcagtaacacttaaaacaactaaagaaatatttgctgtcttacttgtgttaaactaacgaatcatcgcaaatgtataaacagactcttttgaacaacgtaagcacgcacatgaatgaaaacacttatgtaatgctctggtggcctatgtggagtatgatgtggtatcccaaccaacatcaacatgcaaaggaagtatgatgtgaaatcaggcacttgctccctgatgtaaagtactagcagggctaaagtacagtcaaacttttgtccagtaaaattccttaattacaatagacaattgccccgaaatcctattatttgacatgagtgtacttatacttaactggtcattgtcaagactgcttaatggcccgctcttcatcacagcctatgatagctagtcacaactcacaacagtacacccaagataaccagaaaaaggaagtagtagtacaacagaatatgcactatgttttactttaataccatgaaagctatttgtcgaattaggatgcgtgatgtaagtggagagagcacaagctgcaggttaatttgcagccattcatcgatacctaatccattgctccctcacgcgaagaagaaacgttccaataggctattgccaacaaatagtgttttccattgtttctgggattccaatataacattaggataatgattgcacatattgaaattctgcctataatcctggagtattagtactgctgtaccgtataacactagtaaagccaaggccacttggacttggtagggtatatagtagagtagaggtagtgcctgccaagtcattggcgatttggatcttgcaagaggttgcgtgctgtaactatatgggaattaggacccagttcctgcataaatactatgccactaacactgttactatccttcacgttgtcctagtaaaagcagtggtaacagaagcttcacgcaatggatttcgcattttcaggtgttggttttatccaataatgctagcatatacgcaagatgcctctattaaatctatcccgagtttcagggatgttgctgcaatgctgtgacgagtgttgtgtgtaaaacagaagaaagaatatgtgcgtattcgggagtgtagcatctcattagctagacatgcatccaagaaacaagacatgtaaaaggggacaactcttttacatggcatttctttaagataaaacactaaaataggcattgaattcattatatggcagtgtttaataagagaagtgtaaattccctgcctctgcatttgcagtgtgtatttgtttggttcttccagtacggcgcggcgtaaacaaaatggaaaagaagggtttgactttcagtgcccatgcatgcgtgtatgctccatcagacggcttggacagcaaaatcatgcattgactaattccaaatcttttttttttttgcatgtacttggagaagcaaaacgagagagtcctacaaggtttcgaaaggatgcaagacaaccgcatgttccatagcgcgctgaagtctgaaagcgtctttccactgggcacacatctggctagctctcacttgaaagagaggcacaagtcaataaccaccctccaacgtacgccagcaatgcacgtttctgtccaaattcagcaatgacagaggctcgcagatctaccacactcaacggtatgtggtgacaatgaacatgcagctaaactacgatgaacaacggaacagagtttcagaggaaacagcagctaaatactctgcatgaagcatgaactgttcaggtgccttcctagcagaagaaagacaggcagggtagccgtaggatagtagtaggattttcggcgacgacgacgactgtgcaaacgcgaactggaaacagagaggatcctgagaattacctgttctgacgcggccatcgtcgtcgacggccacctccttcctttccaccttctccacgtccatactctctctgtgtacgagtttccctctctctcagtctccggcctctcttatctgagcggaaaggattttgagcgaattctgaagcctgtgcgctgcagctatatatagagctggcgagcttttgcacctgacctgtttcccactgtagattcattcttttaatacggtcacgaaaccccacgaatcctactagtacctcagagtcccctgtagaaaatgaaggttttccacgtcatttttttagtagcaataactaccaccagattatatgcctgttacatttagttgaacctaccaaggtgttcacaaaggtgcagaagttctggtgacttttatgaatctgattagtcaatttgggatgaatctggttggtacttgcctactacattcattccataataattatattcttaagattttatttttcctaaaataattaccacgatagagtattaatatcatcaatcacttattcaattttcccatattctattttcaaccattctctcgtttttatatgtacaccatttaatgaagcgagcattataatctttcttttcaaatcttaatacgtagtacctgctaataaattataattataattattttgggacggaggtagtactttgtaaccacatgattgaaaaatctgaactaataccttctgcagttgagttagtgagcatgttatccgtctgattttggtaatttctaaatatccctgaagagaagacagtgatgctgatgatcattcaggtggtagaaaatgaagtgctggacatatctcagcctctcaggggctcagggcttgacccaaaaggaaagccatcttctgcttcatcatgcggccgccacgaagcacacattgctacaaagctgcatgaatcatgagattgctgctcttctcctctcatctatcatcgtgagatcatcgtccatctcttgacgccaccaaaagaatttcaggttcagaaacaacaaattgtttcttgcgattcactggaaaatcaaacacggctcgtaattcacggccggaaaccatcaaagtttgctgcgtggttccaaaaccatcaacattatgtacaccctgtaatctgcctatatatggattatatttatggatatgtgctgtgtgcaactgtgcaacagcgtgtctttgctagctcgtgccaacgcagccaaacagcctcacgtgtcgtcatatccctacacacagtagattcagggctggtttggtttgaggcctaaattaggcctaccaatatttgacaatttcaatagtgattagtgtctatttggtttgaagccaaattttggcatgccaaaaaaataggccatttcaatagtgaacttaggctattttggcttcaatccaaacgcaactttgccttactaaaattagtcatgccaaaacttaccaaaatttggtactgacaaaatttgataaggcctatttaggccacaaaccaaaccaaccctcagtgacgaagctgaacacctaaagctgggctgtatgggccagtttgggtccaaataagaacaccaattaacgccataaggctgtgccacggcccaggcccaggcccaggcccaacccaatcttacaaaaaaaaaaacaagtaaacaaccccaagccacggctccgagaaatacaaacacgaacacggcacacacgtctacgtgagcccacggggattattgttcgagtcaaatatgttacaagcaaacacgtggttgcatgcggcgagccggcgtgcatcgcgtcgaccggttttcagttcttggcggtggtgaagcggtacgaggcgtaggaaagcgaggcgttgctccagctgcggtggatcagctccgccttggccccctcaccggcggcgccgagcgcgacgtgcagcgggaggaagtggtcaggcgacgggtgcgccaccctgccgtgcggcgccttctcctcgtaccgcttcacgtcgtcgtgcctcccgccgagcagcgcctcctgcagccacccgtcgaactccgccgcccactgcggcaccggcgtgccctcgggccccatcctgcggaggttgtgtgtcgcgctgccggagccgaggacgaggacgccgtcgtcgcggagcggcgccagcgccctgccgagctcgtagtggtacgcgccgtcgcggccgctctgcagggagagctggcacaccggcacgttcgcctccgggtacatgaacatcagtggcacccacgcaccgtggtcaagcccgcggctgtggttttccttcaccggcccgaacccggcttgctccagaagctccttggtcttcatcgccagatcaggagcgcccggcgcagggtacttcagctgtttgcaacaacattattcagtatggtcagatactgatgcgatcatgcaaatgcaacgtcattattcagaagggtagatactgatgcaatgaaattattcagtactatggtcagagatactgatgtagtgattacgttatacgcatataccttttgcttccaggaaatataacgttttccatgcatgatgcatccttttgagcggaatggatttaagttatagtatgatttagtaattgtttggttgcatataagaaaagagtacaaaatctttctattgaaaagttatcatacgccaacaatgaatctaccttcaaccacacgactacaggagcatatatgatggataaatagtactccattcgtcttaaaatataataacttctagcacttaagatttgtcccaaaatataaaaacttcttcactaacattcttttctcaatcaatcacaattcttcaccattcaattttcctacatacctgcacttctctctcccatttaattctgactactttcttaatacttgtgtccaacactaaaaattcttatattctgggacggaggaagtagcacatacttataataatgcatatatagtacctaactaaatacttatgagtagcaactttccttcgacgaaaaggaccaataagctactagatgagtaatcaaatccttatggtgatgcatatatactacctaactaaatattttgtacggcagctttgatgggtgtggtttctccgataacaggttcacccaaattaccagagtacacacccatttttattcgactggcttaaaaacaattgcgtaaatatttactcttggccatcataacctttactagtaatatccacaactatcttatggtgtatatgctagtccttccgtcccaaaatataagctattttggtgaatgtgacacatactagtattatgagataaaatcccttatattttacaacggagggagtaactcaaatgctgaacagagtaatgaaaatgaaactaaatttaattagccatttagacatagctcacagcaaaatccttgctgactgatcgactgaacgatccggcagatgctagtgacaagcgcactttacccacttgtagtagtttggtatgcccattgcccacaaatattccctaattttgctcacagcctcaaacaaaatacacaatgtcatgtctgcatcagatgggatgctggggttggtaaaagttcagatcagctaaacttttgggcatctcttcctactcccatgtttaagtggtaggacctactcccatgtttaataagcatatctaagatgcaatgggacatgtacttcacaaactagcatgaaagatctagtataatactagcatgttttagtctttgattgcgctccaatcagtcccacgtgatataaaatatacaacacgagatacctaaatactccatgcataataatatatagtagtataacatatatggagaagtaatcttcacctttgaccagtttcccctacatcaggcgcggggttatcacaccccagcggtaagtgaggttaccgtgcgatatttgtgacaaaccatacaaaatttatcgaaatttcatttattattttaatttataagaatttgttggggttattgcagtattaccattaccatatccggaggtaaatgcaataaccgtgcaattacggccgattttgtaaacctgcctaaggctatgagcatgcggagaaatggtatcatgctgccatggtgttgcctacgagtaaattcagaccagttgccaaaccaggtttcagcaaccatgtagtgtggttttccgataaccaaggcagaaagatcgatttcttcccatatattctgcgcgatttggaatcaaaaccatccaaatttgacgtcttccctatagcatgtaggaaatccgaatacccaatccttgaggctgtgttcccaacatcttcaacctcgttttccgcgcgctcatttccgaaagtgtaaaatgcccaaagtagaagatgctcgaacaaagaaacgaacgaccaaggtccaattttggcggaatcgctccacgttgtacggccatttctcaatcaagaaacaagggattcgattcgagggaaggagacggacggacggacggaccttgtacatagccttggggaagccgtagaagtcgtggatggtgtcgttgttgccgcggatgacgttgaccgtcggcgcggtcgcctcccagtggcccgacacgacgaggatcgcccgcggcaactccgcgcccgccaccgccgccggcagccacgacttgaagaatccctgcgccgcgatggtgtcgtcgatggacagcgtgggcgcgccgtgcgacaggaagaaggtgtccatggcgccctccgccgcgcgcctcgtcgtagtcctcctcctccccctcctttcggcttcgagggcgctcccctgctgctcgtcttcccccggcgtcggcgtcggcgtggtcgtcgcgcgcgcgtgcaccgcggccgccgggttgggctgcttgctttgcctctgacccatcctcttctcctccttatacggggccggcggccgcgcgcgcggtgcggaggatgactgtttattttgcggtgtttggtaagtttagttggtcgacgactcgacggtctggaccgcggactcggcccctcatttggactttgggatgtcgctgccggcgcgcgcacgggcgtgtaagcagtgacgtaagaaagcgtacttcgctggaggcgcgtgacaagtggagaagcggatttctggaatcggccatggtctggatgttgttggtcatgtgaatctgtgagactgtgatcctaccaacttctctctccttttttaaggaagggtctcatgactctcatcgaatggatgtttggattgatgcttttcagccaaaacccatcgaattgcttattaggctgataaccaccagccacaaaaaatccttatcaagttaaataagccaaataagccaatcaatggtttttctttagcttaaggggaaaaagctaactttggctgatcagctaaagctcttggcttactgatgagggccgaaaatatgattggctgttatatcttgttatacttgtgtctcgcccatcctaggggtaactgttgcactgcgaatgatactacataccgtgttgttactgtatacttgtacaatagtacttcttttttaacgattacactatatatacatacgtgcgcacatattactacacatgcaacaccacatttgcactttcacgaacattttcttaaataaagaaccaactgtttatatctgattttattgaatttttgttgaaggtccaattgcacctactaatctagcttggatggcatgatatatgttactattggctacagtgtttgagaccttgcattgcttgtgtgttggcttcactgtcagctcgtccaatgtaccgcagattattatataggagtagctacttcaatgccaaacaaaggcaaaaaggtaggattgccttgtttcattgctagagaaggtaaaacatcaaccacccaaagaaaagtaaacatcagaacgccagcccaacagacagcaccttatgaacacccaaaacttaacaaaaacagactacagagtaccttaaacaccggacaccaaagcatacagcgaactattgacattcagaaattcgacaaccatttctataaattaccatcgacaaacatgtttttttcctacaaaatatcattgtacaagtgtttttgtaaattcccgttaggttttcatttatagacctccgttaagtcttct

SEQ ID NO: 10674 - DNA, 19004 bp, Oryza sativa
  unsure (1)..(19004): unsure at all n locations
agttgttatgaccagtgtaagtaaaaaacaatcttcagttgtctttcatagatggcaaccctaaacatacatatatatgaaacttacatggcatcattaaattctaaccttacactgttacctgccaaagttatggcctgagaccgggcctttcattgtttaaaatggagattgacagggagtaggaaagtgtcaaatacaggctagctttaaattaagactttctcctccatatgatcaagatgcaaatgcaggtgtaaagggagggagtggtgttcttgctctgcgttccacaggcacctgggatcgtttcatgggtagcacaggtggtggtcagctgacatggtcaatccctgtgcatatccagggtctccgttgtcttctgccccccgacgaggctagttcgtctgctcgattgcacaacatcccctcgagaaatcaaaattcacttccactatgtgagcacttactggattagaactcttgaggggagataacataccatccaaatgattatgaaaataaataacaagacagattaatatgtgatagatcactccacagacatataagttaaaatttagcttctacaagttaaaaaataaataaactatgattagttaacttatattcatagtcaactttatttttttttattgcagctattagaagttgaatttaacattacatatttttggagtgatctatcacatgttattttttttatttttttaataaccaattggatgataggcaaataacgaggaaataccctagaatagttctcctcgcagtcttttgcacccatagttaaataacaacatattgcctaattagctgtcaattttttttgactgaattagctgtcaaatttgcacacgcaaatacggttcagtgatgaagctgaacgccctgttgcttcctaccttgctcggtaggatgggccagttcgggtccaaataaacatagcagttatcatagtgatatcaacgccatgagaggctgggccacaacccaaaccaccatgcatgcaagtttattgcaactgaaaaccacaagacacggccgttaggaaatacaggcacgaacgtacgtctacgttaataggagtatattaacgtagatcccacggagattattaattgttaagagtaaaatggcgatgatataagcaagacatgtttcactctttgcatgcggcaatcggtttgttcttggtggtggtggtgaagcggtacgacgcgtgggagagcgtcgcgttgtaccagctatggtggatcagctccgccttggcatcctccccggcggcgccgagcgcgacgtgcagcgggaggaagtggtccggcgacgggtgcgccatcttaccgttcggcgccttctcctcgtactgcttcacgtcgtcgtgcctcccgcccgcgaggagcgcctcctgcagccacccgtcgaactccgccgcccactggggcaccggcgtgccctcggcgacgggcgccatgcagctaaggttgtgcgtggcgttgccggagccgaggatgaggacgccgtcgtcccggagaggcgccagcgctctgccgagatcgtagtggtacgcgccgtcgcggccggtctgcagggagagctggcacaccggcacgttcgccttccggtacatgaacatcagtggcacccacgcgccgtggtcaagcccgcggccgtggtcctcctttcaccggcccaaatccggcttgctccaagagctctttggccttcttcgccacatcaggggcgcccggcgccgggtattccagctgcatgggatgccatgcatgcattattcagttttttttttaaatttttgaaaggagggaacaagctttgcctcgtgatcagatcacaaggcaacaaacatgatgcatgcatggtagggaaggacgaaacgcgaacagttggacctggaacatggacttggggaagccatagccctcgaagtcgtggatggtgtcattgttgccgcggacgacgttgacggtcggcgtggccgtctcccagtggcccgacacgatgaggatggcacgcggaggctgcgcgcccgccaccgccgccggtagccacgacctgaagaagtgctgcgccggcatcgtgtcgtcgatggagagcgtgggcgtgccgtgcgataggaagaaggtgtccatggcccccgcgccccgtagtcccgtacgttgtgtactcctcgtcctctcggtttcggaggccactccctgctagctgcttatcttatctcgccggccgcgtcggtgtcggtgtggtcgcgtcggcgcgcgcgtcgcgtgtgctgccggccgggttgggcttggctttggctctgcccccatatccttctatttatatacgcgccgcgcgcgcatgggcgcgtggtgcgttgcaacgtcgccggcagccgatgaggcgtgcgttggttgcagatgattgggagtgcgttagttgcagatgattgggtcagccgatgaggcaccatcgtacgtactgtacgtttcacagttgtgcagtagtagttggtcgatatgacttccgatctactactccagtctactagaccgcacacctcacctcaagttgccggcagcaaaagctgcgcttgaacagccagcagctctcgcgttctaaatggatgttaagctttggatatagatagaatatgcatgatggagcaaaattctcacatggttgaattaaattaaatattataaattgctaacaaatagtatagaaaaagtggtctaagcattcaagtagatgtttaaagtggggcctcattcattcgctcaagatcataacatgagctacttcaatgccaaacttaaatgtacgtataatgctagctcaacaacctcactagtagaaaaaaggtcttcccttactgtcaaaatatgcctttcccggtggctagactaaccgctagcgtcgaaaggctagtgaaaatctaaggttttcacaagcaaaactttaacagctagcgataatcgttttcgcttgcggtagtgttataccggccgccagcgataatcgaattccgttagtggcagagataatcgattttggggaaagaaaaagaaaaaacccatgcagctgccctctaaccgccagcgaaaataaatatgcccacatgttgctaccctgcattaaaaaatccatagcgccaaatctcaaatcccaaatccacaacaagcacaacttccaaaaaataccatcacagatcctaaatccacaaattcacacaaaaatttcacatcacaacacaaattccacatcacagatcgagcacaaaaattttacatcacaaagattaagaggtgaggcatcacagatcgagcacaaaaatattacatcacaaagattaagaggtgaggatggattcgttgctcccaagggagggcgtggatggccggcagcggatccgctcgccggcgccggctctgctccccaccgcccctcccacgcgccggtgccgccgagcgccgccactggcccctccccccgtgcctctcccgaggacaggcggcggcggatccactctcccgaggctcgccggcgccagatccgcatctcgttgtcgagaaccaccgccgcttccttccccgcgccactgccgcacctccttccttgcgccgccgcccccttccccactcagcaatggagagtgaagggaggctggcggcggtggagaaagaagggaggctggcggcaatggagagagaagggaggagggatagaggagggaggcagagggaccgtgcgctaccgcgcacttgccttccgtcaccgtcgccgccgcgcgctgccgcttgagaaccgacgtgcgctcgcgttttgtcaccgtcgccgccacaagccgctgctggagccaccgcgcgccgtcgcccgagaaccgtcgtcggagctgccgccgccgcctgtggggagtgagtagaagggtgcatctggagggaggaagaggaacaagaggataaggactaggtggataaggagtggtgggtggtgattttttaatgggcggtgatatttttaagtgtgtgatttttttaagtgcggcgtttaaacgctggcggtaggttaagaagcaatagggttattttttgaaatggacttcttaaccaacctcaagcgaaaacggattttcacttgtggtcctagactcaccgtcggcgaaaatgaattttcactaacggttctaaaccctctattcctcgttagaatttcacaagcggatttcttatatgaccgctagctaaaaaaatagagtaccgtcataaaaaatcgtttcttaagctatggggttgggaacccatctcatctacacgaaaaacagagcggtccgttagtacgttattaattaaatattagctatttttaaaaatagattaattttattttttagcaacttttgttttttttttaaaaacacaccgtttagcggtacatggttaggaaaagcgagagtacatggttaggaaaagcctcgaacgaacacagtcacctcacgctcacagtgacactgacacaagtgcatagccgtatacacgacgacatcatgcggaagtccaagcagagcaacaccgtccccaggcagagcaatcttagtatacctcgtacgcagccatagggaattcgtttttggtcacgaggctttacagtttacagaggaaatgaagtttatctagatgcataattttgactaattgacttggacggagaccccgctgttgaaggtcaagaacgtgcacagtatctcgatccctcaaattcccgtgcgacacgtctgctgcttccatcgcttgctagttacatagtccatcctggttcagctatataacttgatcaatttagagatagtgagcaccaagaatcaatcaatcgagcagaaatttgatctgtacatctccagtcaccatggctgccgccggcagcagcaaaaccgcgagcttgttgctatgcctggcgatgatctccttcgtgcagctggcacagtcctcaccgagcggcgacaaaggcatcaaagggtttcacggcaagaagctcagcttcaccctgtaccagcaggagaccatcaacaagaccagctacatggtcgtcgccggcgtcgccggcgccggcgtcagcgagaccaccacgcccttcggcaccgtctacgtcttccgcgacgacctgacggtgcgccccgagaggtcgtcccgggtggccggcgtggtggaggggacctccgtgacgaccagcttcgacgggctgaggagcctgtcgctgggcaagatcacgctcgaccaccgcggccgccggggatccatgtccgtcctcgggggcacgcacaacacccggccgtccgactgcccggtggtcggcggcacaggtgacttcgcgtacgccgtcggctacgtccggacgtcgccggtgaacctgcggggatcgtcggtcacgttcaaggtggagtttcacctgtactggccaccgtatgctcattacgctccaacttcaaagcactagacaagtcgctgtcttccaccttgatgagcgcgtctgcgtgtgtactcgtttctggcagtccgatattatatcatgcatctgcctattttttttcagtctctcgctgagtagttaatatagagtttgaattacctctgggaggtatttccgtatttggtgtaataaaattcaagattgataatctgaggaattttcatgaaaaaattaaactactacggatgatgcgcttatcggacgcttgttgttcggtgatagtactacttaaaaaagatcctcggatagtcagactttgcagtatacaattatgccaatgagatatgaatcttgagccaattatatcactaacatatgggtattgggttctactttcgtacggttcacatgtcagaaagtcaggaaagcctcatccatactactttcccaattcaatgtttaagttggagatggagaggttgtggattgggatcacatgcagtggctatagccactgcaacttatgcagtcctaaggacatcattggaatataaattaacgtcctagatctttccttgatactgttcacaaatgaccgtacaaagttagtttctgtagcatgtactgtagcaattactgtttaaaacaactgtagcatttatttcagccgttgattgccttgatccaatgatgaaaaatggttccaactgctaaacttgcagtctgtcctatgactgcaccggatctggattcaactctagtcgggcatgcacaactgaaaccgacaacaaactttgttccatttctcaaaccaaacggaaaagttattagcaatgattaattaagtattgattattacaaattttaaaaattgatatatttgattttctaaaacttatatatagaaagttttacatcaaatacactatttagtcgttcggaaaatatatttaaaaaaaccaaagagtagctagctaaaaaaactcagccttggttttttttaactatcatggcacacacctttaaaattgtcgaatggtgtattttgtagaaaaactttttatatataagtttttcaaaaattcaatacattcatttttaaaatttataatagttaatagtacttaattaatcattaatctttcattccattttacgtgtggccgttaatccaggtcaaaaagctagcgaacactgaaagctcccgtgcgccagaaacacccgagaatagacaaccgcacagtaacatacacacggcagcttcatcggttttccatgggcactttcggtgtttcacgattttgcgcacgggttggcccaacccaaaccataccgtgtgcgattttgctatagatttgtcgtgtgattttttctctcggatttgtccttttttaggctgttcgataagtgccaagattcgtgcacatatagcgatgggaatccgcataggattcagtcggacgggttagagcgctaatttctttttttgcgctttaaaaaattgatatgcacgctgttctctctcgttctctctcaattgaaactaaaataaaaataaaatacaaaattacagtcatatataactaaaattatatttgtaaattcagttgatatgacatgtaagtgcattgtaattttgataaaagtaattatgtaactaaatatgtatttttattttcttttgtagtccgttggatgtaaatttaagggtagaaaaaatctgggtgattttttcttagaaatcacctgacaaataaatagacaatccctaccgtgtgtgcttaaacacacgagaaccttcccgtgcggatctagactcccggtaacattctatgtaacggactctttcagacggcacggtggcttaccgtgtgttcgaacagcaataatcaatcaagcagccatcttcatggaaagctagtgagcagcaataatcaatcaaaaggattatttagcagttagcaccacctaagctcaaattcttcttccgtttttctctttctctcggtttcaataggccaacacgggaagctagtgaacagcaataatcaaccaagcagccatcgccatggcagctaccaacacggccatgagcttggtgctgtgcctgctggtaatgatcatctgctccacgcaccggttgctgcatccccaaccccagcttgcggcgacggcggcgtcgtcgtcgtcgtcgccgttctcgtcacgcagcaagataggcaaggacatcatcgacaagacggtcagcttcaccctgtaccagcaggagaccatgaacaggacggggtacgtcgtcgtccccggcgtcgacgcgcccgcgcccgcgagggtcgtcgtcagcgacgccggcgagccctccgccgacaggcagcccttcggcagcatgtacgtcttccgcgacaacctgacggtgcgcgccgacagctcctcccgtgtcgccggcgtggcggaggggacctccatctcgacgagcttcgactgcgaggacggccggaggagcgtgtcggtggccaagatcacgctccaccaccgcggataccggggctccgtgtccatcctcgggggcacgcccaacatcaccaggccgtccgtgtacccggtggtcggtggcaccggcgacttcctgtacgccgtcggctacgtccggtcgtcgccggtggacacgcgtgggcggactcggacgacgtacaagatggagcttcgcttgtactggccgctgcacgcctatttcgctccaattccgtagtaacacatcgatcaacgttcttccattcgcgtcttattccaactataattccatgcagaagttatttttggagttaatttgatacatgaactaagaaagatttaaatgattttattgccctataaatattattgtacatttcaaatggtgcattgatagatcatttattcatgaggcacaatattgactaagataatgtaaggggaataaaggaggtcatatgtgatgaggtaattaatttgtttccacgtccattactcctggttaatatagtgatactgaaagttgctcaatccattccaaataattgacaccggcactatttaattttaaatttaaccatcttttgcacaaaaaaaaaagaatacatgaaaaatatggtatactagcgaacaatgtgctgtcaaaaatattatcatacaaatttctttcatcataatataattatttaaaagtatttatggttaaagtgaaccgactgtagtcaattatttgaagaacagaggtagcaaattctgagtttaaacatgaatattttggtatttagattttaccataacatttaccacggaaggttaaatggcctcacacctctttgtgcactcttattatatagattctgtttctattttataaatcggcgggatgctctaggatttacttggatggaagttcaaatgtggggcagacacaccaagggtgcgctccacattatatatgttttgtacaaactttatcatttgttgagaaggaggtggtatggactcacaagaagtgtgtgcttttataggtctggtaataggctccaaacattgatcgatgaaggatttgcacatccattcaatctaaggacttaaatctagctaggcgaaacgagatgcacatcttaagttatgcttagctcccccaattattttttacattgaattgtacattcaagcctgtttttctcgcatgtttccgtatttcaaaagtacggtcgagttgttttgtttgcactaaataaaagtactgctcccaacgttcaaatataagaatttctgcgtgtttcccaaattttgaaaatctcacagaaaacacatatattttggaatggacatagtactccgtagtttcaaccgtacacttctctacaaattttcccagtaaaaaaaactcaactagcatcaacggtagcaattaggtcgaaaactgtgatacgataaaaccatgttacatggatacacaataaagatatggctagtattggactagcgacctaaggtacctttttttttctggataatctgtttggatgctcacctcattttgccacaattttgtgctaaaagtatatcaaggtataaattgtgcggctccaaaattaatggtcatatttgtgtcaaactttggctaagaaaagagcctatgatttgtgggaccaaaagataagaaatcattgcatgctaaaattgtagaaaccaaccaaacactagccatattttaccacattttgccatataatagtcaagagtggtaaaatacaacaccaatgaagcatgctctaaacacttgaatgattttgtaattgttatttaagggtccaaacaaatcaattgactattagaagttaaaatagatttaaaataggcttttaaagaaatttatgtaatcaaatttttatgaaaagttaaacatgaagcatgtcatattaatccatgatacccaatgtgatatttgcccattgtagtggggcctgtctgtaaatatcattgtgctttaagctagtttaataaagtatatactttcttcgtctaaacaatatccaattatagagatataaaaaggtgacaatatcatctgaggcttttggtctcagttagtcttgcaaaaaatataaaaaaaatgcttttgaagtttttcacaaagtttacttttatattgttaaaaacacatatataaaaaatttatttataaattattttttatttataaatataccgtttgtgacttaccagaacaaggagagaagagtctgttcatcggtccatcacggccggacaaacctcgccgcttcgcttcgcttcaccctttttcggttcgctctagctcctcatcccgttatgccttccccacctgccgctaccccacgcccccttcctctccaggtctcccccctccccttgtgcgacttgtgtcgaacaccgcagccgccacccgtagacgcgacctcagcaaccccacccacttcctctccgtgggcgcccgccgcgcgtcttgcccccagatccggcgcccaccccaggtaaaagccctcgcccgagctccgttgctcccgatgcgcgcgtgcagggagggatgggatcaggggaatgggattgggggtttggggcggaatggatcagttgaatcggctgcgctagtttggaactcgaacagcttgcagtaggataggtgggttgaatggtcgcaggtgttgcgcttttctgatgcggtttcgtttgctgctgctgctgtgtgaaggtagccggttgttgcttgcacgcgtggatcacttacagaaccatgcggcggtaggaacttgggcaagattccagatggttcgcttgtttggtgagctcttgtagcattgattgtgctccgttcgatttcattttggtgcaatccctagcactctaatttttcttgcttggaataaatggtgtaattattagactttatttcagttattaaacttacaatgatcgatagttatagttcagtacttcggttaccctgtttcactgtgctgttttgacttctgttatagcatgctgaaaactgaacttgccaaacaggcaattgatggggactttccttttttgagccagcaattataaacttataattattgatagcaaagttcagtattccagttactcaatttcatactgttcagaatactggctaaataagtcaattcatgttgttctagtcttgtgaggcttccttttctcctgttccaaactattgtcacggttttcctcccgatgtgcaaacattgctttgttttcacttaaatttatttgactcatcttgtatggttagttacattttaatatggcttaaaaccataacggatcattactgcagctttcttatgaggattaataatgggagaatgaagatgaggaacaaacaacggaaatcatctgctctcaactttgatgcaggatgccgatcttccttgtcttttattgtatggagcttggtgggagttgccctcattgtttgcttcttttctgttgtccgtcaagcagacactaggcagaaccatatttatttcagacatctatctgctaccagagagttagaagagattgaggaggaacatttccgcttgccacctcctcacaaggttaatcctcgtgcagtgaaacggcgggggcctcgcaaggctccaaaggttattgatcaatatctggatgagtcatcagcagtgcatgccttgttcttccctgatgaaagaagtgcagtgaacccaacaaaaggtggaaatgacagtatgtacttctatcctggtagggtgtggctggacactgatggacatgccattcaagcccatgggggtggtattctgtatgatcatatcactgccaaatactactggtatggagaaaacaaagatgggctaacctaccaaactcaccccaagagtacatatcgggttagtataaattctagtataatatcttccttgttttagtgactggttatcttagcaatttgttctgataccaaaaaaaaaaaggtacaacaatggattttgagacaagtctgtggctgattggtccttaagtacgtatgtactgataagtggttgtctttataattttccaggttgacattattggggtaagctgctactcatcaaaggacctatggtcatggactaatgaaggaattgtgcttcctggagaacctactaatttcacccatgaccttcataaatctaaggtgcttgagagacctaaggtgatatataatgatcatactggacaatatgtcatgtggatgcatattgatgatgcaaactacaccaaagcatctgttggtgtagcagtcagcaactctcccactggtcctttcacctacctctatagctttcgcccacatggatttgaaagtagagacatgacaatcttcaaagatgatgatgggtcggcttacctcttctactcttctcgtgacaatactgagcttcatgtcagtccattgacaaaggactatcttaatatcacggtagcaatgaggagaatattaataagacggcatagggaagctccggctgtcttcaagcttcaaggaacctactacatgatcacctctggttgctcgggttgggctcctaatagagcattagcgcatgctgcagaatcgatcatgggcccatgggagacattgggcaacccatgtgttggaggcaacaggtttttccggttgacaacattcttatctcaaagcacatttgtgcttcccctccctggcttgcctggtacattcatcttcatggcagacaggtggaatccttcaaacttgaaagattctcggtatgtttggttacctctgttcattgggggattggcagacgaaccgttggattacagttttggattcccggcatggtcgagggtgtccatttattggcacaggaaatggcgcctacctgaaagttggaagggttatacctgaattttgccctacgcacatgaagtacatacaaaaattacagatgatagatgcaatcatggaacagacatagtttgaagagtttggtgattgttccgaatatttcttgagatatctagtcagtgctttcgtaggcctttttgtaacgcaaaaatagtctgtcaagaaaaattgtataacagtgcagctctcaaaacaaatatttgacttgctgtaacatcctccaaaaagaaagttgaaatagcttgagcgtgtgttcatcccgagattatgctggtaacaactaacaggtagtagtgtttctagttactgtatccgttacatgattgatcccaatgaagcagaactacagttacgcaggcacgcttgaatgtcgaacctgtgatcacacatcttgtttaacatccattttcttcgaaaactcaactgattgaatgcctgaatctgataaactagtctcgctggggattgtttatgttgacaagcagccaacacacatgaactaattcatgaatacttgaagccgatggaaacaatgttccatacttcatagttgcatgtgctactttagtacttaagtcatgtcaaaatattgtcaacctcagaaagaattgacatggaacaacagatcacagcattaacaaaagaacaacaaatgactcggataaattccgttggtgatctaccgcttaagaatctaccagattgggaaaaacaaaaactgcctgttaattgctaaagcaaaaatttaagcagtatatgttgagtaccagtgccataatataacatcatttccccaaaatagctagagctgtttcctcttcttggtctttgaccaactagatgcatgtttcttcaatttgtgaagtattgttctctcgctcacccgcagcaccaaagaatgatagagattcctttcgttgacagaagagcatgcttgcagtttttgcctgtcatcttccaaagtgtttgaaccatagaggctctccctcatgtcaacaagggatacaagtgcagaacaaacgctctcattaagcaatagcttcttaacatcaggcaatttttcaagcccgctaatatctggatgttgattggagcttgttactctgacaaccttaagcacactactaatgctgtcgacctcatcatcaccaatcagatcatgagccacgctggccagcttgtcataagcatcagacttcaaggagatgatataaagcaggatcaaaagttcaagctggggctctccatcatatgaaatctcaaagtagtcagcatcttggctggtgcaacctgaatagcccagattatgccagagtgatacccttgctcttgcatatcgacgggagtacttagaagagcaccacttagtaaccagagctaagtcgatgttgacgatgtcatatgagttgtccatctctgtgaagccatatcgatgaagcaaagcagcatttcccatggtaccgtatgtgttaaaaacctacagtggaacaagaggaaacataaagttgcctcaaaacaggaacctaactgatatctaacagtgatacattaagcaatactttggacccaaataaaagatggtaagcacacaattacctcctccccttcattgacatctctcacaacaatcatttccaaatcttcatcgtcatctcctacatagtatgaacaaaacaaccataatgagtgaagctcaaaatcaaccaagtacatgtctaaataaggtctaatgatgttacatgcagatggtcatggatgtaacctgaagggatgtcggcagaattttctatagttgactgttcatcagcagaagcattgtttggatcttcaccatcttcactatctgagtccgaggcttctaacactgaagtgaagtggacatgttccccaccagtcttgtggttaaaactgaaacaaattggatggagggcatttccatattaacgctcagacttaagaccagcacaaatacatcatcacctaagtatgtgcacacctgatgcattgtttccaaataaccaggtaaacgagaaataatctaattacatgagtagattgtaacttacaggtcagccaggggaaccattccagacccatgatagctatctattcggaaggacctcgacgaaagtagactcttagcagagaaataattctccaggctaaaatcatctgggtcaacctcaagttctcctgacaaaatgagtggctcaatacactctttccagtcctcacatatgaactgcctgtcttgcttcactatctgcctagaaattttgccgtttttagagccatcttagtgatcagccaataacgcaatatgaaacatgaaatgtgtgcaacaggaaagtacatcatatgcataattagctcgcattatgctgatttgaaaaggaaaaatggccatagttgtaactccagggagccaaacattgcaagatagatcaatttcactgcctaccatcgaagcatcaaggcagatacaaatcgtggaagcattgcaacttgttactacaatagaagggctcaccttatcgagctcggtgccggccaggaggcgctcggcctcatcggcgggccagacgagcggcacgggctcccgctcggggatcaggcggaggtaggcgtcccacggcgactcggcgccgcgcgcgcgctcatacatgacggcgacggcgagcgcgaggggcccgccgagctccgcggcctcgatggcctcggcggcgccggaggtgcgcggggtcaggcacgcgccccgcgggatggtggccacgaggtccccctcccggagcgcggcgagggcgcgcacgtagacgccgccgccaccgtcctcggcggcgtcgaggcggagcgcgttgctgcagacgacgccgtggtcccgcatccaccgcctgaaggcccgtaggcggctgcgcggtcgcggaagggtcacggatcgtagcgcggcgggggagcgcatacagagaagagcaaagcagaggatcttaccgtgcggtggaggtggaggcggaagcttccatggctggcggcggcggcggcgtcgcgaactcgcgaccaggttttcgttgcggaaatcggtgaggcagcaaccgcgctgcaggcccagcagaggcccaccaaggcctgcaacgcgtgtatgttaacaacccttttctctttttttttttaaacacgtcaatatattagaaggaagcagagttatacttgcacgatgtaatcggccagaggatcattgccacgaaaaataggaaaaacaaaagactgttaagaaaaaacgctactcttatataaagggaaaaataggaaaaaaaaaacaaccctcttcttctaaactatgtaatctcgagaacaacgaaattcgatacaatctcaaaagaaaaaaaaagaaattgaatgagaagaagtagaggaagtttttaaaagtgaaagtgaagaagaacaagcgagagagagagatagagatcgacgaggttgaaccaaagctgccaccgctatgcctcgttaggattggtgtatttgcttaccaaggacttgcttgagaagcttgatcatgggctacatcatgggctgggctaaccaatcaacaggaagcctagtgggttcttaacagtgtagtttcccttttgcctgaacattaaatcgcaggtgagagatcggacgggcaatgatggccataattcaagtttggccgctgatcccaattgatttttgccagcagcgctctgtaatgtgcgtgcacctgctgtaactttctgcctgcaggcggccgcccacgccaaaacacagcacaggttgaggtagtactcgtatttgtttcgctgtctttcgctttgctggttggttcgtactgcaaacttgaactcacaccacaggtggtggctttaactaatgccgtgcatcagttgaacaagcatagagtagttcgcttgctcttcagcttgtcggccgcaattgaaatttaaattttaaatcttaattttaaaattaggtttcgatagtttcatcatatttttttcacgaatacgtaaaaagattgcagtcaatatattagaagaagaatagcagagtttagttatacaacgcaatcggttagaaggccgttgccaatggtcaaagaaaaaagaataaatacagaaaagataagctcatgtaaaaggaaaactacaatcgcaaaggagggtggggtaagggtcccactacactccggcctatcataattttttttcaatcaagacttttaagtcatcaaaaatacagataaaaagttatttacttacaaatatacaattagttgtacgtgaaaatataatcgtaccagcaacaaaagcatcttaatgtagccctttgcatgttctactttcagcagtagccaatgcaagagtactactgcctttagccatctgtgaacaagttttcagatagctaaaaaaaactcagggcccctttgaatcacatgaataaaaaaacggaggaatagaaaaaatatagaattctaacatgaatgtaagtgtaaaacagagaagcaaaacacaggaaaaacgtaggaatgaccgtttgattggaccacaggaaaaactgaggaatttgaggagagataaagactcaaaggatttttccatgaggttctacctcttgttaaaattcctccaaaacttgaaattcatagggttcatttctttgattcaaagggctttgtaggaaaaattcctataggaatgaaatcctctaagggcccctttgaatcaaaggatttatgtaggaatttcataaattcaaattctatagaaaattttcctatttggccctttgattaaaaggattaaagctttccaaatcctatgaaattcctatggaatgacacattgcatgtggattttggagaaaatttactaagagctctaacctcttggaaaatttcctttgagtctatctctctcatccgattcctgcgtttttcctgcgctccaatcaaatgaccgtccctatgtttttcctgtgttttgcaatcctctgttttacacttcaatttctgttagaatcctgtgtttttcctattccttcgttttttctaccctgctatttaaaggggctctaaaattcctataaatttcctttgaatcaaagcggcccttatactttcgcccgtttaaaccagcgctagatctgccaggttgatgctcgcaatgtggaaggtgtaacgcaaacactgtaaatcagtaatgatattacagtagcagtgattaggcgaaagtacagtgctacatgcacgagattaggtatgcatggttaccgaaggtacaacccctgctgcctcctgccagcgaagtaaaggaatcagcaagaataaaggggggagcgcgattagtaatcaccaacttttgcaatctgctgcagcaaatttatacacgctctgtacatgtagctgtggatcagcattaaccatggcgacaagaagacaagcgctagaaaagaagaggaaaggcttagctgttgttgacaatgcgctaattaattgatggatcttcagcaaggcgagctccaaatgcaatgcagccatgttctgatgagatgacgcagtagtagagattgaaggcaaggtcccggatggtagatgaaactgtggcagcagatgtcatatcatttctggattcactcaacaacactgatcaagctataggtgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10675 - DNA, 23529 bp, Oryza sativa
gcgtgtgtactgcttgtcagaggtcatttccggctgtagattagccctcattgtaaaaagcatgtttcttttcttaggcagagagaggcccatgtggtgatccctaaccagataaaaaaaggaggctcaggcctaaggagagaaaaaagggggggaggtgagaggctggcgacttgatcggagagcctgaactctctctcgctctcgagctctctggctctggagctctcggttttccttcacacacagatccaccagaacacaggagtagggtattacgcttctcagcggcccgaacctgtctacgtggcccgtgtcttgtgcgctttttctcgctgacattcctcatatcgagggcgaagaacctcacttagcgcccccggccgaaccggcaaaggggggcctgcgcggtctcccggtgaggagccccacgctccgtcaatcatgtttgccacggttagaaaaattaaaattactcctgtgaaatgtatgataaggcaatggttagaaagtataaagttctctgctcctgttgagtgcacttctttgattacttggatagcaaaagggctaggggtcgttagcaaccaaattgcttttatctcagccgctcgtccgtgtattgatgaggcttatctagcgcaaggcaatattctgaaacatggagtagatggatctttgatttactttttacccagttgtacaaatgaaatcccgttgccaaccgtatagatgtatgaggcaggttgggcaccaaccgaggatgcacccggatggacctaagctccacgccatagcatcggagtctcaacttgggcaagtgccagtgaggaccggtggcatgcgcctcatgacatccaatggggggacaatcaacctcccagatcatgtggtgtgcctccatctctaagtgaatggtgctcaagttcctctcgttgggacttgggtgaaatcactaggagaatggacacccttgatgtgcagacaggggagatccagtacaacctcacggaacacatagctcaaacgtaagaatggcaacaatctgctgatgctcagttcaccaacatcaacatgatgcagcaacagcacgatgacctacaagcgtactttcgctttcaggggttcaatccttatcaaggaccctgagcgaaagccaagcttggggggatatacctctccctccactaaggtaacttgtatcacattgtatatttccctttccaattgcatatttgctttccacttgcatcttataaaacttgaaaacaatataaaaatttgcaaaatagaaaataccaaaaagataggataggtttaagtcatgctaggtaagacaagctagttctcttcgttgaaatgatgaatagttgctctgttctatatctctgatatatgggttcttggtaaatgctctctcaaaggttaaatattagtagccaacaattatccgggaacctgaggtaaatgagctgcagttgctgatctaagtctaagttgttgcgagatatgagatagtaaatatgagttgctatgatcctgatactagtttgactttcattcaggatgttttgtttttcaaaatgataaattgagagttcctcatttgatataaattcctaccagagccaaaaatgtgctatcatgattaaaccatatacattttggttgcttgtcattccattgaactttgtcaaactcttgtgagttgtgtagataattctcatgctctatgatcaagatcatacacccacatatatgcacatgctaaactcctacactgggagctaagcaatattccattccatttccatattaccaccaaaataaattctccatactttcatatgttttcttctcctaaaaaaatccttttgaaaaagaaaaaaaaaagagagagggaaaggcatggttatgaaaaaaataaataataaaaataaagttatgctccattaagcatgagcatgacactgaaaaaaaaatgtagccatgccctctcctaatcaataaaagaatgattttttgggagaagaaagtaagcacaaaggagaagctttttctttattttcctttatataccatttccatcatataccacacacacatattgcatgatcttgatcttgagtatgtttagtcatttgctttagtctaagtttttatttagtaataaaggcgaatgcaagtatgccatgtttgatccctaccgagctccacatatcaagccttagagtaggaatcaaaaaggcaaagtggtgaggaattcattttgatacacttagagagactgagtgaatcatttgaggaactaggctttcttatgcaaaatcatttgaaaacttccggaataagagttgaataatgattgggtgattggtgctctaattgttgttctgtctttcaactgcccaaggcaaggagaagcagtgtctcgtgggaatcaggggtaagggtaagccaccgtaccaaagattatttaatctgagagagagtacatataccttgcacctatatctttgagatatgcagcatagtagcaactcctgatcaacaaccaagtctttgtttcctttcgtccttcacttgggacgagcaaaggttcaagcttggggggttttgttgacggttgttatcgatcagttttgaccgtcaatattgccaaaatatagaactagtaatgcttgcaacgcatatatctgttagaataataatattccactagtattaggtatactaaccttttgcagacaatggcaataaagtggaggagaatcgacatcaactcagacgataaatcaatcagacgttgtcgataaccagacttatgtatgaatgggccacaaactcagaattgacacgatgaattgggccaaaatttacaagtctacatagtgaagcaatagaggaggccgccagccgaagatgggccgggaagacccagcccatggttcggccgaacccatcctagcaccgttggatgcaaggtttggcgtggacgtccaggattgcatcccaatgacggttggagggcacttcggacaattccccttccacaaccgtcataactacctctatataaggacttcaccttctcacttcactcacacacttcaagtaatagctctctcattcccctcaagtttagtttagtagctctctcattctcatcaagtttagtttagtagtatctagctggtggaataggaatagagtagaaatcaggagtccggagccttcggaagagttcaggtatggctctagtagcttttctcttctcttttgtaagctttgtaattttattagaatactcttttatataaatttatggtattgaaatactttccgagtatatgagtacctactttacattatgttcatgttatactgaatatacggttagcttatctgggagatgctttggtgcgggtataatgtttgcttatgcaattactctatgtcatgacgatgatattagagtagtatctggtagtttaggcgtggtgtctaaattacgggatatcattatttggggttatatattgcggatgagaggtgggccgctgatggtgacagctcagtacgggtattcctccgcgccggtatataatcttaagttaattccctagggagggtattccttcgtatttagccccagttgtatggtcatgacgagctgtcgtaaggaactcggtagtcaggggtggcttctcgaagtacaaagagggcatcggatagatggtattagctagtatatcggttaactagaatgtatgtatactatgtatattagaagtataaaaatagattttcttcctcttttctttccacttagcttagatgatatattatgagaatgagtagtgaatgcttgtgtatcactctacccttggattatcttaacccctgcttagaatatgatcatcacaagtaatatataaattattagtcaatgttctctctacatgatcttcccacgggataaaataaatacgataccattagaatactctcgggtgaaatgtgtttctgcggatgaactctgtaaccataatatatcagaagtatttctgcgccattgctgggaattatatttctagtaatgtcgttaagaaataccaacaacaaacacaaagaagagtacaatgaacacaccaacaacctttacataataggtagaccataacctcaaatgcccatcaaacaatcaactaggctaacagctaaccaatcagtagcaaagatacctttgtggccactcaaaacaaacattatacaaaacaaaacattaaagcatgtcaaccaccataaaaactttaagcaaacataataacatgataatgcaatcattagacttgtacactcgttctcaaagcatcaagcaaacattccatcgaaatatggtttcatctatccctcacagccttcttggaacactcaagtccaaccccctattatgatattgtgattggctgaaaatatcatcactaaaaagagcactcaaacaaatatccagcctagcaagtagttaagatgcatggcatggtggctagtccatctatcactcaaatatttttctcaaaatggatagttgtgaccctaacaattgagacagaacaatagaaggcactagcactcaacacacatacattgttttattacacttactatgtaggaaaagaaaacaggcccaacagacaagagcaacaacaaaaacctcttagcatcgtcatcacatatgaatacaaaatcttaatgatatacaaataaaaacatagtgaaaggcaacacaagatcacacacatacatacaacgccttaatgatgacaaacaaccatggtgaaaaattaacacaagtgtacttgtacaaagcatatggaaaggtaactctatttacgcagatgagcaacgatataaaccacatcagggtaccaatacaacaagataaggaacatctacaacaggcattaagaaatatgggaatcataatcatttgcaatacaaaaataatagttggatgcaagtcgcaaacccacagccatcctatatgtgcatgtgtgtcaagttaatcattgttttccctagaatctaaagcctacactctgataccaactgtaacaccccagaaattcccaaaagcctgggatgccactaaagaaccatacgaccatgtgaaaatgatgaaatttttacattagattctttttgttataaaaaaattattgtggaagcttcgacatatagatacaaggatctaagatggcaacaatctgacacatatgaacaaactaagaatggtagataaaccatggtgaatatctatagtatttaataaatccactataacaacaaactctaattttaccccctaatcacaacatttataaactatgtgatatcataatgtgcagcggtgtagctactcccatccattcgtgcaaacatatccgaccgagtacctgaaaaggctataaggtggtgagaataaatctcggcaagcaaacggctttgacaagctatttaaaccatagattcattgtatagttaattaaatatcgagttatgattcacatgaaaacaatttgaacatccaagcactaaaacatcataaccttatcaataaaatccacatcctcacaaatcctagagaagaaaacacttctcaaagatgtcttcgactgtatgatttccatagcatcctgcaatatgtgtgtatgcaatgcaatgatatgaactactgccttcacacccaacaaggtgtgaagctgcatcatattacaacaatatacgatgatgtaccggtacggtcgcaacaataggttcgtagcataaatccaaatccaatgcaaatgtgacgcgaatgtaggttgaattctagagtaataatacgacaactgcattcctacataggagaccaatatacataattatctccaatagcataaagcataaccataagaatgtaaatcaataagtatgactcggataggtaaatcctttgtataacatataaaagtatcttggttgatgatatataatttcaaagtagaggtagaataaaataacaagtcaaagcggtagcaaaccaccgctacgtttacttgcctctaacaacgaagagacaataccaagcatcaccacctattcacaagtcaacctcagcgtattcactaaaacacgcatataaagtaacgacaaaagttgcacctactgcctcatcccaccaaaacacaataacaaggaatgccacttgaactataaacaatattactacttcaaacctttatatctcaaaatataaaaaggctatgactgcaaaaaaaatacattttagaaatctacaaaacaagacctagttcttttatgtagaaagcacttttttgttctgccatttaaatggtctaattcacacttgaatgcaggcttcagaatctgtacagaatttcagaggatacatagaaaacaactatatccggagttctacccatccgatcaaagtgtactttaccaacatggaaagctcacagaaaactctaaggggcctgattgattccactgtttaacctctccaaaaacagttcaatctacaactatctagattttgacaaaaaaaagcaatagtcatactcaaaaattcatatcgcttattccacttgagataaaatcattccctttggtcagaagatagatcacgatgttatctacaacgtttctgtggacactttgttcagaatatatcattttgaccatgtaattgatggaaaacagaggcactataaatctgcccagcctagctagaactaccaattcgattcacaatgtccaaactcttctctaaccgtctttaaccacgaattaaaccactaaattcaccccagaactgatgcacaaggggataaacctcacctagggttttccttttatatcccacgggaaacagcggggaaactccgatctaacccctccttctactcttctcctcctccacgttccatttttccactttgcttcttgatccaagctatgaaggtggagatctagggagagcaaggtctgctagagaggagaggaagcaaaactaagtataggaggtggaggagtcacaaccggcgtcatgggggaagggagggggggatggttcggttcctctcccctagggttttaggtgggggtaagggatttggctaggctcttgggccttgacccaagctaacttgcccacttacaaaggaactttattcaactaattgtggctatcttaataaaccaaaaacattatcttttatttttttaggggtattagaactatagagcgagactgcagatatatactttttatgttaaaccatagtcctcttaaatggtttaattttgatgaatatgattatttgaaatgatcataaatcgattggtaaaatctatccagtgcgtgtgcactgcatgttcttatctagtgacccttttgtgagccgtctgaatcagttgatgatggttgagatatatattcatgggtgttgtactaaccaagagacaaaaaggggaccacttgctagaatatgaggaccatatgctatctaccagttgtcatagcaattcacttgtattttttagatctgtttgaaccaccctactctacttaaagagaaaattccctgtgtacccctgaaagttcacctaatcccttctataccccctgagatttgctcattctctcccatgcccctaaatttcagtttggatcacttctataccccttccgtcaattgaccgttagttgaccgttaaattcacatcataaagtctattttaccctctagtatcaagaaaatataaatttataaagtatattgatggagtgtataaatttattgtatgcgactattatatttatgagtttatttcgtgaggtattatttgcgacggagcggcggcggcaggcgtcagaggggcggcggagcggcacggcggtgtggtcgtggcggcggtgcagggcgtttttagctggtgcgggagcgggcatgagaaggggaggcgcgagtgcggtcgtgagagggggaggcgcgggtgtggtgtctatacgtatgtttacgttggcttcaccatcaccactacgaatttttttaagtagtaaagagtaaagatagtgaggaaaaaaataatctatactatatagtatgcatgttagcttagtcaatactcaatagttagcgatgctattaaacttgctctaacccgatgagtgttaatgagtaatgaccggcacaacacgctagcacgtgcggacgaattgcgacgggaaatcaccatggccgagcttcctctctatctacttctccttgctctgctggtcgccgtccccttcctctgcctgacccgttggtcgctccggcatggcggcggcggcggcggccggctgcctccgtcgccgtgggcgctccctgtcatcggccacctccaccacgtcgcgggcgcgctcccgcaccgcgcgatgcgcgacctcgcccgccgccacggcccgctcatgctgctccgcctctgcgagctccgcgtcgtcgtcgcctgcaccgcggaggccgcgcgcgaggtgaccaagacccacgacctcgccttcgcgacgcggcccatcaccccgacggggaaggtcctcatggcggacagcgtcggcgtcgtgttcgcgccctacggcgacgggtggaggacgctccgcaggatctgcaccctcgagctcctaagcgcgcgacgcgtccggtccttccgcgccgtgcgcgaggaggaggtcggtcggctgctccgcgccgtggcggcggcggcggcggtggcggcgttgacgaccccgggggcgacggcagcggtgaacctgagcgagcggatttcggcgtacgtggcggactccgcggtgcgcgccgtcatcgggagcaggttcaagaaccgcgccgcgttcctgcggatgctggagcggaggatgaagctcctgccggcgcagtgcttgccggacctcttcccgtcgtcgcgcgcggcgatgctcgtcagccggatgccccgccggatgaagcgggagcgacaggagatgatggatttcatcgacgacatcttccaggagcatcacgagagcagagccgccgccggcgccgaggaggacctgctcgatgtcctcctgcggatccagagccaagacaagacgaatcccgccctcaccaacgacaacatcaagaccgtgatcatcgtaagccgagctcagctcgatcagctacctccccacttaaaaagttcaatttcctcttctttttgtgcaggacatgttcgtggcgagcagcgagacggcggcgacgtcgctgcagtggaccatgtcggagctgatgaggaaccctagggtgatgcgcaaggcgcaggacgaggtccgacgagccctcgccattgccgggcaggacggcgtcaccgaggagagcctgcgcgatctcccctacctgcacctcgtcatcaaggagtcgctccggctgcacccgccggtgacgatgctgctgccgagggagtgccgggagacgtgccgggtgatgggcttcgacgtgccggagggtgtgatggtgctcgtcaacgcgtgggcgatcggcagggacccggcgcactgggactcgccggaggagttcgcgccggagaggttcgagggcgtcggcgccgccgacttcaaggggacggacttcgagtacataccgttcggcgccgggcggcgtatgtgccccgggatggcgttcgggctggccaacatggagctcgcgctcgccgccctcctgtaccacttcgactgggagctgcccggcgggatgcttcccggcgagctggacatgacggaggcgttggggctcaccacgcggcggtgctccgacctcctgcttgtccctgccttgcgtgtgccgctccgagaccatgagcgatagattgctacagtatcatttggaaatggataagacatacagaaaaaaaaagaaggatcaactggatgtcatcatgtcatcagtatatatacagactcatactctcatttggtgatgtttcaagtgttatctgtaacttttaaattactgggttttgtcatcatgtaacatatttaacctagcattgaatttgtggaggggaatgagtaactcaccagcggtggcgacaacgactttcagattgtagcatcagcgtgttaaaactccgacagagaacttggaattccactacaagaaacttgttaatccatgacgaattcttggtgacggattcataaaccgtcactgacagaggcaatccgtgacgataatttgttttccgtcgtggacgtgcactagtggatattcttggcccgttaactcgtgacggttttatccagatcgtcacagtgtgtgattttaaaatcgtcacagtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctccttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatgatttcaactgaaaaagtcatcaataacaaagttatataaatcatcaatatctataacttttattttggtcatttcttcatccgacaaagtaatagtaacattatttataaaatttacatatctctctcatagtttataaactgtataagagatatgtacattttgtgaataatgttacaattcgctttaacggatgaagaaatgacccaataaaaagttatagatcttgatgagttataccactttgttattgatgacttttttagttgaaatcatttagtatttgaaaatgttgtttgaaattgtcataatttgaaattcaaattcatattgttcaaaccaagtcatatagaaaaatgaccaaaacaaaagttgtaaatattgatgagttgtacaactttattgttgatgactttttcagttgaaatcatttattatttgaaaatattgtttgaagttgtcataatttgaaattcaaattcaaatttttgatacaaagtcatatagcaaaatgaccaaaacaaaagttgtagatctcattaagttatataactttgtttttgacatctttttcacataaatttatttagtatgataaaattcgatttgaagttttaatattttgaaattaattgagaggagggaggaaaaacagacgctgggccggcggcccgaaggagcagcgggcgccaaactttcagtgtggcgggatgttgatcaaaatttcaacgtgaaatgaccattttgtccagatattttagtggtaacttcggatgcaccatgggtattttagtaaaatcgcattggttcctcaaccctagccgatccaaatcagataagccgccaccacacgcgaggcgctactgcagatgagaccgccggcctctgtctccgccgctgctgggcgccggcctccgtcttcgccgccgccgggcgccgctcaccgcgccggcttcctcccccttcgccgcttgccatgccggcatccgtctccaccgctgccaggcgcgggagcggtggatccgctgccgccggcgcctctcgggcccagagggggcgtgcagcgcagcatccggggcagccaccggtgacgtgaatcgaggtggaagaagcaccggcgagggagagctccgacgagtcctcctcctcctccttctccggcagcaggtcagggcgcagatcccctcccagcagcgcgcctgcttcctacatctcgcgagctccgtccatcgagaggctgctcgaggaggacgccgcactgctgcacgcgtgagcatagggagcacggtaggcgatcatggtgggcgaggacggtttgacacggatgaaaaagaagaggagaggcgccagtctttctttctttgtttcttgcattagttttcttggcgagttttgacgcatgtgcctcacccatgtgcaggagggcggaggcgggatctgctactgtgagagggactggtgattggtgaagcgccccaacttcgactgcgagcgaccgcatcccaactgtaaccaatctctctctatccgctgatgctagttgcttatcaaagttcctgaatctgatgaatgcagaaacctctaatttagttaagcaagtcaattcatgctgtaacaatatgatctctgacaaaaaactgaattccttgtttctgcaaatgcaagtgcagtcataaataagaaagaatattcgtgaaagtttcatagaaactagataaaaaaaagaaagtgttttagataaaaaaaaagaatgtgtttattttcagaaatccacagttgctatattttcagatatcttcaaaactgaataatgttttaatccatttgccaacaaaaagaaaaagaggtgcagaaaacagcttacttgggggataccatggatcatgcttgatttgatcagctcaacggtgatttgatgctatctagattcatccttttttttttaagttcaacactgtacacatttgctggacataatgcatatatgttgttttcagcgtgacaaatacaatgaagaagaacctaatgcatttgatttgttcaaggagttccactacagcaagaaaaaaaatgctacaccactgctgtatagtaggctattgtaagataagtttcaaactttgctctttgtaatgcttatttttaattctctcatcaacaacaatgtttgctccttgcttgctagactcaaatggaaaacaagctgtctacaagttcgatgaagaggactcaatctgagatggaagcggaaacttaatcttttgatcagtcaagttcgatcaagttaattcatgcatgatgctatatcttttgctactacatgcattttgctgctattgctaacttgtgtcaagtcaatttttgactaagctaagctatacatgcttgcattttgctgccgcagcattcattaagctcctagacttgtatgcattgcttggaatctctatttgttgttggcttgagccatggtaaactgcaaggttgtatgcactttgaatgttgtaatctgatgttggatgaaaaatcatgtgatatgatattgaatggaaaaatgatatttctatttgatttgctgctgcaactattagttgcatgggctgtgtatatgggctttagttgtgaaattaagctgtatatatgggctgtaagcgatgtagtagtgggctgaaaagggcaccaaaaaatggtgacaaaattgggctgcaaagctgctgaaatgggttgtaaagctattgaaaatgggctgccaaaatggctgaaaaggagctgcgaaaatggatggaattgggctaaaaattggcccatctttgattttggcctgttaataaataggttgaggtagtgtctacgtcatcatccacgtaagcaaccatgtaagcatccatgatgatgtggcattcaatccgtgacggttatttttcgtcataggaaatgaacttgggctgggctaactaggcctcgggctctatcgtgatggtttaaaaccgtcaccgattccattaatccgtgatggtttttggtaaaccgtcacagaggttaatccatgacgctcaatccgtgaccatctctgaaaccatcacaggtgctacatagtgacggttttttgatgatccgtgacggaaatttttcatcatgcattaacagattccttgtagtgttcaatgttccagggtgagctaggacaggagggttaggggagagagggaggggaagtttcctagactttgaagcataggcgtgtagagacggcggtggcactgccgaagccatggttttggaggagtatggtgggcaggcttcgacatctagggagttagacccgaagtggttaggaggcgtgagcgatggtgacgtctttgatgacagagagatacatgagacaaggaagacattggtgcagaatgccttggagagatatatgagacaaggaagttgtcggtgcaggatgccttgctactgtgcggcttgtggaggaggagagattgggggggggggaaggtgaagaaggtaagtccggctagccttgctagcaccgaaattggcaggcgtcagcacttggttaggaggtgcttttaatgggtggaggtgggacagaggaggtggtatagaagataggagaatgttactatggtgcacatatctgaccatccaaaataactgaaattttatatgtattttcaggtgtttcctgttttcaaatattacaaaattgttagtaaaatatgattggtaactatagattttgaaaaatccgtagtataaacatccaataatcacatcatatttcaataagggagtatatgtatggctgtcgacatatttttcacatagtcatggtaagaagagaactctgtgttcggctgctagggttggcaactaatcactgttgcacggaaaacagagtggtccattagcgcgtgattagttaagtattagttattttttttgaaaaatggatcaatgtgattttttaagcaacttttgtttagaatttttttgcaaaaaacacactatttagccgtttgaaaagcgtgcgcacggaaaaagaggagagtgagttgggaactctggctaccgaactcagcataggaagtacttagatattgtagtttcattccatatatagagtattacaccatacttatattaatatattccatagcacaatacgaatagattcacaatagaaccatcaacacaatccataattttaatatatgacaaaaacattgaaattataaaataagcatagttgcaaacattgcttgctgctcatttattcctcaacaagttctctagctaattggtccaacacatcttcatgtctcttcagttttgcttcattgaaggttgatgtatccttctccatcaatttttaaatacatttggtatttttctacccttgcctcctctcttttagcacttgcgttctcttttatttttgcttctgctccaatcagtgttgcttctgcggcctttagcaatgttgctgctttagttgtaatagcttcatgaaagagaaccatattttgacttggcttgtcccccaaagttgatggagcaccttttccttttttcctctgttttgctgccttttgcctctcaaggcacttctctttgcgctctgttttctcctctatttcttggttcgatgatgaagtatatgctcctgattcagaaatcttgttcctcttattatggctactctcttcaaggactctacaccatttaggttgttctttaagatctttccacatataatccaaggtgaaagtattttggttgttctaacttttgtgccattcacgggctttctctattatcatatgatcagaatacccattagtgaaagtacttctagctttacaataaaatccacagaacttagtgacatctctcttgacattatcccaatgtgttctgcattgcttggggttccttttgtgcccattgctaggcaatactggtgttgaactctcaagctatagccttccaatactaatattattttttgtcattgcctttgatgggatcaactgagttgttcaaccaagagctcattagttgtatattgtcatcttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagccaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacaccttaagcttaaagtctagttttattgcatgacttgtggtctgactccacaatgttaaatgtgttgtactatagcagcatttattgcttatggttactttttagtgtacattgtgctattgtggatgtcctaagacagtatgtaattcaaaggcaataaaattattaaacgagataaaaaaaatgatgtagcttgatttataaaaaatacagatttaaatttcattcataataaataaagataaaaagttatatacatatttaacaaaatttacctgtatagctagagaaattatattgcaactatgtaattacaatgtaattagtctaattcagtaacatattttaagagcacacgttacgcttacaaaaaatcctcgaaaatagtaaaagtgaagtgatttcttgcatacactgtttaatgcaatttcaaatttaaatttaagtttagattgtttgtgtgtttttttttaaaaaaatcgaactgtttggatcagtaaaaaaaaacaaattgttcggttaagtgccaaaattatggaatcgtttgaggtactgaaccgaacaagcacctccgccgaatcattcgcggcatatcgcatcggcatcggattgcaattcgcaccaaaccgaccgccaccgccgcaccaccaccgaaattctcaattttctctcgcgacgaaaagggaataaaagcgcttcgcctcgcccactgccacgccccccatctcttctcccgactcctgagagaagaagaaccgctgcttctccacccgtcgcggagccccgtgtccatcctccggcgcggcggccgccccccagcgatccgcctcaggtgagagcaccgcccgcaccccctactgctctcccctcccctggagatcggcgtcccactcactcccatcccccacctcatcggtggattggattggataccagtaggggggcgatcgctcatcgctgcttgtgtgcatttcttctggtaggattgggggatttactgcgtgaccgtggtgtgatattatgttcgtgttcagtgcattgcttcttcttccaggaagagatatcaactctcttttattaatcgacacgcgtcctgtgtgttcttctttttatcgcatcgtaacatcgttaatgatgcagggtggttatccgcgttgttagaagatactatatggattgtaaaatctatagaggattgtttcattttcttcttattgttgctaacattaagaagatgctaggataggatcataggatggtgtaggtcgacactgaccactgcattgctattcgcgcaacgccaatcttttagtacttcacttcctgcttcactcctctgtcaaaagtcgatgcttggaattaaattcttctggaaattgggagcttcttcaaagaatcgtgttgtcctgaatttctttgtcccgtttggcattttcctttttttttatattgaatgactcaagcccatctagtgtaagtgtgtaactgcgtgctctaacattttcaactgaaccaggggatagttttcaagtttatcaccttgcctttgctggtttagctgtaccaaaagataaaaggaacaatttccaatgaattacatatacattttgtttaacaccaagtgagctttatataatatttatcaatagacttgaagacttatatatatatttgttataccctatgccttattcgaaacgaatccagtatgcttttttgagtaatggcctggactgcaagttgatttactgtttatgactattactattcacagttaaaactgcaaatttatagaggtgttaggaaatggaagaaagaaaataaaaccaaacagctgtttccatgtctcctaggaactctcagttgctacctaaaaagccaggtgtttcacttgcttggtaaaatgccaccgcacaatttggtaccactgcttaggacctggcacagtttggcaccgttgcttggaacataaacagaaggtctctttttagtgttctgctcaagagctttaagacctctcaagctcacaaccattatcatatgcaggttgctaaaatggataagctcagtggttctgcacgtcttattatcgtttcagatcttgaccacacgatggtttgtgtttttcaactcatatcttagacttgttcagagataattgcagcctgttatatgtcgttttaatccttcttcaattcaaacttgcaggttgatcatcacgatgaggagaacttatccttgcttagatttggcgccctgtgggagtccgtttactgtcaggattctctactagtattttcaactggaagatcccctactctttataaggaattgaggaaagagaagcctatgctaactccagacatcactatcatgtctgtggggactgagataacatatggtgaggcaatggttcctgatgatggttgggaggaatatctgaacaataagtgggacaggaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaaggaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattttatatacgatttaaattggaccaaagccaagaagagaaccagctgtctcggctagggacaaagaagaccctgcaagtacacccaatgaatataaatgattaaaatatgtccaaagttgtagaagaccggcatcaatgataatacattctttggagtctacatttttcaaagtacgaaactttggagtggcaaacacacatgaaactctaatatttgattgaaattgaatatgattctctgtactaaaaaacactaaaaattttcagtatggtatttatggatttccatgtttacctggatgcatgattgaacatctactctcttttgatgcttgtggttcagatgtctatgctgcaaactgatatatgatttatattagcttgtattgttctctgtactgtctagacaacagagcacaactactgtctaacagagagcagagcacaacacataaccttgatgacaggctataatttttgttattttattctttttgtacaaatgattctcacctgaaagttttaacacattcctactttaggtgatgcgcggttgtgctgtttgacaagtcttgcgctgaatgtaaaggtacatcatctctactcagtcttgcactgaatcccgttgcaattttgcatcgttagcatgtctgcatgatctaaaaacgcaggtttaacttcactttttttttttcaataatatcagcctgaaacccctgctggcttcctgataacacatgtacacaaaacatggctcaaaggatactcttcagcggatgagcagtcctccaagctttaaaccctttttcacccctgtgcacacggaatgaatttacttgatgataaatgaaggacctgctcgtctgagaatctcattttcttatttaatgtaatataaatgatctgtctcgtgactcgtgcgatgataaagtgaacgatctcagaaggcaacttcaacaaatgttggatatgattttacagagagttcagaattagatttcatgacacaagtaccgctaagctggcattatttgtgggcacttgccaacaagttttgcatcactatgtgcctagcggtcaaataccttgcaaaaattatgacattatgcatgtttttctttatttctgaatgatattaggtaacatcattggttcgccacggataaaaaacatttggttctttcttttcccctaccaaaataagcctcttgccatttaaaaaatatatggcttattctgagttggcacaagtattaaggcaattaaaatcaagaaaaatatgagttaaagtatttatgctactgatgcttaaatacatcgaagtagggacatcagctagtgataagttttagtagagagggagactggtgataagtttaaattcaagctaattatatattttaaaattcacattgtcggtgatatgtgtctgggggtatcaagaccagagggaggaggctgccggtaccaacgtggcactcccccgaggagggtcgggcccgtggta

SEQ ID NO: 10676 - DNA, 1426 bp, Oryza sativa
gcatttaagaaggcgtgagtgggcgcaccacgccaccttaaatgcaacgtgtggtacgcctgaccggtcgaatgaccgatgggatcgggatagtgcgtctacgcactggttgcatgtcatgcggcctctgtcacgtcgtgatgatgagaggcttagccggagtcagtacatctcacctagtcaaagcagggtttccgtttccccgtgcaagtaaagacccagaagtcttcactcattaatgatgaatgacacggatgccccccgtgtcaggcagttggatttgacgggccccatgtcgtagcgcccgtgcgagtggcttccaagttaagcaacaagacatgcatttaatgtgaatgccctcgctctcccctaggcagttttctaggcccatgtggcagccccttgagatataaaaggaggtccaggcctggtgaggggagagatcgattcttgggcgaactcacactcgagtctgagcgacttaagtgatttgtaacttacactcaatcagccagacacataagtagggtattacgcttgcagcggcccgaacttgtataaaccacttttgtctcatcgttcctgaggggcccaaccccctctatgtcacaccttccatcgagtctttgattttcacccactgcccccggccgaactaacaagggggggcctcactgtccctcgcttgaggagtgcaccctccgacacacatgcaccttgtagattatatttgaaatatgagtataaatctataggagtatttatatgcttgtgtgtttgttgatgtaaaaacacgaggcctgggagatctgcttaactccagtgcaggtccaaaacttgcctttgggtgtgtgagcgtgccagttgatttgatcctgcaatcaacaagaaataaagacaaagaaaccacggttaaatccataaaagatagccgatcggctggatgctgatgacaaatcatttatctttgagccgatgtcatatatgcatcgatcggcagtcatgaataaataagaaagaactaaatctactcaatcggctgtagatattaacaatatataatccttatgtcgatatatacttaaatcaagtgattgggacatatcggtcaccatgccgagacagtataaatcacttagatcgaaatatataccaacaacaagactatctatgttcatagcatagccagtcagatagatctagcatgtatcggctaatactccgataccactctatattaagatattaatgcaagtagaatatatcaaacagaaagcctaatatacttttagcgcaacaggatcttaacataaagggcagatttaacatgtcaataaagcatataagataaatatagttaaataagataagatcggctgaaaccccaatacaaccctaattggcaaccaaagacaggctagagatt

SEQ ID NO: 10677 - DNA, 11666 bp, Oryza sativa
acaggctttagattgaaattctatttacgacttataagatcagactcaactgatgcagctataagtatgaaaagaaaggcagtatctagacaatcaaatcgttggatgttttatagagtggtagatatcctatataatctagatcaacatcagtatttaacctaatcggctgccttctattagcagatgttggccgattgtaggttatatgacgatattgctagagattacgtaagatatatgataactcgacgaattacataaacaagattagagtgtcataaagatagaagcactaatcccgagaacgcaagccgccataacaagttttacctcttgttgaagatcaaaactgatgcagctcaacccaaaagtaagaactcgtcgaaacaaaacgaaagtaaaatgggtggcgatgcgccgagattgtattgaacgtgtgttcgtttgattacatggggctcgggtctatttatacccgagaattacaaaatacgtccatatcggacacgactcttatctctaacaaactctaagataccataagtctttgcggtagacttttgcccaaacatatctctaaggaaattatataaaatatcctaattaatagatacaattgacttctcaggactctatccatgcgtggcaatcatcatgaagcacgtcaacctaaaccgacaacatatgctgtgtcatattgtcggattcggcttaatcggctaaccccgtccaactcgaactctgtcgatcctagtcgtagccgatttggactttagccgatcttcactctgtttccgggacaatctctatctcgatttccatctcgattcctccttcacatccgatatttggactaccaaatttggtcgttaacagtgttgcaacggtgtattcataataaactaaactttttatgggttcatgtgaccgagaaaagtaggcctcagcctcaaatgagggaaatatccaagtatggtcatcaactctcataactcaactaaaacattcgtgcatagttttttatgtattgttttgatcatttgtttctatagatttattacaataagattttttcgagaaaatattacagtaagacatagtgctaaatttataatattatgcatataatttttcatgcacaattttttatttcatattataagtcactttgaatttttcatgcacaatttttttaaaaatctataagttgctaaatcattctttaatcttaaaaaagtttgactacgaaaagctcaaagcaacttataatatgcacttttttgatgaacgtagtagagtactatgtatttactgtatacgtaagaaattaagatatatagacattgttatagatatgatgcattggagtgctctttttttcgagggaacgggtgggagtttatgcgattccactgtagaagaagagagttgatctaatttataaaaaaaatcggacccaaaagccttacaatggctcagttaatttgtgaaaaatcagcaaaaaccctggtattaacaaactgaacctaaacaaagcataaccatccaacaagggaaaagctcctaaaatgaagccttcaaggacacgccgacagaacggcaacatcgcccgaccctaacgaatttatggttttcatccggagaaatctcttgatgtggagttgaacaagggctccaataataacgccttcaagaaagtgaacggcgcccgagagcgtcgccgttgctagcatcggcaaacctgagtaaggctttcacctcgaagtcccatccaaacatagcgtccccaacggaagccaccaaataccaccaacacactggaggtgcctctcctatgcacacaaccacctgcacaccgttgacgacctactctacaaccggcctcgctagtacgtgcggaagccaccagagaggtgccggatctagacctacgtggtcagatcaggccgtccctcgcacagccttcgccgccggtctgggacgagaggccgccagcaccgggtagggaggagggctaggccgccggtcaccttagatctggagaaagggaggaagggaaaaaatagagagaaggaagaaggggaaaggaagaagcagggaggaaagggagggagcgtcgctgctaccggccatcgccgcaggtggcagcgttgccggtggcgtgaggccggcgaccgtgcgctggggaggttggggaggcgggctttgcctcccggatcactgagagaggtgacacaggagtccggcgtgacgcataggcattggagtgcttttaatgggcaacttttgttctttagtaaagcggctcgttgtataatgtttatctagatcatgatcatatttcattatctgcaaggcctacttgcgttggaaagttgcatgggaaaaaaaaaaaggcagaaatcgtgatcaatggaacttttgttgatgatggtccttcagtccttgcatgtggattttgtggtaccaatctgccagcagcacaacttttccttaggtttataaacggcttatatatagtaatatcgtcgattttaacttaggatcataagaatgtcgtgaaatgtacaggtgacgatcgaccatcctttaaagtgtggtggcatatatattaacaaatccaagtaaggtccattaaacaacacaacaattctcagtgattttgcaaaatatatacaataacctaccaattttataaaaagaaaggaaaaaaaagtgcaatgcgaacatagctttaattgtagatttgtaataatctggatgaaaagttaaaaattatacatctgaaaatgttgttttaaaagtataaacatatttaggattcacaaatagatgtcactaggtaattccccgcgctttactgcaggaattagcaattctcaatatattttttctcgacaaccagagtaaaaaagggaacacaaataatgaaatataagagtttattagtacttatcatgaaacaatcaaatgatacccgtgcttttatatgaaacatattgataattatatgttaaaaattataaaaataatagatagatttgttaaaatgttatgcaaatatttacaacatcatatataatttatttaattgtgggctataactttatagaaagtatagatttcagatgtataaacttaaaccttgaaatcttaaagcactttgattagtaaagatgataattgtagattggtcctgaaaaatacttctatataattatatttttaatgatctctatgaccaggcatgtgaataaaaatgtaatgataagacatcatacacattggagacaatgtcaatggaaacggcaaacaaaaaaaaagatctggtatatatgtgattagggggatcatcaatatcaatcaattttttaaactgcacgattgcatccaaaggtcacaggttaatttttttacgatcatcaaaagtaaagaatccccaccagtataaaaaaatattatcttcaaaagcattaaaataaatctaaaagagatcgtgaaaagaatatgaaacactgatgctatactagagttggaattaacttcacaacatatatatgaactcttttggatcctttcttttgtgaaagcaaaccctcatcggtacaactgagaaataattaagtgtgtagtaaaaaaagatgaaatgaagaacagaagagcaattaaatggagccttccattccttcgatcgatcaatcgatcgatgaggcatgttagctttgctagaagccgtgagcaatgcacgcctcccagaagagcctgtcactctcggcgtcgctgccgccggcggcggcgacatcatcctccgtcgccggcgcggcgcacttgccgtcgtccgcagccaccaccagctggtagcccgcgcagtactcccgcatccagcgctcccacgacaaagcctccacggagccaggcgccgccgccccgccgcctccatcctgatcacccccgcagcacgactcggcgtcgccatcgtccgcagggcagctgccgcggtccaccgccgccgcgtccgactccgagtcgcccgtcgcctccatcaacgacgacgccatgctcggcggctgctcggagttcataccgacggggcgacacaggaggccgagagggagatcgttgtgtcgtggcgtggcgtggtgaggagaggcgttttgtagcgggcggggaggtaaaaacgtgaagaatgtgggcaaaggtcgcaaggaaatgagcgagcgacgggtcaaagattactgatgcgaagccgaagcagcagcggcagcaagaaaaaaatgggttttaaccgtgcggtggcgtggtaggctgctatctagttcatacttcatacacgtcgcgacttggttgcgcttgcgcgccctcctctctactttatgatatactccctctattttgtaatggatgaagccattgatttttgaacagatgtttatcatacaattcaaaaattttatgtaaatgtataagatataaatcattcttaaattactttaagttataaaacaattcacaacaaaataaattataattacataaatctttttactaagacgaatggttaaacctgtgaaaaaaaattaacggtattatctattaaaaacggagatagtaagattgctaaggctaggtcggctaataaaaggtcaagcagttaatttgttactaaagcctgtagccatggcagtgcatccattggccaaaaatgcgtggtagtattaattaatggatctgtgtcaaaagtctcatgccatatgcatttgaccaaagatagctctatcgatcgcttatacggtgtgtcgttgatgaagtcggattattctacatggtaccatttgttctagttcttccgtatatgtttgtcatccttgttagtcaacagttagttatgcacctagggtgagattgtgagtttgtttgtttcgttctccgcgtgacgtttcccgaactattaaatggtgtgttttttgcaaaactttttttataggaaagttactttaaaaaatcatattaatctatttttgaaatttaaaatagttaatactaaaaaaaagtctctttctttccccccacaaaagagtacttctatatttttttaccagcaatggcgctatattttcccaataaaaaacaatcaaatcgtttttatactgtgaattttaaatgttacaccgccgtaaatcactttacaaatttcaataattacaatctaaattttataatacaaattttataatgaaattaagactaaaagtaattgatcagaagaggagatagatgagatagaaacatgcttaattagatataacatacagagatactaatcactactacctccgtcccaaaataagtgcagccatgagttttcacgcctatctttgatcatctatcttatttgaaattttttcataattagcatttttgttgttatgaaatgataaaatatgaatagtactttactcatgacttatgttttaaaattttttcaaattttttttaaataagatgaacggttaaagttgggcgcgaaaaactatggctgcacttattttggaacggaggtagtaaaaaaaattgactgaatcaagtaaaatgtggcccgtgtttttgaaaacagaacatattgtcttaattaatgcctaaaataccgttatctgctttgtacaaccaaaattgtattccattttcctttttagttttgaaaaacaaacgagaatccatatatcacgatcagagaacactacaagaagacataattcatactatatattcatcttaccgatgtgcaggaaaaaaaaacaaatgagtaaatttccaaaactattgatgttttgaccaaactattacaacactaaagatttagggtgttgtactacaaaattatagaattagctcaaaatttatcaccaaactagaagtacagatctatagatttgggagtttaagtccagtgatagtttcattattattgaatatgttgttttgctatatatgcactctgcgttaaatatgtagttagtaataaattatcgctaaattcatagttatgatacaacatcttaattaagtatgcagttttgtagaattcagtctaaataaatctaaatttaaggatccaactatagggactaaattagcaaatagccaccgctagctacagcacaagttactatatatatatatatatatatatgctcttattaatctattatagttttattcaactacacaaaagttttcaaatctagaaatatattccacggttctagatgtcaagcacatggtactacacgactatagccaaagtcaataatgactactctaacaaacctgtatactaacataagtagtgtaggaacatatcacgtgcgtactctcactaattgcaagtataaggctgtgtttttctgaaattaggaagaagtttggggaaagttggtagtttaaaaaaaaaagttagaagtttatatgtgttggaaagttttgatgtgatgtgatgtgatggaaagttgggagttggagtgaagtttggtgtgaactaaacacaccctaagtcatcttatatttatgcatgataattgaggaaacaacacaactttgtaaccctttattcattctactgatttacttgtgagaacaagaacacattaacttattgaagttaatgtttttgaagaagagttgatgatcttaaagaaagacttacatttagaaaagagttagtgcaactaaaacaacttacactgggaaaaaaaaagatgaattgagctcatttcattactttgaaaagtggaatttcaaattaatttcagagaaattttgctacatgtcatccaaaatttttgtaatatgctgatagatattaaaaaacatgctaaggctaaaaaacacctaaaaattggtaattacgagaggacatttcaagctcaattagagagaaaaattatttaaaaagataagaatgcttttgaaaccacaaatttctaacctgatcatgcagagaaaatttttgaattatgcaactcttaatctaccatcacccaaagtacactagtagcgcacatcatacttcattcttactcttgcctcaaggtataatttctaaccccaagacatttttatttttctttttaaagaattcctctctctaattaggtcagaaatatcacaagttaccactttttggttgtcatatagccatgatacatttttttgatacccactagcatattacacatactttgaatgccctatatcataatttgtcttagtataatggtcacctaagaaactgccccgtttttttctattcttaattcattttttgctccttttctaggggtatacttctgctgatcgttttggagaaaaagggaatattaaataagattttctagtcaaacttttttcaaataaaattttctagtccaacttgctttgcgttgagatgcagactgactggacgtattgtccacatctagaacgtacaggacaatctagcacggattgtacatttctagaagctctaggacgtatgaactggtcttcctttgtctgcaaatataaaagacatatactccctccatccccataatacaggagattttgagtttttgtttatattatttgaccactcatcttattcaaaattttttaaattattatttattttttttggcttactttattatccaaagtactttaagcacaacttttcgttttttatatttgcacaaattttttgaataagacgtgtggtcaaacagtacaagcaaaaactcaaaactccttatattatgggacagagggagtagtatactgacgaacttaattatgcagggtctattctgcagattactgctaaaataaaccgttttaaattttgacaataccaaaattttagaaagttaacattattattaaggaaaaagtacgaattaccccccccgaactatcgtggtaggccgaattacccccctgaaccacaaaaccggacattttacaccttcaagtattcataccggataaattacccccttagcactattttgagtggttttgacttaagcttgcacacgtggcgccaacgtggcagtgcagtcagcaaataaaaaaaaatgttcgggcccacctgtcatcccttagactcaacaaattcctatcattcccctgggctctctctctctggcgaccggtggcggaggtgtacctcgttccggtggccgacggcggaggtggacctcgctcccggccgggacgggcggcggatggcggcgcgcgggaggctgtagcggggcgcgcgaggacgggcggtggacggcggcatgtggaggtgggtgcggcgaggatggccgacttgggcacgcgcttggacggccggctgtggcggtggaggtggaggcgcccgggcggctggtgtcagcggaccgggcggcgggtgacggcagcgcgcgggagcgggcggcgggcggcggacggcaacgcactggggcggtgtaacgccccgatttttgttcgggaattaaaaatcattaaataatgcattttctagaaactaaataaaagttaaagcaatttaatcaagtgaaatactgggagaaataaaattttactttaaaaatcattggccggaaatattttgtaatattctctgtgccctaaaatactctgtgaaattttccattaattttcggagctcgagtaataatttgaatagcacaaagtttatttaaccaatttaataaaaagaaaaacaattaaatctaccctccttcactttgggccacttccggcccaaagccctccttccctccccgcggcccgtcccctcccttcttccttccttcctccttgggccgtcgacccatcttccttcccctcgcgcaaaatctaaataacccccctgggttctcctccctctctccctccccgacaggtaggctcggcgaccccacctgtcaggccctcctcctaccttcggcttccaatgccgaagccgccatggccggcggttgctgcccacgtcccgccaaatccagcgccctcccgctcgcaccctcacacccaaaccgagtgaaaccagttcccctccaactcctccacattttcccccacttttccccaatttttggcgccaaatcgagtccccactccgcccacgttgagtcccacgtcaccggccggttgccgcccgatcccgcccctcttggccacgatttcaccctcccgagcctatataaaccctccccgtgctctcctcttccgtttccccctctttcccgagcccatcgcgccttctcccgctctctctgcacgagcccgagctctgccgctcaccgccgtgcttccagctgcatgccatcgcccctccagacgccgccgcgctgcgccgccaccaccgctagcctcgccgtcccgagctccaccccggcatccactttatttccctgaaccaccgccgtgatgccgtgtccacgcacagcccgagccgccggtgcttttgccgcctccggccgcctcttgctgccgctcccatcgccgctgcgccgcgcaaacaccgccgtcggcatcgccatgccttgccgcacactggcctttgcttggttttcccaaatcgccaccgcatctaccaccccaccgtgaacccgaggtcgccgccgtgactgtcgcctccggccacctcttgccgtcgtttccgacctcctcacggtgtgctgtcgcctccgtcggcttctccgtctggtgccgcacctcggccgccccatcgccctcgccttccaccggcggagtcctctccttcccgtcgaggtgagctactccccatgtcgccggctttcggccgagttttcccgccgcctcgcgcctcctcccttttccctaacccttccatcgtgctccccatgtcgtcccggtcgccgtccgcagcctcgtcgcccgttggccgccgttggagtgccgccgctatctcgcctccgtccggtgtcgtgccgcttggtgagcatccccttcctcctctcctttccgccacccttcgcgcgccctctcgcgccaccgctcgccgtcggtggccgttcaccgccgcgcatcgtgtctcggttgggccggctctaagccatgcccgtgctctgggccctcccctagtcccgctgacgtatggggcccgcctgtcggcgcgcccttcctctttgatgacgtcagccgtgccttttcccttgagaaaacaattaataattgtgcaataaatcgatattaattctagaaattcatttaaatggctcaaaacttctaaaattcatatctaattcattcgaactccgaattgagccattcaacttgcaaaattcatctaaaattaagctctacatgtttgtttacttttcatgtactgttttcttggtgtttattagagtttttcctcgttttgcgtgctagcatgtaggatccgtcgtttcggaagttcgcggtcgcgaggaaaagagttcggaagatcaaagtaaagaagcaaggcaagtcacacattccccttgagcatgttgatcccaatttacaaatgttttaccatttgcaaataaatatgcatgttttgctaattacatgggatcagagttttacctatctgctcgcttgtgccatgtttacttgatatccgtcctttgtcaacattgggtaataaattggctagctcatgttacttatgtgacctagctagaactatatgcttagccatgcttaattaccactagctcagttgatgggataattacaatattagacctttttagtatcagaatgagctgcgtgctcgagacatctggccatgcttcattgtcgtaattatccaactagaatgcgactgaatggtgggctgtgggtgcatggttatgctagtcgcacccatggcaattaaagaccggttcgtgggatgccctagaagaacttatcgtacttaccacaagccagcgtggtaacggctgggcttgtagtgtagctttcctctagccgacgtacccaggcgagggtgggcatgatggagttgggtcggccggggtgtccggttgatcggcttctggattcatcgcggcacgagaggagggctgcccattgtctgctgggggcgggggcgaaccctaaggtgtggtgcgatcggttagagggggttatgcgaagggtcctgtcacggcctctttccagtatgtcgtggtggcatgtcggcgcacggaaacgtgtcgtggggctgagtcttgtgggtacagttgtacacctctggccagagtaaaactattcgaatagccgtgcccgcagttacgggcggtcgaccagattcaccgtgattagtcccaccttaataaatcgactcaatgcactgtagttcaggtgggttggttgggcctgttcaacgtggtgtagcgttgatgagtggagatttaatgttactttaattactcaacagttttactgttttgctcaataaaatgttttacaaccgcctttatgcaaatagccacaaaccgtccttgtgttccccttgcacgtctgcatcattgatgtggcttgctgagtacggtggttgtactcagccttgctattattccccattttcagaagtattgtgcttctgagctgaagacgaagttagaagaccaaggctcagaccccagttgagtttt

SEQ ID NO: 10678 - DNA, 1460 bp, Oryza sativa
gggcgtgacaggccgggcggtgtatggcggccctgtcgcactcgtcggggagggacgaggctgttgcggcggtggcaacggcaacggcggtataggcgaggcgaggcgagcgcggcagggatgtccgagtcgggcacgcgctcgtcagggcgggaagaggctgcggcgacggtggcaacgtcggtagaggcggcgcacgacatcgacgtcggcggcaacgacggcagaggctgcggcgcacgatggcacttccccctcgccgtcttcgaggccccgccgccctgcaccagagacgggattggaagatagtggcgggcgggggcggaggccggtggctcgcttgggcaacagacggcggcgcgcgagaaagtgcggcgggcgggggcaggcagtgggcgaggacgggcgggggtaggcagagggcaaggacgggcggaggcgagagcggcggacggcggcgcaggaggaagggggcggccgccgcagtgccggtgtgtccgagctctgcgccgccgcgacggtagggaaggaggtcgccgtcgccgcctcactccacgtcccgccgcccttgcctccgccgccgctaccactggagccgaagatgaaaatgaagataaagattaggtgtttcacacgaaacgaggcggtaataacatgtgattaattgagttttaattattacaaacttgaaaaatagattaatcttatctttatagcaacttttatatagaaagttttcgcacgaaatgtaccgtttagcagtttgaaaagcgtgccatttttatccaaaagtttatccagtttttgttggagaaaagaagagggccaatttataatatacaatgcattcaataagaaaatacttatgatccatttcatcatctaaaagaaattagacttagtttgttttaaaaacaagtaggtgtaaattccttttctttatggaaagtttaggggctctctctttttttttcacaaatataaaagcactattgttgctaataattatgtttaattgtacaatcaaattagtcctcccttgtagcgcccgttccatcgtggcgcctagcgggaaaactatctcttaaaaaccctatttacgaaatccgtttctttgcttgttgtctagtgtccatgccatctcagatctcaaatccccaatctatcgtcgagttcaatcccgaatccaaatccttcccaaatcaaatctctccgcaaaagtctattttgcctccctcgggttcgatgggccgaactcctctcggcccatctccccctccctccccggctctctctctctctctccctctccctctcccccgctctacccgtgcgctgcgcacgcgtgcgcgtgagccgcgccgagccgagcgctctccgccctcgctgccgattctcgccgggccgcccgttgatttccgcgcgcgcgcgcgccatggtggtcgaccgcctggtcgcca

SEQ ID NO: 10679 - DNA, 4497 bp, Oryza sativa
ttttccttttcccctccccgccgacgtcatccgcctctgtggccgttttggccgcgagcgccgagcgccagctcgcgccttgaccgcccaaggtcggtttccaaaccgacatcgtcgtcctataaaccaaggcgccctcccatcgattcctcctcccgtttcgctcgccgccaccgcgccattgtcgcccctctgtctcgcctccgccgttcatcgccaagcaccgggagagccggtgcgttcgtggacgcggaaggggactccgggcgctcgccttcttcctctttcccggcccgaggccggagagatcactcccgtgccgtcggcctcttgtcacagcgccccgcctcatctcggtagtgcatctccccgttctccctcctcaatccatctcttccccttagttttcggtagtagcatgtgtagccccccctagctagccggcgccgccccgactgctgccgtcgctcgccgtgtgctcgccgccgtcgccgcccgagctcggaagcgcctctcgtcgccggcctccctcgatgcgattcctcctaatccggcgcaaggggtggattcccgtagccgcgtagatgctctcactgccaggaatcggcccctcgtgacctcgtcgccgtttcccccttttctctccgccggttgccgccgccgcaatccgccgccgtcgagcatcccccggcgaatccgagccattggctcgtctcccctcgtcctgcgcaacatcccggtgtgctcgccttcgcctgtatcgccatggtttgctccgccgctcgccgctgtcgaccgccgtccgttctggccggcgtcgtcgtctacctcccaccggcccgcgtggcagccacgtaggcgccacctcggcgccacctcggccgcgaccgggtcaagtagaccccggtccgccgcttccctccgccccctcgcgcgtgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgcgggatggacccggcccaccggctctctctctcccctccccgcccgcgcgcgcgccttgggccgccttcttgggccagccggcccattaaggtcggccgagccgccccattctctcgggtcgcgccctagccgcccgagggaagtctaatttccgtccctccttcttttcttttcttttatttttcaaaaaggatttaaataaatccttttcctttagactaaaaatccaataatcttagaaattcaatatcttcccaacagtaagtccgtttgactccgttcaacttccaaaattcctcaaatctcgagatctatctaatggcacgcttagaggtcaataataaggctttattttcgccgtttgctgagttgtcccgtttcgcgtgtagtttcggagcccgaagacccgtagtgcgaggatttcgaggatcaagctcaagatctcgagcgaggcaagccacctttgaacatcttgagcctatatttgaacttaattatattgcttgaaaaatattatgcattgataggatcgcacttaatctgcttgtcccgtctgcaaggcagattggcggacctacctaatttgttgcatttgacccttccattgtaattgttataccatgttcccttgtatacacctagttgcgcctcggtaatcgtgcactctgcacaggtatcgacggtcgccttcaaacttaaaatctgagaaacttcttgggtaaaacttgggttttacaaaagacttggaaaacccgacagctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtgaattcgccggggtggtgtcggggaggacccctgggcttcctggcatagtatggtctgggacctaatctggtgttggtctgggacccctctcgttggcatatggtgaaactgtgtcggctttcgaaatgccttgttatgaaagccttaaggtctctagtcgtggccgttctgcatgggctggatgatccgggttagtaatgtcgtgtgggtaaagtgtaccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcccgggtggccgtttgaaagcttttggccgggtgccaatcttgatcaattcaaaagactgaatcattgcacatactccgaccggacgagacgcactgtctcatccgtgtcatttgagaagcactcccttagttgtttcagaaaagagtttaaataaaatcaatcgcaaaaacaacagcctttctttgaagcctacattaaacacttatttcccatggcttgctgagtactcctgtactcacccttgctctatataaataattcccccccagttgctgaagaagatgaagcggatcccgctgacgaggagttcttccaggagcaagccggctacgatgagttttagggtttcggcctagttcccaagtcgcgcctgtgatgtttggtccaagtcttggcttccacttcccttttgtaatgcagttgtgagctcgggatctgtccgcagcccaacatgactgtactcctactctataataaagagacatctgttgctgtgatattccgtcttcctgtgataccagcactgtttcctgggactggtatcggttaacaggttaatttggagcgtcacgggctagttccgctcgggactagttcggggcgtgacatccctctaattggatcatacaaataaagatagagaagagacatatctagaccatgcttccttcggatgtgtgagatccatagtacttcctccgttttacaatgtaagtcattctagtatttctcacgttcatattgaatgaatatgtctagattaattagcaccaatataaatatggaaaatattaaaatgattacattgtgaaacggagggagtatatcttaaggaaaaaaaacatagtcaattatgtattgctaccttagtgcccttatatatgtaagatatggaggaactaataacaccgtataggactgtgagaaggctattaggatctaagcaattaaaaattatgtaatgctacgataacgggtgttccaaatttggtgaaaaggaactgagatttttataagattttctcgaattgatcattttacttcttattggcatttcctacataaaattattgtttcatgttcaacttctgtgagatggtaaatagtgacatagagttgcaccatttgtaatttttaataaaaaccaatcaccttttgtataagcagcttgtcatgacccaaaatttctcatttttttttggagtctgtcgtatccttataagcatatatactgattatatatatacatatgttccataagaatacaaagggattatatatatacatatgttccataaggatacaaaggtaagatgtaatgtctaactatcccaactagagtttgcaaaactagagcaatggcttcatttattttgcaccagctacatggcttaaatacatccactggtccactgaccaccatgttgtcatcaggtctattccctacacctggcaagcagctatatatcctcttaatttaaactgaagactaaagaagacaacactccccattaggcctgtctgtcgccatccccctttgacatgtcatcatgactagtttctatgcacatcaaatagcaagaaataatatgagtatgttacacatactaagcaagattagtatatttactctttttcttagatgaaacattattactgtagatattaatagccatccattaataaaagatactaaatatagtggttcaaatacactcttcagaggtattaaaataattgttataatcttattcctttagtctattttcccaaccagtgatacctttaactgagaatcacgtcactgaattccctacttgtgtgaggtattccagatatcggctgaccctatattgttgtttcagatatcggccatctcaggctaagtatcacaatcatgttctatgattatgacattattattctcatagataaaatcatcaatctgttattctttaataatatttattgttagcatcaccatctcaatatataatgcaagtaagcaaatttagttagagatgattaagggggtgtttg

SEQ ID NO: 10680 - DNA, 30034 bp, Oryza sativa
gataggtagataggtttccccctctctcgtcctcacctcaagagtggttgatcctatccatttcatcaatacacagatatatttgtctgtcttcctctccaaaataattcaagagttaaaacagattgtacatagttaaatgtcatgtatagtactattccttattattattattattattattattattattattattattattattattattattatattcttgttgtttattaatgggtggatttgggttggacatgatcctatgcttaatgcacaggctcgtaaagtccaattcaattgcacagtgtggaagacaacccatcaaataacttttcgagcagagtgtgagtaaagagtccacgcaatccagtgagaacacaatggctaaatataactatgtgtgcatcattgttatttatatgattttttatgattgcttctatgatttaaatactttttctaaaaaatcaacaattaaatattatgaattatatgtaaggatgatccactttttcaacggtttgtacactagaacaaattatgttcatctatgatgtattaaaaatacattaaacattgtctaaattcgattagatggtaatatagaatatattttaaagcacttatgtgaaacattatttggcttgcttggattatttttctctcactgaaggcatcagattgtttatgtaatggttttagttattcattttgggttagttcttttttcttacatagtttatattttatctattcacatttgcaaaataatgtataatggtgcaacctttgttgttgaataattttgtaatgtttttatgtcagttgagatgaagtttagaagggtagggtgttgtccctcgataaaatatcgctgaatagtttattttctaatctttgtttggatactggaaatttaatttagccatacatatgcctatagaatggtatatggtgatgcaatatatgctaatttttaaagtaatttatgctatttatatggcatgcaaagtgcactgctttttggccgaatgacatatatagcaaaaataggggcactatggatttaattatgaatgcaacaacattttagttagattaaaaacatttgattttttttctccttttaatttgatatatagctacaaaataggaataggagcttcaaaatgggaagcaggaggggaagcaggaaacgggtatgcgcagctgcatgcacatgcgaggggatggggaggaggtgaggtgggaagagggttgtggatttaattgtttttattttccttacttataaatccaattcatagatataatatagctacaaaacatgaatgggagctacaaactaggaagcaggaacgtttaggactgccctagaaacgtttgtagaaaatttaatggactagattatgtgggatgatgatttaatatatttgtatgtataagctttagaatataatacatatagatgatatagcaatgtttacatgaggattaaaatataataaattactattgcatgatgatgtgttatttttgcatgttaagtattacaaatttagaatgtagtaggtaatagtaattattacatctgataggaccaatgtatattaatttgagttttactctaatacataaattttgctttccctgatacgatcagtactctaacacgaaatttggaaaaatgatgcaaatcaccagcccaatgaatcggacgaaccctgttactgtcacatgcatgtctagctgtttcttctccttatttcctactctctttaaaaattctttctcctaaattacttattcaatctacgatccgatcacaccgttgtattcattgcgatttaatcttcacaccaatatatcatatgattatattatgtcaaaataaaaacatgtgttttaaaccgttaaaactaaattttttatacgtggtagtgatatgtttcaatgtgtgtcttcattgtgttccacaaaattccttaaactacttgctactactctctctctccactttctccacctcatccatacatacgtgcatgtattttagcaagcttcaaaatgattatttttctcctaaattacttatccaatcaacaatccgatcacactattgtattcgttgtaattaaatctttagaacaagatatcgcatgattatattttgatgaaaggaaaacatatatttcaatctgttaatacttgttgtttcatatgtgatagctaggtgattttcctattagatatctcggcattcctatgcattatagaaagcttagtaataaagattggataacaattgaagaaagaattgaaaaaaaaacttagtagttggaagggtaaacatatatatgttagtgggagattggttttgattaattctgttttgtcaagtctagttatgtttatgatatcatttttgatattcctaaaggggttcttcaaaaaattggttattatagatcctgtttcttttgtcaaggggatgaacataaaaaaagtatagattgacaatatgggatattatttgtcagctaaaagatcagggcggacttagagttcacaatttagaaataaaaaaccaatgtcttttaagtaaatggttgtttaaattaataaatgagcaaggtgtgtggcaagatttactgaaaagaaaatatcttactggtaaatcaataactcaggttgagaggaaacaagagattcccattttttatcaggtctgatgaaggttaagaattcatttttaaatatgacttcctggattattaataatggtgaacaagtaagattctgggagtaagattctgggaggataagtggctagggaattattctttgaaggaaaagtacccttcgttattttctatagttagaaggaaaaatgcctcaattgctaatgttatgggttctattccgcttaatgttacttttagaagagcattagttggtcaaaatctaattaggtggcataatttgtgtgcttccattgtacatattaacttaacagacgaggatgacatttttagatggaattttcatcaaaatggccaattttctgttcgatctatttacttagctttaattaataatacatagagagaaataagattatttggaaacttaaaatgcctattaagattaagatttttatgtggtatctccttaaagggatcgttttaactaaagataatttgactagaaggaattggaatggtagtttaagatgttgcttttatatgaaaaatgaatcaatataccatctattctttgagtgccatgtttctaaatttctttggagagctatacaattattttttggactttatcctctacatagtacatctcatacgtttgggaattggcttttgggtgttagtaaaaaaataaaaaaaattattcttgttggagcttccgctgtatgttgggctcttaggcttagtagaaatgatatggtttttgataaaaacaccatcaaaatcttatttgcaggtgtttttcagggcaacatattagtttcgaggatgggttcaattacaaagacatgatgaagatatcaagctaataaatgatgaatgtcgtaaacttgacacgacaattatgcatctatttgccaacttcgggtcgaggttctctaatagaattaagtagttaggggatctttttcttcggttggtgtctatgtaacatcccaggtaaccacgtacctagagtgccataccaaaatacactcaaaaaccacttaactccgaaaattattagaaatttcggcagtctcctcctaaaattacggacatccacgacagtcagttataagataactcaataacgatataatccacacaatccaaaccatcctagctcctcaaattccacgtgaaaataaggaccggaactttaaatgaccgttacaagttctacgcaaaacttatgctaagcagaaacataatctaaaactaaattccaatagtgtgcaataataatgtgtagtccaagggtgctactcccgccccatgccgatcaatgtcattaggtacctaaaaaccaaattaaacacaagagtgagtaaagaatactcagtaagtacaatattgaactagtaaaacatacgcaggtttagtgcaataagaaaccaatatgaagcatttgcttttcattaatttaaaacgaaggagacaaaaaatagtagttccctcccgagcaggtgtgaatatcctcttagcattaccggtaagccgagcaagcgtgatcagcgcttcttaaggatcatgaataaagatccaaattgcactcccataactacgcatggtacttgaataacgtaaacagaaacttccggaagaaagaaacatgaataacgtcgtgaacttgaacatgaagtgaaatatgaatatgtaacataataccaaaaccacacaattgataataggaagcttcgaataataattgggtaaataaaaccaacaaagcaacacagtttatccatcgcacaagtccgtcttgtacttgctttaactccttcgatactccgactcaactccttcaacgttggaacccttcatacctgtggagcaaaactacgcataaaccactatatcgaactaatgacagatataagggatatttactaaaatcgataacctgaacatataaaataacctatagcagttcccttactattttatacgtaactcacaaaccgtctaacggaatctagcaaataatataacttcggacatctagacaaaattgtctacaaccttcatgttgagtgaaaaatcagattatgcctctgaaaatcccagattaaggaaaacgaatttgctgtcctgatttcaggacccggtcagcagtactatttctgttgtttgtcctaaaccgtttatcggaatcgagcgaaaccagcggcgttagaaagatatcgtcgatgactacaaactttatttaggacaactaacctgaatcgtgaaggtttaatgtcagttttgaaaataccgtttccagcccataaccaataatctcagaaattgcacaaactgccaacgaattaattcctattgaaatcttttacatctagagactaaaagaaagttccaattgcagagaaacactactttgcaacaaatttccctaatctgcgaaatcgctgaaattccccaaagttgttctaccttttccttcccttgttactcctgttcaactgcttcctgtgctgtctggagccttctcgtctctgatcgatgcagcagcgtcaagcagcaagccacgctatagcatgagcagcagcaggaacgttagcatgcacaggcagcggcaccaacaccagaacagatccaattggcggcagcattagggaaaacaggaacagcagggaagaacacagcagcagctcaccaaggagacgagcggatggggtggcgaaggacgacgacggctgaaccggcggcggcggcggcgccggcggagacaggaacagcggcggcggtggtaggacgcaggagatgtggcggctagggcttgcaggagcgatccccctgtttttttttcttttttgtttttcgtttttcttttggttgggtatataaggagactgaaaagatctaacggcccacattgttttaacttatagtctatttgcactactcggcgaactctatgcatccacgattcctgatcgcttattcgaacaatggtttaaaaattaaacttttgcgcatttgttctaatattccccaaaatatactaattcgaaactcagggcattacattcttcccccatttaaatcgaaatcgccctcgaattcgcccaaccatgctcaagaacaccgggtattacagtctattagtttgtgtttgcttagctttgtttctgctatcgtgaactttctttgtgagttttcttctatgtgaattatgtaataattggctgtaactctttgagtaaagactaggatgtttcattccattatataaaaaatatgtgataacgacatgttttaacgtgtattttcaccatgttttataagatatttaaatgttttagttgctgattttttttgtttcaccatatataacttaatgtttcagttgttggtcaactgcaatatttgatcatcctcctattttttggaggcattgggcgtcccactcccatgggtagattcctcccgaaattgatggctactgactatctaagatgccattggcatcgggcgtccgcgatgccttcttcttcagttctccttttacttcttggttgcactgtagatgaaatgcacggtagctctaggatcatcggctagacaaactttgttggaggcatgccatgaagcccttcggccagatctaccgaaaccatagtaccagcaaggattcaagccaaagacatcaaaaccattcaggcgaagccctatggcgaaagccataagcgaagatggcgaaggctggaaagccgcatcggtactccgaaagtaaaggcatctcgagcgaactacaaagacttcgccatgacgagttcggcatcaaggaggaccaacaggctgcccccggccttttaggcccgttcgccatagaccaggcccagcctatcagcccattaacggcccatatgtacaaatgacactgcgtacccatgtaaatgtccctttcataagggcaaccatgtaaaatcccctataaccctaaaccctagaaggtgcaagcttgtgctaaggctataaatagacctctagggccatgtaatagggggatccctaaaaaattttacgaattaatacaattgcttttacattccaaatattgttgagagaaccacgcctttcaatgtgacatagttgtccattcgacaacagctggcgccgtccgtggggatacccagaccgaaagggcaaaatgggacccttctcgccacacgccacgcccttcgccatagtaccaataaggtacgtcgtcaagggctgcgggtgaataggtttcgccacacccacgcccttcgccatagtaccaataaggtacggcgtcaagggctgcgggcgaagagttttcgccacacgccgcgcccttcgccatagtaccaataaggtacggcgtcaagggctgcgggcgaagaggtttcgccacacccacgccctttgccatagtgccaataaggtacggcgtcaaaggctgcgggtgaagaggtttcgccacacgccacgccccacgccacgcccttcgccatagtaccaataaggtacagcgtcaatggctgcgggcgaagaggtttcgccacacccacgccctcacgcccttcgccatagtaccaataaggaacggcgtcaagggctacgggcgaagaggtttcgccacatgccacgcccttcgccatagcgccaataaggcatggagtctagggctgcgggcgaagaggtttcgccacaaccacgcccttcgccatagtaccaataatgtacggcgttaagggctgcgggcgaagaggtttcgccacaaccatgcccttcgccatagtgccaataaggcacggcgtcaagggctgcgggcgaagaggtttcggcacacgccacgcccttcgccatagtgccaataaggcatggcgtcaagggctgtgggcgaagaggtttcgccacacgccacgcccttcaccatagtaccaataaggcacgacgtcaagggctgcgggcgaagaggtttcaccacatgccacgcccttcgctatggtgccaataaggcacggcgtgatgggctgcgaggcgaagaggtttcgccacacccacgcccttcgccatagtaccaacaaggtgcagcgtcaatggctgcgggcgaaaaggtttcgtcacacgccacgccctttgccatagtaccaataaggtacggcgtcaagggctgcgggcgaagaggttttgccacacccacgcccttcgccacagtaccagcgaggtacggcgacaagggctgggggcgaaaatgggttaaggagttgctcccaagagcagccgaaagagatttatcatttttcaagatgctccgaggggccggcaaactcaattggacacctgagtgtcaagccgcattcgatgggctaaggtagtaccttcggcactagtgtaaaaatccatttggaaaaacattttctgttgattcggtgtgccgaaagagttcattaccggcaataacaagcggtttgactccgagaagtccaaggaaatatgtgaggggctaaaacttgaaatcaagttcgcatcggttgcacacccgcagacgaacggggcagccgaaagggacgaacggcaaaaccctagcagcactaaagaaaagaccgaaagccgataacagttaaaaaggtcgaagtactaaaaagaccaaaagccggcaatggtcaaaacgatcaaagtacctaaaaatacctttgccaaaggcaaaaaggggaaagtacaagccgaacagccgtaacacgcaccacaccccatttatttgccaaaaagcacaagttacagataaattccattgcccaccaaaaggcattcggactttacatccgattcatcagcaaaagcagtcctcaatggcgaaggactacccccttgagcatcttcttcatcgctagttgttagatcaacacaaaaaaaatttaaagcggcgaagaaggaaaaacggggattatgctgcgtcgacgctgggcaatggcaaactgacgctcagtcatataaaattcatgggtgtcttcgccttttttgtgtatgatatttcgtggaaaaaccccaaggcaaacgtttgatcaacgaaaacaccaggggggcgatacgaatcggtcgaagcatagctcgccgaacgttgaaaccgcgaaaccgcgacagctcgttttcagaaaacataccgatcgtcgctacactcgacttctgcaaatacttaagcatttctggatgcatatgccaaaagtcgagagcgaatgatgcgggctaaaagtcaatgtgaattccttttgctaacacacaaggggaccgacatgcttcacccttccgaacgtacaagttacaaaatgcaatgatagcgaaaagaaacttaaaaacacgcacaagctccatcgggcaaaagcacatacgtgttatacaaaggagcaaaaaattttataagtatattacatcatccgtttcaggacattttcgcctcgcccctactaagtccggcgaacacggttcgtcatctatactgtacacgactttaaggtgggaaggaggcgaaatacataccgacgtcaagcgatagcagctcaatgattagtcatttcgaagtctaaccaaagtgtggcaatgtcatcgcggcgctggatgtggcaccggtcgtaatcctctaaggttcgaccaggatgtcttcgcctccaattcgccattttgacaaccacatagctacataagaggcgaacgcttgattgacgaaaatgccagggggacgaaacgaatcggccgaagcaacgctcgccgaacattgaaaccgcgatagcttgtttcagaataaagatactgaacgccgttacattcaacttatgcaaaacacaagcgtttttcccagcgcaaaatgctacgagtcgaaaacagaagtcgaaagctgaaaagtcaacaaatcttttcgccaatccccgaaagggggccgaacgcatgacttttggcaaaatcccctctaaaacaacagggaaaaggggaaagaaaaaaaaatacaagtcaagaatcgtgcaaagcagacaaacttggcaaaatataatcacccagtgtcataatacagcttcgccattttcgaaaggcgaatgccagtgttcatattttttctgcaggagtctaaaaagaggtttcgacaggaacatcagccgaaagggggcgcctcatgccataccgtatagtttgcacggtctcggccgaagctccttactcacccttgcccgtgaggggcttgttggaggcatgccatgaagcccttcggccggacctgccgaaaccatagtaccagccaggatttaagctaaagacatcaagaccattcaggcgaagccctatggcgaaagccataagcgaagatggcgaaggctgaaaagccgcgtcggtactccgaaagtaaaggcatctcgggcgaactacaaagacttcgccatgacgagttcggcatcaagaaggcccaacaggccgcccccggccttttaggcccgttcgccatagaccaggcccagcctatcagcccattaaagacccatatgtgcaaatgacactgcgtacccatgtaaatgtccctttcataagggcaaccatgtaaaatcctttgtaaccctaaaccctagaaggtggaagcttgtgctaaggctataaatagacctctagggccatgtaatggggggatccccaaaaaattttaagaattaatacaattgcttttacattccaactattgttgggagaaccacgcctttcgacgtggcatagttgtccattcgacaacaaacttattagagaaggttagtgatttgataaacaacgttagttagtcaactggttgcatcattgccccattttcaaggtaaaccaaaaaattatcaagagtaatgcaaattaacagcctgcattatctcataagttgagagtgtagctcctgagacaagtcatctgggctgatggacaggggtggacagaaattccccgaagaccgaaggccgacccaacctgacccgaaccgaactaccggtttttttcggtcttcggctggagcttgggtttctaattttgttttcttcggtgttcggctgttttatcagcttgtagataacgcaaaccgaacgcaccgcatacaccgatctactatagcatgtcttgtgtctcacaatcaagaatggcatgtgggccccacatgtgggtgggtcccacattattttgatgtgaatgacaaatgggtcccacacatatttttttaattctagaacacataagcgccacatcaaccccatatggaccgaagactaagtcaacatcgccacgtaagcgccatgtcagcgaaaccgccctccaaaaccgccgagggagtcaaattgtaccggttttaagagttgggggttgagatatccggtattttggcttagggtcacgaattagattttgatcagttttgagggtcacagaataaacttattcctcagataaaaggcaagcagaactgaaaaagtacactgaaggtccctaaacttgtcatcgggataaaaaacgtcctcaaaccgcaaaaccagatatgtggggtcccttaactatataaaaccggtcacccgaggtccttcggtggttttgaccctggttttgctctacgtggcggctgagccagcgtggcacccacgtgggccccacatgacaggtgtccacgtcgccctctctctttcccctttcttttttctcttctctttgccacgagtgagtagcaagggacgggcggcggtgagtggggctgagcgacgatcggcggaggcggcttgcgagcgcacagcggccggcgaagtggagtggagcgggggcgcggaggaggaggcgggaaaggaggagggcggcgccgcgacagcggaggacgccggcggcggccgccgccgccggcgtggggaggcggtcgttccatgaaaacctaaccactaccaaccctcttgcccagacgcggacaaagtggcgaagctcggcgccgccgtgtccgatggccggagcgagcgcgtcaccactgcggcggacaacccagagacgctggaggaggtgattggcttctccccatagaagcttgaggctatgggtgtggacgcactcatgatctaggcgaagatggccgatgaggacgtgccgttcgaggtggcgctggccgcgggtgacaccatcaccgtgttcgacacgctagtgtcacccgacgagtagttggagtcacacggctccaacgcctgtgtcacgctggtggcgaccgtccagctacgtgacccgtcacggcgctgcgatgcgttggttgcgccctggaggctggaggggggagagagaggggggagagagaagagggtatttaggcgttgactcagcaccgaagaccgtggtgaaagcgccatggtggacaaaaccagcgccatggtggacaaatctggcgtcaatactgtcctgggacctcaggtgacctgttttatacagttaagggaccccgtatatctggttttgtggttcgaggatgttttttatactgatgacaaattgagagaacttcggtgtactttttcccaaccagaaccagtcaaccacaatctcatggaaaggcatgctgaacttctctcgatatttagggagtcgctgcactaatccctctcggaagtgcggagcaagcaaaaacgttgaggggcggagcctgcgacacgagcagcggagcgggagcgcgcagctagcaggatggcgagcactggcgctcgtcagagcggcttactccatggcagcgctagagctggtctgcggaggactcggcggcagcgcagaagctctggttgaaggggcacttggcggcagtgtcagaacttgtcgacgccgctgctcagtgccttcgaatcgagtggtatcggcgcatccgcgcggtcaaaactgaatcccgtaaaaaccgaaccgattttcttcggtttattcgggtcggttttattttttgtaacttttctcggcttgtgttttagagaaaccgatctaggagaaaactgaagaaaccgacccaatttatccgagtaaactgaacgcccacccctactgatggagttcatgaaactattcatttctctgcttgggtataaaccaaaactctatacaataattctatgattggattagaacattcataggtcaaacgtcactcacgtacacctttcttctgaagactcgcacgaagtacgatggaatagattagaacatcctccttctgtcccgaaaaactgtactaatttttcctaagggttaattagatacctatcatgtgaaatcattgtcatgattaatatttatgatgaacaaattgactttgtaaatgatttaatcaatgaagtggtttggaattatgtgtggatgtttgtgtgagtgcgtgtgattaatgtgggtcaggttatgatatatgtactcaggaacgattgttttatctaattcgattgttttatctaattgtgtgcaggtgacttgaggttagtcttggtcaatggtgaggaccgggactatctcagggaggagcagaggtctagtgcgatcgggataccatgtgagaaggtaagagagtcaggattcttgaaggacaatttcagtcaacggtggggatcggaactagactcaataaggagttgaggtccagacggttaagaatgccgggtgacgaagttggatacgacagtactacaaaaaccctcatagacaacgactcaaggtgcaaggttcatttaaaaccgataccaatgtagcttttcccacctccctacgatgaaaaaacataaaaccgacacctatgccagttctaacaaaaaaaccgacacatatactataggtgttggttttttaaaagaaccgacacctataatatattataggtaccggtgttttttttaaaaaaacggcacctatagctttgagccaagcccatcagcaccgcacccaccgcgcatcattattatctactcgtttctccgtcaacccttatccatccaccttctttctctcgtttctctgctctcgcgtctctcttcctccctcctccctttctctttttttctcacggtggttgcccggcgaaggcggcgggccctgcggctggtagctggcctagcggatgcggcagcgccctcccctcgcggcgggttccgtggtcggcggcgggcaccccacgagcaatggcggcgggctcccctccgctagatccggcgagaggggagcctgtggggcaggaagtggggatgcggcgggctcccgcaccgacggctgcctggcggaggcatctgcggcgcacctcagcaacggtggtggccatgccatccccatgcggcgacggcgacaggggtggagaaggacgccgatggtgcgggcgaggtggcggccccggcatgagttcttgattttttttctttttgagttcttgtgttcttgagttcttgttgagttctagtcccaaacttgttgagttcttaatgctttgtaccatgcatatactagtttgttgttgattttgatctcggatccgagagacggtgatgaaggggagtagtgctgggctcgagggaggatgacaacaatggtggtgtgtggttggtgagtttagctcgattcgagccgtctctcttttttttttttgctcgagcaaagctaatagtgccggttctatttttccacataggtgccggtttcttgtattagtgccgattgaaaaaccggcacctatagcccgttcccaaccggcacctatgatggtttcggtactaatgcgagatggcacacgatggatggatatcgtgtgagagagatcttcgcaacgggtttcacgagatgtgcgtgcaagcgtcggcgttcgcgaaggaaaactggaagaaaaattgagtgattgctacagttctcgcggtactgtagcatggcatgcatatgtgtgtgcactgtgtccgggctggtggcgagcagtatgcatatgttgatgcatgtaggtgtgtgttgacgtcagcttgcatgcacgggtttcggttggctcggttggttagtaaaccgagtcggctagggagcagcagcggtcggcctggtccgagccggcccacgcgaggactcgcaggagtccgaatggaagtccggctgcggttttggagaaaaagaaatatgatggattgagtaatatcgtgaaatggagttttacacgtcctttaagttgaagttgaaggttcttggtataaatagagatggaggttatgccttaaggtaagccaagtttgagagattagagtgataatcctaattcgcacgcgcgcgccggcagcgcgcactcccggcccatacggcccacgcggcgcgcacacgaaatctaaccaccgctgttttcttttttttccgctttcttttgctttttttcctgattactttttaatcttccagtagcaagtgttttcattttttaaaaaagtttttaaatcttgacttgaaaatttttaaatcttaatttaaaaattttcaaatctcgagttgaaagttttcaaatccgagttgaaagttttcaaatctcaagttgaaacttttcaaatttgagttgaaagttttaaaaaattttcttgcaaattgaaatttttcaaagtttgagttgaaagttttcaaaatttgagttcaaagtttaaatcttaagtcaaaagttttcaaatgtaacttattttttttcaatctattagtaaaaaaactctcctaataaaataaaaaatctattgttaattaccatcattatctttaactaacagagttagtaaggctaccgcgtccttccgaaaacgtgtgccgcgtgcgcgctagttctgctcgcggcgcgtacgcgcgtactacgaactcccatattagagagggtttcgtgagaaatttataaggggtgttgtagctacaccttgtgaacaatatatttaagtgataaagatcatattcaatcatcaaggcatcgatgatctattctggtttcgtaagttttacgtttatatttggttttggcattaacttgtgattgtttgttttgctgcgattttgttcaagttaatccatccaaaacctttctaatacttcatagatcagatctggaaagtttcgttgattggttcttactagattcgaatttgcttaagttttaggtttagttcagatttgctaaaattctgagacagctgactttcgagggtgttttctcttaaaccgtttatagtttgcaaatctctcaggtggagttgttccttagtttatttagtttattctatcgagtctgcaactcgatctaatggttggtttaagagagatcaagttttcacagaagcgttgtcgtgctggttttagggctgacggttagaccgccgagtgacctgcggttagaccggctaggttttggtcagaccgactctagtaggtcggatagaccgccggacgtgtattccattggtttttgaggttggggtgtacttttaatctattaagattcgattatttgttttccgctgacataatctaccattcacctcctctggtaggcttgtcatcgtaacttttgtagttttgaaatataacactaccatttatatatttgaacatatataccattataaacttgtagatattggatatatgcctctcactgcccttacaatgaaattttggactaacttagcatttcttcctcctccatcctctctcttgttcatcttctcgccaattcgatttgataaaaattccattagcactattccgcgctctacagcgcggaatattagttcgagtgccgcacaacgctctctccttccggttttcccttttttaccaccccacctttcctccgcatcccaccttttctcggttcgtttttttcgttttttaccactccaccttccgtgtttctttttctcttttccatctcatccgtgcttcatcaatgggcccactaaaatattaaccatccagatttttctgtttttggttccttctctgtagtttttctgttttcgcgttttagtaaaatatttaccgtctagtttttctttccgagttttccatttttctagtatctccgcacgtttcaaaagtaacgaatttactccgtggagtttttcatttactcccagcctcccacatctgctcatttaaaagtaacaaatttactcacatgaatgtctccacatcgtatgacgccatacctagatggtcgtaaaagaattactaccagcttacaatgctagtagttcttttaccaatattataaatattgtttagattttgtggtatgttagtaaaacaattactaccttcctctcgatatagcccatgatctcgtaaccaccatgtagtaatatgtttactgatgtgttcaatacatagtataagagtaaaaactgagattccttggtctgcgagtaaaacaattaccaccttcctctcgatatagccatgatctcgtagccaccatatagtaatatgtttactgatatgttcaatgtacagtataagagtaaaaaattgatactaagagtattgttgatctgtatcataaaatagtcatacaagtgaaaaaattacaggctcaatcacacacaagcgataaaattactcacaggtgaatcaaactagaaatgaaaaaaaatgattcagctaaaaatccatctggtggctttgctggatcttgctataaggatgaagagaacagtctgtgtcttctgactggtaacacagactggtagtggagagggcaaccagggagcgagtagtagtcgacgatggaataatagaaggatgtagcggtatggtatagagatgagcccgacgttgcgcagccatccatcatctagcaagcacgaaaaaatgtaaaaacattctcgttcatgtcaatagagatgacgagcaaaagaaaaatatcaaacaacctacatcaccgacggactccaccctatcctctacggccagccacatggagcacgatgtgcaaatgtaggacctgtgcagcccatcaattgagatcaggtaatattggagattgcacgttaatttgatttgaaaaaaatattggggcttcatgcatgaagttgaaggagagtatgcagatgcaaatcaaagtgtcatttccttacttgcttattctatcaatgccgccgacgtggtggagtagccgctggttgttgctattggcccaggtgaataccttattgctggttaaggtgctgcccaacgtccggcaacgaggcccgaagcagtgccttcgcctcaaccgccgccggccatcgctcaccggccaccgccatcaaccgccacggtgtcatcgtcctcctccatggtgtgtcgccgatctgtggggtgggatggtggatcgatttagatccaaaaaaaagagaaaaaaaaggaagtgaggcgagagtggttggttgggtacgggaaaaatagaatatataccgaaaacagaaaagttgtttttatcgaagtaaatcatttactccaataatggtcggagcacgatgcgggacgtggggtgggatcagaagcaggggagttgtttttattatcaaagtaaatcgtttactcgaataaaggtgggtggttgaggcgtgcgataggagtaaatcgttgacggagcgtggggctcctcaccgggagaccgcgcaggcccccctttgccggttcggccgggggcgctaagtgaggttcttcgccctcgatctgaggaatgtcagcgagaagaagcgcacaagacacgggccacgtagacaggttcgggccgctgagaagcgtaataccctactcctgtgttctggtggatctgtgtgtgaaggaaaacagagagctccagagccagagagctctagagcgagagagagttcaggctctccaatcaagtggccagcctctcacctcccccccccttttttctctccttaggcctgggcctcctttttttatctggttaggggtcaccacatgggcctctctctgcctaagaaaagaaacatgttttttacaatgagggctaatctacagccggaaatgacctctgacaagcagtacacacgcctcctgctccgctcgtcagctctcccggtggacgcccgtttcatacttcattcaatggccagcgattttcttgccatgcttgcactgaagcctggaatggatctgaccgggactgacataccaactccaggagtcagcacgccagctccggctagagacgagaaccaggaagctctcatcattccgacgggacggggcgaggcgtgcgacaggccgcctgttgccacctaacccgcgatctgaccggtctgtgaccggtcacataccgcgactggtcacagatcggataagcatgcgctgcgccgcattgaatgcggcgtgacgcgctcgtctaacccgctataaatgcggttaagtgagcgccgctgtgctcacctaacccacacacgtggcgccaatcaccacagggggtcggggtgccccagccctcggggccgaaacaggagcggcccgacccctcggggagacagagggagaggtggccacgtcaccgtcgggcccgacccccccgagggggtcgggccacgtgagtgatcgcggctacccaagcctctagtcacgatacccccggccccatgtcaccgacagtagcccccggcgtcacgccagggcgaccgcccccctcgagggaggcgatcgggcatgatgccactccttaggcccggtgacaggtggggccggtccccacaggcaggcagaaacccaacggtcgcaaatcgcgcgcatcggcaagggagaaaccgatcgacaataatgagcggcctcttcaagaccgctacattactcgagcagcgcgcgaatcgggacgagccggtttgtttcgcctggggacatgatgatggcgtttttcgcggttggcgagcgcggttaatgcgcgcacgatctgccccatctcaaacgccacggccgcacatctatcgcgtgcgccgcaaacgggcgagtggggttagtggaggcgcgggcgcgagaaacgagggggcgaggtagtgggtgcgggaagcgaggagccgggcatagcgttggcaagggtacaaagacgccaaggaagggatttgtttccttcctctcgccactctcccccttgccttcgccacttgtgctctgactctccgtttcctgcgccctaaccttgccatactcgctcgctctcaagctcctcctccgccggcgtcatggcacggggctccgcaccgctcgagggtagcgtgctgccgctttcccgcatcgtgagcgagaggcaggccgggctgccgcgccgattcaagccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcacacctcacccccaacgcgataatgacattggccatctttgcgcacttgtgcgagatgtttatcggggtacacccgtctctccggctgttccggtggttcttcaccgcacagccggtgtcgccgccgacggtagtcggtggctgctacttccagccgtgggggcaggtgctgaaccgctacattccctgcgtcgttcgcaaaaagtgggacgactggaagagcgattggttctacacccccctcgccgacgaagcgcgcctccgacttccgaaccagcctccggcgcaagcctccagctggcgggcggcggtagatctgggagacggctacgacgccgttcttgaccgcctggcgggtctgcgatcccaggggctcacgggggccatggtgttcggcgactaccttcgtcgccggatcacgccgctccagcggcgcgcccggggcgcctgggagtacaccgggcccgaggacgtcatgaggacccaccaggggcgcaaatgggactgggaccctgaggacttcaggatggtggtccaacgggtgcttaatctcagctccgtggaggcatccctcatcccccaaggggtcctccccctctgctgcgatccagagcgcgccaacatcctgaccatcatgcagtaggtcggggcgtcgggggagcgggccccccgaggccacgatggcgtgggcgggagccgcaggggggaacaatctaccccgggagaaggtcgtgcttctgggccccgcgacgggggcccggggggcagccgccctgccgacgcccgggggaagaggaagcaggagggcacccctcccccatctccccgaggggacggggcggtgcgtgccagcagcaggcgcccggagggtgccgtgccgacgccgcagcccgagggggagcgaaagaagaaacggctccgcaagatgggggggattgtgccatgccgggggaacctcatctcgcccccgaggtggtcgtttagccgacctccccgcaggttcgtccccgcgcccatcgcggccatattcattctcccgtctcccaaggcaagttttcactcacccgtttctttttgtcttctggtttttcttccgcctcagcgagatcccgtcgcccctccccccccccccccccgcccttccaagtccggccggtctgaggccgaggagacggcgaccgcggaggcccggaggcgggaagctgaccggcgagaagccgcggaccgtctccgagaagccgaggaggctgcccaggaggccgtccgggttcgccaggctgaggtggccgctcgggaggaggccagactccgccgggccggggagtccgtccgggaggcagaggcggcgcgcgcacgccaggcggcctgccaaaccctcgacccgactccgcccgaggggacgacaacttccgaggccacccacgacgaggccgcgggcacgccgctcgggcccgaccccttgggcgacacttgggacgagccagcttcgagggacgcccccgagtccggcacgtcgatcggcgggccgagccgcgcggcgcccacaccgaggcggctctcccctctgtcttccgctgccccactgagcgcggagcccttcctgcaggccttggccgccacgaacagcacggtgctggacgggttaagtgcccagatggaggccctgcaggcggagcgggcggagctcgacacggcgtgggcgcgcgtcgaggaggggcggcgctcggtggaggccatggtggaggcgggccgcaaggcgcaccaccggcagaccacacagctcaaggcccgtcgtagggagctggcggagattgccagggaggtggaggaggagcgggagactgccctcatcgccaccgccgtgctcgacgaggcgcggaacgacctccgcctccaatacgggagccgggcggcgaagctggaggagaagctcgacgccgcccggggagtccttgatgtcgccgctgcccgggaacggcgggcggcggagaaagaggcggcgtcccgccagcgcgaagaggcccttgaggttcgcgccacggcgctggaggagcgtgcccgcgccctggacgcgaaggagagagacctggcggaccgcgaggccgccgtcgccacccgggaggcaacactggcggcgcacgaggccgcctgcgccgaagaagagtccgcactccgcctccgcgaggacgcgctcaccgaacgggagcgagctctcgaggaggccgaggccgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcaggcgaaggagctggacacgagggcgcacagcggcggggcggccgcgggccacagcgacctagccgcccgcctcgcagccgccgaacacaccatcgccgagctgcagggcgcgctggactcgtccgctggggaggtcgaggccctccgcttggcgagcgaggtagggcccggcatgcttcgggacgccgtctcccgtctagaccgcgccgggcggcaggcgggtctctggggcgggcggcacgcgaagtacgccgccaaccaggggggcctcgcccagcgcctctcagagatggctggggccctccagcggctccccgaggagctcgaggagacgatcaagtcatcctcgagggacctcgcccgggggcggtggagctcgtactggcaagctaccaggccagggaccctgacttctccccgtgggcagcgctggaagagttccctcccggaaccgaggatggcgcgcgcgcgcgggtccgggacgccgccgactacatcgtccacagcttcgagggtacggcccctcggctcgcgttcgcgctcgactccgacgaggagggcggtgacgacggtgcggacgacagtggcgacgaggccgacggcccgggggcgccggagtgagcccccaggcccccgccaatcttaatagcttttccttcttcttccgaggccttcgggcccccttcttgtatagactgatttaatctgtaatcaagtaaagaggaaatttctgcgtcagttatgtttgttgtgtgtatgagacgaggatggtctgtgccgcggtccttctgtgtcttggcttgaacgagggctcgtgcccaggtcccaacctcaagcggcgcgggtgggggctagtgcctggggagatccgcatgtcgagactggccaggccgggagcgtggtgaccgagggttatggatgacccgattgtgggcctttgccgattccccccccggagttcaccacgccccggggcacggctcggttctgggcctcgtttggcgattttagccggcccgggccaccgagggcagggtcgagcacgagcgtgctaactcaagccaagattcttcaaaaggaaacgatggcacaggcacagtcctcaggaaatcgaaaatgcttttattgaaatacggaagagaaaaaagataaggatatgcatgtggtagcccccggccaaccctgcacgcccggggggtgcggggttggcccgagcccgagacatgacgcccgacccccactaggggtagaagcgacgaaggtgttcgatgttccacgggttaggcagctctgcgccgtcgcccgtggccagccgaacggagcccggccgggggacaccgatcactcgatacggaccctcccacattggtgagagcttgctcagtccagcacgcgtttggacgcggcgtagaacgaggtcgtcgacgcagagtgatcgggcccggacgtggcgctgatggtagcgccgcaggcactgctggtatcgcgcggctcgtagggccgcgcgccgccttcgttcttccaagtagtcgaggtcgtctcggcgaagctgatcttgatcagcctcgcaatacatggtgacccaaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctagggtgggcgggggaggcgaagcagagcttgatgcccatgtcttcgcagtagtcaccgaagagctcactagtgaattgggtgccattatccgtaatgataccgttaggcaccccaaatcgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaatggccacgaaagaggtatggtctgcagggcctgggccggctgatgggtttgcctggcgtggaactggcacgccctgcaccgccggaccaggtcgaccgcatcgttgagagccgtcggccaatagaaaccctgacgaaaggccttgccaaccaaggtgcgtgaggcggagtgggctccgcactcgccttcatggatatcggcgagaagctcgacgccttgttcccgaggaatgcacttcaggaggactccgttagccgcgcgccggtagagggtcccttccaccagcacgtagcgcttggagatgcaccggacgcgttcactcccttcgcggtcctcgggtagagtcttatctacgaggtatgcctggatctcagtgatccaagcaatcaatctaggggagctgggagcgcttccctcgggtcccgaggcctggactccgacgggcctcaggggccgttcaggcgcgtccgtctcccctagggggtcgggtcgcgccgacggctgggcaagcctttcttcaaaggcgcccagtggggtctgggctcgcgaggaagcgagccttgagagttcgtcggcgaccgcgttatcccgtctgggcacatgccgaagctctatcccgtcgaaatggcgctccatacaccgcacctggcacacgtaagcgtccatctacgggtcaaagcaccggtactccttacagacctggttaacgactaactgggagtcgcctaacaccaggaggcggtggatccccagtccagctgccactctaagtcccgcaaggagtccctcgtactccaccatattgttggtcgcccgaaagtcgaggcggaccagatatctgaggacatctccgctcggcgaggtcaacgtgacccccgcaccggcgccctaaagagacaaggagccgtcgaactgcatcacccagtaggcggtgtgaggcagctgcggggggcccgagctggcctcgggggcggagacgggctcgggagctggggtccactccgccacaaagtcggcgagggcctggctcttgatcgtgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaagtaatggcgcagcttcctcgaagccatcagaatagcgtaaagcatcttctgggcctgagggtatcgggtcttggcgtcccggagggcctcgctaacgaagtagatgggccgctgcacctttcggcggggccgatcctcttcgccaggggccgcatctccagggcgctcttcgtccgagaggcctcgcggccccgcactcggcttctgtgctgacgacctcggggtcagagggcgataggcgcggccttcccgcagtggccccggggccatcctgggggtcgggggcgcctggcaccgtcggacaagcaggcggagggccagctccggccgtcgggggcctcgggccgccgttcggctcgggggcctctcctccctgctctctcccgggtcgagtcgacacagggtggggatgcacggggtgagggttgtcctcgtcgcgctccacaaccaacgccgcgctaaccacctgcggggttgccgccaggtagaatagcaacggctcatctggctccggggcgaccaggactgggggagaactgaggtacgctttcaactgagtgaaggtccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgctcgcaggcacgccgaacaggcacttatcggggttcagctttatgcgggcggagcggagacttttgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagtcactccggatggatgacctcacggatgaatccggcctccagaagtcgcgccacctcctcgcggatgaaggcttgacgttccggggcctgccgccgcactttctgccggaccggccttgcgcccggctgcacggcaagacggtgctcaatcacctccctggggaccccgggcatgtccgccggtctccaggcgaagacgtcggcgtttgcccgcaggaaggagacgagcgcgtcttcctatttatcgtccagaagaccaccgattcgtgtggtcttggacgggccgtcgcctaggacaacctccttgaccgggacctcgtcgcacgtgaccatccgccgccttggggcggccgggacggaggtgctgagcctctcgtcgccgcccgcgggcttggacgccgcggcaaggtggtccgcgcgttgctccatacaagcaagcgcgactttgaggtcgccatggacggtgatggggccactggggcccggcatcttcatctggagataggcgtagtggaccgccgccatgaactttaccaacgcgggcctccccagaaccgcgttgtagggcagactgaggtccgccacatcgaagtccacccgctccgtgcggaagttggcggaaccaccgaaggtgaccgggaggtcaatatgacccagcggccaggtgtgccccggcgtcacaccgatgatcggctgggacggccggagcaccatccccgggaccttgatggcgtcaaaggccgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtaagggcaacctccgaccaccgcgcccgccgcgtcgcctcatggtaggggccgcggccagaagctctcacttcatggccttgaggctccggcgagaagcgtgagcgcacgctcccccatcgacggtggcgacggtggcctcaggctcctggaaccccaggtcatcgtcgccatcgtcgatgtcctcggcgatggccttctgcttggcctcacctcgccggttgccggcgggagccgccagggtcttgccctcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcgaaacgggccgaccccttcttcctcctcctgtcccgccgccctgaccgagcggcggacccgggggcggccgaagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcgtgcaagtccgcttcttcgcctgggcgcggatatgtgccctggaagttcgtggtgaactgcttggcacaaattctcccaagagtggaccgacgcggggaagaaattagccatgaccctgtcgtcacccccggcggcctcgatcccggtcgtgtagatctggagaaacttggcggggttgacgcttccgtcgtatttttcggtgatggtgggccggaaccttgggggccaacggacgttccgaaggctcgccacaaaggctcgacagccggcaccgccaaccggggacacggggggccggaccagtgcccagaccgaagcggcgctccggacgaggaagcgccctccgttgcgcgggcggcgtgacgagcgtcgcgctggcgctcgatatcgaggcgggcatccggccccccacgcacatcttcttgggttggaggcattgacgagggaatggcggacgaatggcgggtaacggccgccgctcgccgcgccctccgcctcgacgacttggagccggcggcggctgcgccagaggcctcggtggcggaggaccgcccgccggcgcctagtcgctgctgcgccgtcatgaccaagtcggccacgtcatccagccaacgtcgggctggagtctctggatcggggacgacgggcgggtgacgcaggagcgcgcccgcagcctggagcgcgccctggggcgtaccgccatcgccgtagacgaggcggcgacgcgctccgtctcgccgtcctcccccgtcgaccgcgagtggcgaagtcgcgtgtcctccgacctccctgagcgcctcccccgcccaagatttcggcgagagggggacggtggggtgcgagcccgacggcgcgggttctgctccccgtcgacaccgctagcgttcggagagaggctgtgcgccactgcccgttcggccattgggctgagcgggcgaagcttggcgcacacgaaagaggacgagggcttcgaaagacacgcgcgccccctacctggcgcgccagatgacggagcgtggggctcctcaccgggagaacgcgcaggcccccctttgccggttcggccgggggcgctaagtgaggttcttcgccctcgatctgaggaatgtcagcgagaagaagcgcacaagacacgggccacgtagacaggttcgggccgctgagaagcgtaataccctactcctgtgttctggtggatctgtgtgtgaaggaaaacagagagc

SEQ ID NO: 10681 - DNA, 24203 bp, Oryza sativa
  unsure (1)..(24203): unsure at all n locations
ccccccccccccccccgagggggtcgggccacgtgagtgatcgcggctacccaagcctctagtcacgatacccccggccccatgtcaccgacaatcgtttactccgacaatggtgggagtgggataacgggacatggggtggggtgggcctgggctgggacatggggtggggtgggcctgagctgatgcatgtttggcgcttgtaatattaggagcgcgcctaatagtagaactacaatttaatgatagattttacatcaaggaccttagaagtttttggccatgctcaacacttggataggtttaacccaatatataactaaactaattcctaaaataatatgacactataaatcttgaaatactagcacttagcaatacctacgggctaaaaatcacaagcacgcccattttctagtcatatcttaactaatataaatattgctatttttccaatcgtctcatcctctgatccgcattttttcgtccatcaccgcgtttttccgatttctaatctggcgctattttttccaccgcatccgatttcggatcgggaccacctatacatttgtcgacaaattttcttctaaaaatttgataggtgtaattatagtacaatcgtagtgtaattatactgtaacttatatgtaattacagtgtaacttatatgtaattacgctgtaacttgcatgtaactaccgtataacttgtatataagtttcacgtaattttgaatcgttaaataaaaaatcacagcacacacatatgtgtaaggatttgttcccacagcctccattttaccgaaataaaatattacagaaagatttttgaaagttacatacaagttacactgtagttacagtgtaattacatgcaagttacagtgtaataacactacgataactgcagcgtaattacatgcaagttacagtgtaataacactacgataactgcagtgtaattacatgcaagttacagtgtaattaaactacgattgtactgtaattacatctgtcaattttttgggataaaatttgtcaacaaatatatagcaaaaaaatttgtttcggatcagatttggttagatcgcataaaaaaagcgcgcccaattgtcacgcaaaaaagaaacccacaccgattcctactccagtttgagattaagcccataggcctaaattaaaaaaaaaatcgcatataccgtctgttccaaaaaaaaaaaaccaagtcgttcggcagctagcccgtttccaaatttccaattcgtacgcgaatatgataaagagaactttgaattgtcaaattggactctaatccacccaaataaaatcagcagagggatccatgagagaactccaatccaccccaataaaattgcattgcaacatgaaacatgagaactccggtaccggcatgaacatgaggcgagatgcaccttggactgacagacgcgatgtggtggcggcacgagcttgacgcagcgcgtgcgcccgagcaacagtagacaacgcgcgccgccatcgctgggaccaccgctgccgccgccctccccccttcggccagatctgggagggaggggagggagcgccgcctccgccaccgtggctccctcctccagccagatcccgcctcgacgacctccccgccggccgtctctcccacgtcgccgctggggaacaactgcctctccacacgcctcagccgcccctgtccggatctgaagaacggctccacgacgacgagcgcccatggcctccaccgcctcccgccgttgctgacgtgctgcgccaagccgccagcagccacggtgttcagtgttcacacatggatggagacatggagtaggtcgtgggaggataagggcagccacaatgtggccataagaagaggccataagattttatagtgaccatatacattgtgaaacaaagccataaggcattaaatgcaaaagaaagctttaagcttatggcttgaccacaagcaataaaataatagggtaaaatgaatgtgatgatgaaaaatttgcatggctgataaaagaagtactagaatagtacattgtgggacccatcttaaagtttactcttgcttcaaacattgtggtaataaccataaaaatagtgagacacaccttaatgctactcatgatcataaacattggagatgccctaaggctgatatggccatatggggtcggctgactgggtttcgacaggacatggacttggtctatagaccatggagcactatgggctggttactgtgctgcgcttgctgtacctttttgttttttttttcccttcaatgaacgggtttgcgtcgtcgactcttcgtgtccccgacatcagcattaattctgctccgtcttcgtcgtctagccccgcgcaactttgacttaatcaccgttcaagagctcggctacaacgatttcctcgacaatgccgtgatcgactacggtctacgcggcatctctcactccagtgtcgtactgtgcgtggttggcctgatcacccaatcaagcgcccatctgcgacacgtcttcatgggatgaatcgtcttcgagcaagtgtactatgccaagcttcggtctcttctatactatccaacactggaagctagggagggagggaggagctccacctccatcacctgcagtggccgcccccaccatcgctcccctcctccggccatatccaggagcgtggagggaggaaggggaggtgagtgtcgcctccacgccgccgcctgcaatggccacctccatccgcgaaaaaaagacgaaaaaaaattaaatctgtccgattcaaaaaaagaaacaaactcgggcgaaaaaatggggcgaaaaataaaatcgaatccgattacatgtgacgcggtaaatccatccacgggaagctgtcggcgccatcggtgaagccggatcggtgatgtctacgtcatcgctggatccaccgcaggaagccgccggtatcggatccggccgcgggaagccaccgccgttgggaggacgccgccggatcttgaggctgagagggagggacggccatcgaggccgatggggagaaggagagggggagggacggccgtcgctgccatctccaccgtaccccgccgtcgccgcgccatgccggtgagacaggagggaaagggggagagggagcagcaccaccggagggagagtggagaggaagtggcgccgccagaggggtgagaggagggggagatgcggcgccggtggggggaggctgcgtcgggcgggggaagccggcgtcgggcgggaggaggcggccgatggtgtggtggggaagggtggggggagaatgattctagggttagggttgcactggggttgttgtccatcgaaacgaacggctcagatcgatcgagtgttgggcaggcctccatcaccacacggtgacacttgagccgcatgcgggccgacagtccatcacaaacgtggaactgagaggagtatggagatgttagttagactttaataccttgcggcctgagaaaagtgggacggctcggttgcgggctgaagaagaaaatgggctaaaaatggcccatagagaaagaatgttttttatttaaataaatgctaaaatgatgtttagtttgtattatcaaaattaacaattaagctctgtaaatttcaagaaaatttcaaagagtgtaattaatatggagaatttaataaaaaataaatgcaaccatatcattttatttctcacacttagtttacttataaattaatttaattatatacctacctacttaaaaatacccaaatattccaaaaaatttatatttcaattaattagaatttaatatgtttgaattcaattttctcttttttcttcccgttgcaacatacgggcacttttgctagtattatatattttagtagcaagcaagtcgacaggtgtaatcttacgtgatgaacatggaaccatctgatcgtatagcttgatgctttattagtttctttgaagcccatcatgatcatcatgcaaactgcatagtcatggatgcaagttcttaatttattgcaagtacgatgagattgaacacttagcattttctgtttacatctctgacaggcgacaagtcggagaaattaacgttacaacaaagaatctccaaccgaggacaaaactggcatccaaaacttttgttaacttaacccagaggaatacttgggctataattactcacaaccgttcccgcttccccattcgcctacagccctacacaaacacttatatcaaaacaagttgattccaatgagcgctaatataataggctaaggtactaccttagtaaataaataaataaaaggaaatggtctccacagaatttatttacaactcaagtcatttccacatggccaacctaaacaaactgcagatatataagggcacccacaatggttatctatatgctctctacaagatattcatgtcagcatattttactatatggaagagactaaatgaagagagagagcaaagctatctactaacttggagatagtctatagagaaaaacgaggcaatatattagagagctatagatacccatgtagacacactattgaagcggtttactattaatctaatctattgctgagatgtacatgttttatagagagcaccttactttaccattgcgggtgctctaagtgaccacaattcaactaggtaagaaagatcaccataaccacagtaaactaattgaatgtttggtttgtgaaatggaatctttttgctccatcaccacctaaatccctccacgtaggcataggcaataatttctcgacgacattgaatttttcacatacgtttggtcactcatcttatttaatttctttttgcaaaattatgaaaatgcaagtcatgcttaaatacctttaatgaccaagttacaacaaaatagataataattatgtaattttttaataagacaaattgttaaacaagcgtaaaaaaaatcaatgttgtcaactattagaaaccggaggcaatacaaattaagggacaggaccatcccgccaaagttcatggcgtgatccatgatagaccaaccaattaatcctacaaggaggttctcaaataaaaaaaccacactaagaatcaaatcctacaaccaatagttaaacattattggcattatatatagtttggcgtttaaactatattaattctatcggttggttagttggtttacaaaaacatcttgcccttgtggttttggcatggtgttagagaacgtcttcaatgcaaatgatacaacagaatctaataaatatactaaaccatcatcactacgactagaagaatagaaatgaaaaggcaaaagctgaagaacgaacctgttatgtgtgttttgctaatacctcacgcatcaggctttcaggagctgtagaaagtagattatcagaaagaggaatgggtgatagcatttggcataacaaagtgtatgatataagttagaaggacacaataccttcaataccatttgtgaaacgctcgaactgacccaaggcttgtctgagaaacatctccacaccgctgacaactttaaccccacattcttctgcttctcgtagaagccgggtgactttcggagcatataccgcatcgaacacaacatcgtagaagcttagtgcttgctgcacatacaaatggaaaatattgtggccgcaatgagcggacaggtatatcaaggtagtatcaaatgtgctaattagagagcatgccaagattaattgaaattaaagatggtaacagagtagaagggagggttccaccagtttatagctggaatatatatgttaagagtttgttattgctacttcctgtaattaggttcggattccttctgtactcccgattctaattttataagttggtagagatatagaaggcctaacctatatatgtactcccgctatctggcaatagattattgtgttgagtatattccgtcttacagaatattaacatggcgtgcgtgtaagaaagagacctttggaataggggtgccatccacattggggtacattcccaacgatgttgcattagcaaggatcatcccttcttcaggcctgaaagtttcaagctcggctaatctcagggcatgaccaccaaccgcggcagcaagacttactgctttttctgaagaacacaagaaaattatcatattaaatgatgtacgtactcaaatatgatcagctttgagctttataactagtgcgaaacaagaattgatggaacaaaaatcacccatgacaatgatacaaacatggatataaatggatgcaatatatcttcccatatttcagcattgatcattgtctgagcggcataatgagtacagaacttccaatactttacactaataaaatgaattatgctttgcatatgaataattgaataactgcagccaacatagaacattttgtctcagaaacaaatacaaaaaaaaccttaccgtaggtacgatttgctactacaattcttgcacccttctcctttgccccgtaagcaatttccttgccagctccaccagcacctacaacaacaagaagcctggcagccaaaggtgtgacggcaacattctttgatcctggacctgtgaaatgtaaattatcagctacttttttcccatgactccgaaaaaacagttgaacgattgtttcaggattaagattataaaaaacctcatatgccatcctcaatggcacaaattgctccaatgtagtcattattgtagcccagtagttggccatctggcctcctaattatagtgcttatggcacctattgactgcagattgaagaaatgtcaggttaaataagtctaaaaaggtaagtaattaattaaatcaagtaagcaattagagaaagtgtaccacacatcaaggtaccttagcaactggatcatgttcatgacaacactgtacggcatcaactttaaaaggaagagaacaactgcattacataaagtcatataccgctcaaatttgttcttgtgaaataccccctccagttgtcaaaagtagtagtttgaacatacatcaagtcaaataactaaaactagaatcgtcgtataattaaatacatcgatgtatatttgaatatttatatgaaaatcagatttctagatgtgtcttgaacagtgctttcattacatcataactctattggaatcaccagacatattaaaatagaaaagagtggtcaatgtttcatcttccatacccagaggaactatatactaacagaaggcnnnnnnnnnnnnnnnnnnnnnnnnnctgaattaccaaaagtctggttactttcagcaaactggattcttgtttaccgtcaaactaaaatatctattctgagctctctcccagaatgtgcaaaacttatttaaaaaattttttaccatcaaacagtggaaaagcccctatggtttatttcaattatataaaagagttatttacaaaagggaaataaattaaaaacatcgcagagggacctagattacaagtaattatccatgattcaaacaagggtctgtcatcttccctaagcataatcagatgtaggctcagttcatttttaaggagttgtttccatatatttgtaaaaatatgtgcaaagctatgttcagtaagtactctgtaaatgttagaatatcaagggaaatgtaaaagaatcacagtaacagacctagacaagggagggggagtggccgtttcacatgttcagtactattttttgctatgttggctaaaatttagcttagagagttggatggagagtctcttggtgatgctctaactgcgggttgggtgggttttttgtgtggatttttcgctgtgatttccacaatttgagtatgtcacatgtggacagtcagtgatgatatgactgtacaaaccaattattcatacccagtcaaagagctgccaggaaaaatatatatagctgaatttttcccatgaaaactaacaagggattcattaggtgaggtttgtacgaatgaggtttgtctaaggaagacatcagattgggggatccctcatgtatgatttatcaaaaaattacaacaatccttattcatgtggtcccttgagagtcaataccacttaaatctagtatatccaactcctagaaaaaattagtccatccaattccaagaaatagtaaagtaattatttctactttttgaaattagtacctgaatcctgaaaaatccggagacgaatatgtgctaagaaatctagcaatgttgtctgccaaaagtggaagataaacagcattgtatccaacagattgaagacatgtattgtgcaaaactgggctcttgctctgttttactgggttggctataacaccgagaacctttgtatcaggtcctatgcgccttatatcataaatgtctatcagctcttcgacggttggctgcccaggtgctgatacctttgtagcatcaagactcccaaaggttagatatcccccaaacttgggggataacacccttgacattaaacctttttcgcccataactagtccaatcataggcacctgtcatttccatttctactggtcagtcaaatggaagttaatacaaaatggtatggattagaggaaaaataacataaaagtacaagtcagacatattacgacattatcccacatactattgcatacctcctaatataataacaccaaacttgatgaaatacaacaagaatgaataagctaagaaaagagcacaacttttccatgagcttagtgtttttttcttcttaagaatctcctcaacacataaaggtttaataaggctgaactagtcccatcgtaaattcacattgttttagttgctttcactaggaaaatagggattacggagactcgaatatggaaagaacatgagaacaaaaggggttatatatttttttctttcgtttaacaggttcaattccattttttctaaccaattggtttttcgaaaagttattttgaaattagaccgtgcaaaaaacttcaacaaaaaataggccgttggctcagcaccaactgtcttggcgctaaggctagacggctcgtgccagggctgttggtgctgaaccccctgccaacatgacagtcgaggcaatcccctcgtctacgtggcagggtctcagtgccaaccgccttggggctgaaccgtctaacctcagcgccggccgtgttggcgttgagctaggttactaagggcgacacgaggccgcaacaacccaacatctcttcttcctctcctctcctttcctctcccctagtgctcgtgtgacgacgccaagttctctctcctcccttccccaaatctctccaaatccacacaaaatcaaatgggatttcgtaaggattgagtgtggggtcgagtttaaagataaactccctcgaaaaccctaatttcttgaacattttattatgtattttggttgttttggttctaaccatgatttgaggaatgtggctcgtgatctattgttagttgggttgtctgggtcgtgattagtgtggaagttccatattgatgttgcttcggttgattaatgttgatttgtaaatttctgaacctatattttgaatgtgtgatgatggctagggttagatgtgtggttgtaacccgagataaatgatttgttttaggcaatttgtaggagtttgaaagttaagttgtactatgattcatgtgttttttaaaacattaggacttagtggtggggttagtggtaatttataatttgtacgttgttagattttatttaaaacatttgaacgttcttaggtttgttagttttgggattggcgtggcattaatcagttattttgaaatactttatttttatttatcggttacatattggatggatagattagtatacgttgttagggtttttttttgaaacatttgaacgttcttaggtttgatagttttgggattggcgtggcatttatcagctattctgaaatactttatttttatttattgattacacattgtagatgaatagattggtagctgtgtggtagatgaaagtactggtggaagccaatttgcgggggagactgttagatagttagtgtttcatgccaaatccacatttgaagagttaaagtcccgcacgaaagatgaattggattggagtgatgagtcggttggtatgaaaggaagatacaatgtgggcgcaggtcccatatcacataattttatgttagacttgaatagagaggtggaatgggaaacatatgtagatatagtactagggtcacaattcaaatcgcttgagatgtttgcttggaagaaagagcgcagcaaatcggagaatgaatttttagacctcaattaaagttcgcgcatagaatccccctgtactgtcatgaaccgaagaacgatatgtttgtcgcggatcggaaggaataattaattgtggaagatgtggaggtagggcaggaagtacaggttgaggaggatatggaggtagggggaagtacccgttgaggatgaagtggaggtaggggaggatttgtcagatgttggcctagatgtgaatcaagttgagaatgagatgaaagttgaacttgatgataggcagatggcttcatacatcagagaattgctttgaagaaaaatttacacccgacaggagtgtgaggaggctatggtatttaatggattgaacatggatttgttgaatgtgcattcagatgatgatgtggatgagtatgcttctaactccaatgacgatcgtccaatgggcaagatgtcagaggaagagaggagagtgtttgagaaaatcgttggtcgcaatccggaaatcactcaattcaaggatcttagcaatgatgggctcgcagttgccgatggggatccacaataagatggaaccatcgatgccataggggaggaatcgagaacggggttggaatttcaatctatggaagacttgaaaatatggctgcagagctactctatccgggtgcatccatgtttcatgtgaaggagtccaatgcatctatcaagtacaccatggcttgcctcgggtattggcgttgaaccctcgcatcagggcagagcccaacacaggagctgtgttgagcgggcctgtggtgagcgactaagtcacaaaacttagcgccgaattagttggcactgagatctttagggtcattgccaattacgttggcactgagatttgacggctcagcgcctctgggccgcccaacatatgagttgtgttgggtggcccaactgcgagcagctaagtcccaaagctcagcaccagaaattggcactgagattagtagcttagcgccaatgcggttggtgttgagcccctgccatgtagacgaggggattggctcggctgccacattggcaagggagtcggcgctgatcagtgtaacctcagcgcaaaggcggttggcgttgagccgacggtctatttttggtaagtttttttgcacggtctagctttgaaataagtttttgaaaggacctatttataaaaaaaatagggttagattggtgtagttctcatgtagcttagctgaagtacaatttgtgaaatacaattttctgaaagccaacatgctaaaattaaattacaaatcctaatgtttttcacttaaaaaatacttccaaaccatagaaaatcccccatgccgagtgatgtttacaggccttagggaccattacacaaagttttgacatgtgcaataattcaaaaacatcatggatctgaatagcttcctttatttttttaaaaaaaaaagaatctaaagggggcatgcagtagtagtgggctagaggcaagatgtactgggacaactatacaagataggtgacatgcaagtttccatgtagaaaagtgaaagcatttcttggattttataaaatgacacttacttggcagtgcaccatcacttggaacatctgtgacacatcaacaatgtcattagctgttgttgcgattttcactatatcagctccaactgcttgtattctagccacaagatctgcaagctcctcacaggatggagtactttcataattatgtgccgagacaataagtttgcacttctctggcttactcccataaataaagctgataaatttgtcagcaacctacaagaaaaataaacttggttagtacatatagtatgcatgccgttatgtatgtaaatgcctagtggctaatgaagatacaaatgtgcccccatacagtcctaatcatgtacttagataaatgaggcatagagcctacatggctagatgattggtgaaaattaaattatattaaagcatttggctttttaaattgcttaaaactaggtttgcattgtgttccaaaacatatactccttctgtttcatattataagagttttgatctttttttccgagtcaaacatatttaagtttgatcaagcttattgaaaaattagcaatatttacaacaccaaattagtttcattaaatctaacaatgaatatatttgatagtgttaatattttgttataaatgttgcaatatttctctataaacttaaaaaggtttgacttaggaaaaagttaaaacatcttataatatgaaacatatagagtatgagataagagatacaagaataaaaactgaagaatcgtcccgaaaaactattggctagagctaccttgtgtttttttttctttttttaggttggcatttttgtcttgaacagttacatgttacttttttttccaaattttttattgtttgtttgctctccttacttaacataaagatgcaaaaaaaaatatatttggtgtgttccctaaaggaacaaatggaaaacatgaattttttgacttcaagtttattaagtaattacaaaaggaactttttacaatttcattccagagcatcttaaaagaaaccacatgagcataagaacgatgtattgagtattcattggacgtttttaaaatagatttcccccttcagtgttatattttagttaaccttcctaatgcgatggccaaatggcagctagactctaaagaataaaatagtatgattgacaaatggattcaatttgaacttaagaggaatgatctatcttgtcatgagcaatagaactgaatattaaaatacataaaaatattaaaattgcaccatccataatgcatgaatgagtgtcatatttgtacctccagctatgaagctacaacatgatattccaaatttactcaaaactcattttcaaagttatgtacaggccacattttcatgctcaaattagtcatattgtggtagaatgaaaaatggaggcaatgtggatgcacttgtgttccacaaataaaaggaaaaagtagtggtggggtttaaccatgaaaagaaggcatttttcagaatcgtttttaatacaatgtgttatgcattttgaaaaatagtgggcactaatcaatttgaaatctaaggatgcttacaatattacatattaactgggaacagcgtaacagtttaacttatttgaggtaacaaaccttcaattcaatatcgacataatttactcctagctccattgctaaacggagtgcttcaaatcttgtagcatcatcaccttcatattggcctccttcccaattgggtctgcaaaagaaatatgcacatacaaatgtcatttatgcaaagcataacggtgaatctaatatgcagtagttatataaatataaccaacaactacaaagtggggagcaacattgtgaagtaaaacaaatgtacctgcattgcatagtaaatcaattaaagcacagaaattgaaaagataaatataaagaagagagaatcaaataagtctggtcattctgtttacgtggaccttttttttttaaatcccagcataatatcaatttctagagtgtcaagggtaatgatgaacgatcttatgccacttgtcaagggtaatgatgaacgcaagtcctctcaactagtttagcaagcaccaaccttgtcaaaaacgacaaatgatttcaccttgtctcaatcggaaaaggacgaacaaataaattgggtttaggttcttagctgggcacttttcaaaatttgtggttctacttgaaatcttgaacaatttattcacatattaataaatattcaaacttagtcaaacaatatagattaagctatatattcaggaacaaatataagcttacaacttttgctagttttaatgtcccacaaaatttaagaatgtgttatcacaaattcacaacagctccataatcccccagaaaaacagagaactaaattttctccaagttgttctctatattttaatagagagaattatgtttttcttatctcctctctagtggatctcacatcaatttgctcgtttatttcagatcacaaagccatgtagcaggccaatgtggcaaaacttgtggaattagcaattgtaaaagatagctaggtatagattattgcctattctatcatgtcttaaagagcatgcatgctggatttctcaataacctcgtgcctactttcactgagtgcgtagagaatgtgcagtaatatggtcctatactattgtagtaactatgccatgctcatgcagtaacatagtgcttcctctttccaaaaatctgagacctatttcattctttagtttttctaaaaatctaagtcctatttatagttactatgtgctaaattaaattgttgatcaattgcatgtttatttgttttgccacatggtgagtgagttaattgcttattggtattgatgaaaaagaaatagatctcagatttttcgaaggagggattagcttgtatataggtagagtaacacgctctgggataagcaactggtgcaataacatgttgttaccaactattagccatgtcattgctacatttgccctatttatcctgatatgttgttatgacacaagtcttgacaaaaagaaatggtttcactgccattggtaatactgttactatgatcagcatctacaatatgaaatagggaattaagtaattgttaattgccaaaataattatagctgttaagggtagcagtgtgcgcttaggccatctccaatgctaggtgcttatatgggagcttagaaaagaaaaaacaaaatccattttactacccaaactaatccaatagctagatcacttaatctctgaaatattttttatcctccaaactattgaaaatggcactttacttcttaataacatctcttttttttactctttatacaagactagaaaaaatgcccgtgtgttgcaacgggtgaagtttattttaatcttattattgctatattgtttagttgagatgaaattcactgtagtaattcgcttagatatatatatatatatatattttaaaaaaaatcatgagctgtatttaggagtccgattgtctcaagctagcatgcgagtgtttttaaagaggcttcttatatgactcctttattttcaaaagcgaacgaacttaaaaaccgactcatacacagaaaacgttccaaagtaccgataaaaacttcttcaatttttataagagtagaaatatattttaagataaaactttttataatcatagatggcgctatcattaaagttaaaactacacgaaaattactttgcaccggccaagtagagacgcctcgcgcagatgccatggattaggctgccgaagatgtcaaactgataagtttgcttcaacttcttacataatactttctcagaataagttcatttttcaccaatctcacacatatcaacataaaactgaaaagactagaatacatccactttatcaaattctaattcaattatttgcactttatctgctcccaatgcatttatctggcctctactttcacaaataccgatgtaatgtttatctaaaaaagaacttattttgagataaataggagcagccaaaaataaatggagggagtatatgtctgcttcctctcctctcattgattggtgccagttctttgccgcgtgagcatggtggcaaaacaggataagagaacctgagctgctttcttcgtctcaaaatacagcaatctaagattggatatcgacaggggtgaaaacgggcggatacggtcggattatggcattcccatatcctaacccatatttttctttaaactcggagtcgggtacggttagtgacggataatatatcactcatctcgtattctatcccatattattttcatcaaatcggattcggaaacggatatctatttgtatctctaattcatagatattaaacataataaggtaattaaagtattaaaagagatacatcaagagaaaaattatgcaatattacatgtgagctcataaaaaatagtgattaaccaatcttttatcatgtttgtaagtggatttataatagattttcatatatattttataatatggggtatgcgggcggatacatgttttcccgtatcctaacccatattttctaacgaattcggattcgaacttggatagtattgggtatcccattttttctcccatattcctcctgtgagcctcgggtagggcgggcggttggaatatacccgccccattttcatccctagatatcgttatgttacaaatccgaataagtgtactccttttttttattatttctttttaggaatgcctagaatcgggcgctcgacgtggggagtaaaatcgggcgccacacgtcatgccctcccgcgcgcgcgccctacccgccacatgtccccgcgctgctcccgccacgtgtccccaccatacacgccgttgcaacaaatcacccacatattatggaaaccctctataatgtactcataatgtttcactatgtatggatcaaatgttgcagtgaattgaaacaattcttttgtaacaaattacccacatattatagaaaccctctattaagggaatccatttcatttttttccacaaaaaagttcacgtaatttacttattgtttcactatgtatgaatcaaatgttgcagtgaattgaaacatcatttcgctattcgctgaaacattgttttcatataaggtgaaacagcgtccgatgaaacattttcgatctacttagtaaaacaattccatatacttagtgcaacagcgtgcaacatttattaaaaataattcaataataagcttaaaaaagttcatcggattatattcatgtgtggtcttgttttaaagatttaattgcaataaatttaatggtgcaatcggatcatgatttggataaataatttaagagaaaaaaatagtttaaagttcacttatgtatgcaggatgacgtcatgatgacgtggtcgtccgattcggacgtgtcgcctccagttttttcccttattgccgcctgctgtagcactgtagcagtgtagctgctgtttgagtgtttgcttcgctctctctttctactgcgcatggaccaaccggagaactctctatcttgaccagataaataattagccttgttacctcgagtatcacgaattgtatatcttatctactatcccatttgatttttaatttttaacgccgttgcctcgtagatacaagtttgatcatgaagctatagcaccatacgcatatgcagtatttcttctctttgatcgcaacaaagcatgtgctcgttgttcttcgggaagcatatgcgacaggaatcggcagaattatctatctcacgattagttcgtcgccattcccgtagcttcagaacttcatgaccgccagactgaatgaatttgggcctgatatgggccttcctgcccccgcaatcaaaacacgccatgaaaaaactaaccgtgcaattaaaaagcaatggcagagcgattttgctatatctcactcgaaagattttttcttatctctcactcgattttctcactcaaatttacagtgcattttcttgtaagttatagtgtaatttatgaaacttacactgtaacttttgtaagttacactgtaatttttgaatcttcacatgtaaattttaaattttatatttgatttggtctttttcttgaggatatggtaatttaatgttcattatggtgtttcttaattgctttttgctttttattatatctatcagattttaatacaaagattaaaaatctgtgtgatacgattataaaaatctttcgaaagatgtataggtactcccatggcagagataacaacagcatgtccgtactattatagtatactaatttttggtagaatgatattgctaagattttgttttagattattacccctatcaaaatttagcaaagttaaaatgatgataaagtgaacaaccgaacatatacaagcttatagtatcgcagatcgcatagcctcacttgacactgcctccctcccagtacaactctcccaagtcccaacacactctgactgccacaactgcctgtgcacatgtgaaacatgcaatgcgaaaaaaaaaaagtagaaatagtactaataccagttctaaaaaaaaaagtactactaatagcggatagagcagaagtgtcacgtactgtaaataaaatacatgctagttgttcgcttagattatttgtgcctactagtctgttctaaaagaagataaaaccctatatacaaacctgacacgcatatatctaggtttataattagaattgattttttaagaatgcaggggtacatacgactttgattgttcaaaaccacagctgacatgtacgtgaaaagaagcaaacaaaaatatggtttaatatttttattagcggtttgaaagcctatattaaaaaattgttttcataaaatgacttcaaaatcaaactcttctaaattcaacttctggatgtggtagaaaagcaggcgaaatctttatatgtatctagtacgcatcgacggcatcgtaccttggcgcaaactcatcttgttgaaacaaatcgcagtactaaaaactatatcaagtctcatgaagaattaacctatattgtattgacgagtgacggagtgagtataggaaatactagagtacaaactacaaagtgtttgattcctgagggagctcgtgactcttataatatgtatatggccagcattaaggaataaaattgttcactctttagtcaagttgccgttttatttttcttgtcgtatcctctctgcaccgcctaaagaaatagttagaaaaagcttggatcttcctcgggtactgatgtgaccatggctactacggatacaaccattgctcacataatgcgtgaacaagaagacatcaagatcaaggtctccaagtgctggaatccgattcggccacctgctgcactgttgatttcaaacggccgccgaatctgcatacgacctccgtttttggcccgtgagtacttgatggaaagcctacggagtcctctttccaatggatccagcctcatcgccaaattccatcctagtcatccgcggatgaacaaacaaggtgctgcgtcacctgtcatgggcctttgggcttgtaacttcgtttgggaccctggcccaagtggggcccaagtggggtgcgccccaaccaggtggagcacgaccctagagtgcccttggtcgtcctcctatctctttaaatagttaggtaccccttcagagtttcgcgggttttgattaattgtaagtttagccattgctacttcgcttgcagcgcgcgtgtcggctagaccgtccgtctgcttgttcggaaccccactttatcgtgtatcaatttatctttgtgcgtcttgtctatctagcaattcagttgctttatatcttgttcttgcttgttctcgatagcttgcaggaataaggttgatctgcaccggcaagatcaacaacccacggagaggtgtatcgatcgctaaggcgcaacgcaacggttttgtacagttgtagtcggatcgtcaacgtttctcccaaatcgtagttatcacaactcaccgaaagatcgggccaacaacagccttgagtgtcgagatgaactcagggttcatcaggtatgtttcgcttcactttttttaactactactttcttattttccacgcaaactttttacgaggtggtaaatgttattttcttaaaaaaattctacgtaaaagttgcttacaaaatcatattaatatattttaaaccaatacctaattaatcatacactgttccggtttatgtggtttacgtgggaaaggaaaaagatcccaatcgtttcaaacgaacgcagtctagccgcataagtactaattaaaagcattagagaaatcacacttttaaaagcattgagtaaataatctgtgctaaaaattcaaaagaaaagggaaaaaaacagggagcgcccaaaatccatcccgaaaaatgtatacaaccccaaaagcaaagcaaagcaggaataatcatgcatggtaagctgaaacactcgaaacgttgcaacttgcaagctgtgcatatgaacacgcgctaaatggacgcaaatcctgtatcaaaccagtccagcgcgcggtgcgcggtagctgcctgagagagcacgacgtacggtagggtagcaagagcgggagagggccggggttctgacctgtaggtgacgatggcggggagcgggcagccgcggagcaggcgcgggagatcctcccgcgggcggaacttgctgccgatgaagtcgagccggatctcgacgaggtcggcgccggcggcagcggccgcggccgcgtcggcccgcatcgcctccaccgtgcgggccaccagcggcacgcacaggagcgtcatctcctcctcctcctccttcggtagcgacgacgtgaatgctcgcgcgagcgagatcggcagtggcagagtgccagagtactgatggtaaagtgtaaggtgggggcgggcgcgggtcgggtcggaaggtgtgttgggtttgggtgtgccgactgtgccggtgggcgtagcagggtggcgtgggttggtaaggtgggagtgtgggagtgtgggagcagccggccgggcaagggaaattaagcaatttggcattgtgtcggagactcgggagttgccaaattggggttgccgccggaaaagtgataggactatatttttgccgttccggaagatgacgcggacaccgcgtgtcgtggggcattgttcgtcaaattttctaaaaatttgacaaatataattatagtataatcatgatctaattacaccgtatcttatatgtaacttgtatatcactttcaaaaatttcttcgtaacatgctatttcggtgaagaggtcgtgggaacgaatcctcttgcatatatgcgcgcaatgacatttttccttctttagttgcacaaatcttgaaacaaatctaacggttcaaaattatgtaaaagttacatacaagttgcattgtagttacatactagttacattacgattgtactgtaattacatccgtcaaatttttaggagaaaatttgttgataaatatacagcaaaattgcatatacgtacatataatatttatatgtactagcataacgtttgtgtattgtaatagattctagataactttcattgacataaattaaaatcatatatcataattcggcataaatgatgaaagaaatataataaaaaaataacgacatgaaaccacaaataagtttggtcggaatgataatttaatattaaaacaattatataactaaatccccttttttcatttagctataaataattcaatacagagaaaaattataagttaaaaataatttttagtggatcaaatagtgctaaaactaaaattgtaaatgaaaaaacaaatgaaattagctagaaattgaaaaagcttactttaactcatagatgaaaatttgatccattaattccgaacgggtgcccgtttcattaacataaattagaattttcctattatattcatattactatggtttcaatattatgtgagtgattcaggagcatggttaggttggacaaagaagcaatagcacccaacaggcattgttcatcgtctttcctagccaaaagcgagaaacaaaaaggagggaagatggatgctggtgcttcggtgaaccaataatagtaagtaagatggtaggatgtgtcccacgatgtgactcgtccatagatgatggatattggcaacgaagaaaatcataacagcaagaacgtgaccgataatgacgtggtcccgatagagagagaaactacaacggcgagttctgacgatgaacacgacgtgaatacaaccggtacctcgacggttcatgtaaaatataaatgcatgtgattacgtcagtatgcaatactggtcatcattgatggtttcaattattttatctatatttaaacaatattcttttcttattaagattcggattttaccccaatttcaattagcacgtttttcaaactactaaatggtgttttccgtgcgaaaattttttatacagaagttgctttaaaatatcaaatatatccatttatcaaatttatgataatttaatttaattaatcatgtactaataactttcttattttatttgcatctacttaatcttcatctcaccagtttcgaacaccaccggttacttttagcatttaactacttttgtcagtttctgctgctagtccagcatataaaagctcaaataccacatgatttgttgcatcaactggtcattacagttttcatagaccgtccagagggttaatagaggcagtctaatcctttggaatcaactgatcgatacagttttcaaccagctagaacctactccccccatcttataataaatttatttttgactcctcatttatcctaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaactaagaaatcttaggttacatccttgcccaacccaaaagagaaaaacatcgagtgattcaaactgccacgttatcaaaagatcatactcatagagtacagatcctgagacagagcatccttgcctgataaagttccattttaagctgcaaacttaggcataaaccagagctttatataataattctctgaatggacttgaacattcataggtcaaacgtccagcaatcacgtacacctttcttctccagactgacatgaagtacaatggaaaggagtagagcataagcagctgaatattacaatgatgtatcattgccaatcacagatattggttccattacgaatgatgaacatgaaaccacctgatcatagcttgatgtgtattgtttccttaaaactcatcatgatcatcaagcaactgcgcagttatgcatgcaaattctttattgcaagtatgatgagattgaacactttctgtttacatctctgacaggttaagtcggcgaaatcgaacattacaacaactaatctccacctagcacaaaattgggctggcatccaaaacttttattaacttaacccagaggaatatttgggctaattactcacaaccgtcgcttcgccattcgcctacagaaacatggttatatcaaaaaaaaagttgcatccaatgagcattaataagcgatggtaatgatcagtatatcttagtaaatgaaaacgaatggtttccatggcattgattacaactcaagtcatttccacgtggctaacataaacaaaaccgctgatttatagtgtccacagctcaacaaggtgggaaagcctatcaaaccacactaaatgaatgcatgttggaaccaaacaagattgtttggtttgtgaaatgggatcttgttggtccatcaccacctaaaatccatccacccctcataagcacgtatgcataggcaatacaaattataggatggggccatcccaccaaagttcatgagatcatcccatgatagactaaccaatcctacaaggaggtggttctcaaatcaaaaaccgtatcaaagaaccaaattctatactccctccgtcccataatataagggatt

SEQ ID NO: 10682 - DNA, 4857 bp, Oryza sativa
aactagtagcctatcattattagcattatatgtagtttgggtcctaaactatattagttctatgggttggattacatatacatcttgcccttgtggatttggcatggtgtaatatgctaacagaatctaatatgctaacccatcatgactacttgactagaagcatagaaatgaaaaggcaaaagatgaagaatgaacctgttatgtgtatttggcagctatctcacgcatcaggctttcaggagctgcaaaagcagattatcagaaagatgaaggtgtattagctaagtaggtccacaaaaaacattcgacataataaggtatatgatatataagttaaaagagcacaataccttcaataccacctgtgaaatgctcaaactgacccatggcttgtctgacaaacatctctacaccgctgacaactttaatcccacattcttctgcttctcgtagaagccgggtaactttcggggcatataccgcatcaaatacaacatcatagaagcttaatgctttctgcgaaaacaatggaatttataacaaatattgaggcagcactgagcagacagctatatcaagataatctcaaatgtaacaagagagtatgctgaggttaattctaaaggtggtaatagagcttccaagtatgctgttctggaatataacatggtgcatgcatgagcaagatacctttgggataggggtgccgtccacattggggtacattcccaatgatgtcgcattagcaaggatcatcccttcttcaggcctgaaagtttcaagctcggctaatctcagggcatgaccacccactgcagcagcaagacttactgctttttctgaagaactcaagaaaattatcaattacatgatgtactgaaatacgatcaattttgagctttataaccagatgcctcatatccagtttgaaacaagaattgatggaacaaaaattacaaaaaagatatacatattttatttgctaacttaagaatagttgatgtgatcagcatagactgctactgttgattgcaagtgcagaaagagttgtccaaataactacacaaagaaatactagtatttttggggtggcttatgcaatgcactttgacatgactgttccatgaacagtagcagtctattcgagcatagttgacatttagtactagaatgataatgcaagtgtagtatattcagtaaacaaggtactctaccgttttcaaaatacagggcttatttaggacgagaatactaagaaatgtatgaaataaagagaaagaagataaaatgagcatactacccatacttaaattgattcgaaattcgtattcaagaagaaaaaaaatcaaaataagagagtacttagcgagagcattgttcaatctattcgacatagatgacatttagcagtagaatgataatgttagggagaaatgtgccaaatagggacacagaagatatatcatagtaaaatcacatgcaggctttatatttcgagagaaattttgtgaaaaatataggcaccatcttttcaaaatggagtaattacccatcttggataataaaaaatgcatgcgttagtaatacaagatcacaaaagttagacaatattctgcatccccgcaaaatatatatattgtgcatacatttggttgagatcacttgccagagtaacaaaacatgaatgcttatggccataactgaaagacccactatgtcggagacaatagtgctagcgtgctacaagcctctgggaatccagtagtaaatatgcttattcaaccagtgacattaatcattccactccaactttactcaaaattggatgtacaataagaaacaaatgaccaaattccagtgagttctactcctaccttagagaaagttaatgtcctaagtctaatgccaagaatgcctgatcagacgaatttttcttgtgtttttttctgttatggattgaatttacaaatttgatcttaacgtgaaaacagttgacaagaaaatatcctgaggcttatatacaggatgtcaacttaaggatcaataaagagggagttgatgtggaaaatagaatagttgtataggctactaccaggacacaagttctaaaatgaaagaaatgcaaagcatcctgagcagtaaccacccttttagatagagataggaaatagctaactagtcaatctaatccaatctctgactaaacagccatcgtgaacaacgatgcagttactgttgacctgcagtaccgcagaccctaggcaggcctattgctgctttggaccttaatgggctgcacatgacattcacccttcgcgtgggtacttgtcacgtgtgcaatgctgctggcctagagtcattgaccagtgtttctatctggccctagtgggctccacatgactgataaaaacatggataataaaaatgagttaatatatcttcccagattgcatgcattaatcattggctgagggagtgaggagcatagttcagaactttatatcacaaaatgaattctttatgatttgcacatgatgatagaattaggtaggcacagaaattgcataattacagacaaagaatatttggctcagaaacacaatcttaccgtaggtacgatttgctactacaactcttgcacccttctcctttgccccataagcaattgccttaccagctccaccagcacctacaacaacaacaagcctgccagccaaaggtgagatggcagcatcctttgatcctgggcctgtgaaacataatttatcagatatttttccatgactcccaaaaaagagtaaaaaaattgctccagaattacgattataaaaacctcctatgccatcctcaatagcagaaattgctccaatgtagtcagtattgtagcccactagtttgccatctggtctcctaattatggtgtttatggcaccgattgactgcagattgaagaaaatatcaaaggtcaaagaaatctgaaaatggtaattaaatgaagcaattagatcaagtgtaccacatcaaggtaccttagcaactgggtcatgttcatggcaacactgtacagcgtccactttgaaaggaagagagcaactgcattacatttagtcatatagcatgaactcagatttgttcttgtgaaataccccctccagtcgggaaaacaaaacatgttattttgcatatgcatcaagtcaaatctctactccctccatcccaaatatagctacctttagcattcaaatgtcatcccaaaatatagctatttctccaccgacttcctcacctcaaccagtcacgaccaccatctcatttaatttcttcacctactttctcatctcaactaatcacaatcatccctcactttactttaattttctccttaatatccgtgtccaactataaaagtccttatattttgggacagagggagtaacgctttgtgcatttctatatatacataaatacatccatatatacatttaaatatgtattatattggaacatgggaatcatatttgtagatttgtctaaaaaagtgcttccattatattagaattttattgtaaacaatagaaatattgaaattgaaacgagtcgtcagagttgcatcttagagaccactgtatattccaaattgatatttttcatgccaggaggggagtatgctaacaaaagtctttccacgaaaatgatttgttgcattcagagtttcagacaactggcctcttgtttacccccaaactaaaatgtctattttgggctctctcccagattgtgcagagctatgcacagtaagtactctgtaaaagtttggatataaagagaagtgagaaaaaaaacacagtaacaaaccaatacagagggtcagatattgcatatcccaacagtgttgtacctttgtctctttggctgaagaccagagctcagatcctactaattgtggattgggtgggttgtttgtgtgaatttttcactttgatttctgggatttgaacatgtgacctgtgggttatctgccaatagatgactgttctaagcaactattcacctcccttgcgatcaaagaactgagaggaaaaatacagatagctaggttttcccattaaaactaacaaccattaggtgacgtttgtatgaataaggtaaagtgtctaaagaagaatccagattgggagtatccctcgtgtatgactcagaaaaatctagtccatccaaacgtttcaaattccaagcaatccaatagaatagctatgtaattttttctatcctctgaaattagtacctgaatcctgaaaaatccggagatgaatatgtgctgagaaatcgagcaaggtcatctgccaaaagtggaagataaacagcattgtatccaatagattgaagacatttattgtgcaaaattgggctcttgctctgttttactgggttggcaataagaccaagaacctttgtatcaggtcctatacgccttatattataaatgtccaacagttctttgacggttggctgcccaggtgctgatatctttgtagcatcaagagtcccaaaggttagatatcctccaaacttgggggataacacccttgacattaaacctttttcgcccatcactagtccaatcataggcacctgtcatttctactggtcagtcaaatggaagttaatacaacatggtacaaattaggaaaagaagagcataaaagtacaatttagacatactacaacattatccatactggtgtctacctcctactccctccggcacaaaacatagctacttatgcctttttttggagggattaaggttgaggtgggaaatggttgtggttggttgagatgagaaagtagttg

SEQ ID NO: 10683 - DNA, 7521 bp, Oryza sativa
aatgatagaagtagccatattttgagaccgagggagtaataaataacaccaaacatgatgacataagaataagctaacaaacgagcacagctttgccaatgagcttagttttcttcttaaaattctcctaaacacataaagttttaaaagcttaattggtccgatatttcaatttgcatcctctctgcaagcgaccaattttatcactattcacatcctctgtgcaagcaaccaattttatcacaatggtaagtaatgattttctattaaaaattaatgatattatttgctttcactggtaaatagggagatttgaatatggaaagtacagtataacagaagggactgaaaaaaaagtttaatactacaggttagattggtgaaattctcatacagcttaactgaagtacaatatgtgaaatgcaatttcctaaaagccaatatgctaaaattaaattgcaagtcctaatgttttcattaaaaaaaatgacttccaaaccataggagctaggaagcatttcatacaaagtttgaggaatgtttactggcctgagctagggatcattagacagaacgatttccgtgtgaagtaatttaaaaacagcatgaatctaaaaggaatgcagtagtggtatcaagatgtacaggatgattatacaggataggtgacgcaagtttccagatggaagagtgaaaatgtatcttggattttatacaatgacacttacttggcagtgcaccatcacttggaacattcgtgacacatcagcaatgtcactagcagttgttgcgattttcactatgtcagatccaactgcttgtattctagccacaagatctgcaagctcctcgcaggacggagtactttcataattgtgtgatgagacaataagtttacacttctctggcttactgccagaaataaagctgataaatttgtcagcaacctacaaaaaaaaggaaagttggttacaattgtgtgcatgtattccaaatcgtgaactcaaataaatgaggcatatgggtgtacatggcttgataattgaggaagagtaaattattttagagtgttttgctaaatgtttgtcttaatccagttataaacaggccttgtattgtgttccagaacatatgacataagacgtgatagaataacaactgaaaaaaaaatctgcctgcaagattattagttagagctaccttgtattattttcattttctgggctagtcttactgtctcagacagttaggcgttccttttttctgttgtgagacgttttatttgttagtttgctcctttgttaatacaaagatgcacaaatctttcgtgatttacctaaaacaactggaaaacatgaactgtgcaactttaactctatttaataaataccaaaaaaattacaatttcattccagagaagcttagaggaaatcacaggacactaaccacaaattgagcataagaaggatgtattgagcattcattatcaattataggacatttttcaattaaatttcctcatctggagttatcttttagtgtgatagccaaatggcagctaaacactgaagtatataaaagaatgattggcaaatggattccatctgaagttaatggtatgattaatctactggtgagcaataaaattgaatattaaaagcaatagagatactaacatagtatcatttagaatgaatgaacaagtgcccatataggcacctccacctgtgaagctataatgtgcttttccaaatttaccgagaactcattttcaaagttatgtgcagtacatacacaccacattttcatgctcaaatcatttgtattgtggagaacagaaaaatgggggaaatgattatgtatattgcacaatgtccagtgcatgcatttacaaaaacacaaacaaaaaaaaataaagtagagcagcaaggtttaaatatgaaatttcttgtgtgtattacattacatgtattttcagaagttttttacacagtgtatcatgcactttcacaaatggtgggcactaatcaatttgaaacgctaaggatgcttacactattactgcatactaattgggaacagcgtaacagtttaacacatttatggaaacaaaccttcaattcaatatcaacatagtctacgcctaactccattgctaaacggagtgcttcaaatcttgtagcatcatcaccatcgtactggcctccttcccaattgggtctgcaaaaaaaacaatcagatacgtcatttatgcaaagcatagtgttgtaaactagtatacataagttagacaagtatgaccaactactacaaagtgggttgcaacattgtgaatataaaaaagtactcacgttggaaaaagctacaaaataaatcaactaaagctcacaaaatgaaaagataaatataaggatgggagaagcatataccttttatgtatattttttttacagatcctataatataaatattcatttctacaagtatagaaagctaattaatggccacagatacgctcaatcagtttaagtgtttaaccaaacgccggcttttacgaaaataagaaatgattgtgccacgtctcaatcagaagtgaacgaacagataaaaaaccttttaggttcttgggtttagttcttttcagattatttaccagattgttgaaatggattatttgctcaacacttcaaaaaatacattttctccaaaaaaatatactcctgatgtattgcttagaccacttgttttaagttatttgttaagtaaatttatcaaaatattttatttctccctatcatcaagtagattatccgcagcaacaatctgctcaataatctgtttcgaactgagccttggatggactcttttcttacgttatggtcatacttgaataaagtatttacaaatctacaaactgagtcagacaatatggcaaaagatgtgtctcaattttgggtacaatattatgcaggaatgaatttaggtttatacttttgctagttttaaccttccacaaaatttaaggatgtgttatcacaaattcataatagctccataatccaaaaaagaaacacatggatctaaactttctccaaatagttttctagatttagtagagttaacttttcaccaggttgttgcatgaggcaccagggtatcaatgcagtgtgaacccagcagcattccagcaatgacatgctaactgaaaaggtgggcagcattccattcaattccttgagatattgactagctcagcatgagattaagagatatgtgtgcttcactattatatgtttgctatgggatacgtccagtttgcccagtttacattcataaatatccagattggaccctctgctctaaaaccggttatttaaacccttaactttccgagtcatcaaagtattgagccatatgagtaagccaaatcatgccatgaatcaacaagttaactgaaatcaaaaggcatttctctgattctcgccctctcttttgtctcttttccttatctcctctctagtggatcatgcatcaatttgctggtttaatgcagatcaaaatgccatgtagcaagccaatatggaaaaacttgtggaattagcacctgtaagagaattccagaatatatagatttacatgtatagcgaattaacacgctctatacatgtactccctccattcttttttgagatgtccttttagcatgtacgtcttctcatctatgatcatgtgttcagtttgctgtccatgtattcaatgagccgtagtcaacccctttagctcgacatatctcaccttgaggacacctagggaccagcctagacatcgtggcgtcctggtgccccccatgtgccatgattgcatggcaaccatgtcattgacaactattggagtcatagatccatcaaaatggccaaggtctctgatacagtagttggaggactaaatagttgtctatagagcaaacaatagtgttgtgtttatgcaaaacccctgtaggtgggttggtctgtgatatacagtggttagcccatgcaatgcttttggattgctcagctaggttatggccttggttagtttgtatttggccctttactttgtggggaacctcaacaggctgatcatccccctttgtgcccctagtctgaccaaatgttaccatcaagcttgctacgaggatgatacttcttgatagttggtgtaacacttcaattggcaggtcataaacatcgttaaaaggaacatttttatataacaactcaacagatatgaagggaatatttaaagtcctaatgtcaaattaacccacttactatgaataaaataatatatctgcaaaaaaacatctaaagttgacaactaatgaactcagctggtgcacattatattgcaccagtattaaattctccacgagtttatcattatagtattgcttttacaatgtatagaaactaggatagtacacaaaggaaaaatatggaaaaaaaagaattggattatgataacacgataggcagtcattttcaaggttctaaaactcagcagctagtattcattcaatcacctcactgtggaatgcatatacaggaaccagccttgtacttggcattatactcaattttcaatttaaagtttgaatttatacatgatgtttatatggtatcagaacaaaaaaaaaatgttgcatcttttctatttatgtaggcttcaaaagctatccatagtaaaaaaacgcaagctgccaggtagaatgatcaaaagggggaatcacgacaataacgacatgaataataggagtcaatcatgtaattctaaatcagcgagtagaaataggactagtttgcatcaacagttcataacgacatgttaaatcagaatgtgtgatcagaaatcagcaagacagatcaaaacctgacaaaagttgattgcaagttttttgtgccacaaacttgttaactgacctggaacgcactaactacataaattaccgaacaaatggaccagttaaacctgttagcatactcgttttgcaatatactcctaaggaacaatcactcaatgaatcatccaaatctatcaacataccttttcaaaagaaaacatatcaattcgtgagttgaattaaaaaaaaaaaaactcgactggcgggggaatgacttccccatggcttttcattaagaagaagcctcaaccaaaccggtcgagaaaagccacgaaccctggccccccacacgcggactcaccccctatggatcagtccgtaacctgtgctttgaggcccctgctccctatacgagggcccgccataggtcaattcttaacacgtgtttttatgagaggccagtgagtgactttttttaactaggcctgaaattcgcttcatggggagtgaaacccaggacctacacgtgctacttgagcattattcattaggctacaggtccttccgtgagttgaataaaaaaaaactgtggaaggcatatgatgcaagtactcatttaatcaaaacattggatagctttctagaatattgatgttgtttctgtttattttatgtggtactgagaatttaatagttagtcaaagattaattgtgtcatgtgctctctttgggacagaataaatgcctccgctccagataacttgtttatatctagtcttgacatggctttaggtttcaaaccatggttatgctatgaatagcatgcgtacatggactccacttggagaacaaatattccatgttctaggcaacatatgctatgtggtcactcttttggatatgcaactgtcattagtgtgtgtattaaaattaacgtgaaatgtacagatttcaacttcaaattcactatcccctccgtcacataatataaggcatccaagaattcaaactttgtcccaaaatatctgcttcctccactcaaccacctctcacttaatttccacccaatctaacccccaaacaccttcctgctcccccccccccccaacagataccccctcatttaatgatgggcattatagtctttttcattcatccttaatctctccacaaaaaaaaaactagaatcccttatattatgggacagagggaatatatgttaagaccaaaagaataactgacaaatggcatgattgaagccatgacagacacagcagtcgtattcacagagaacatagcatctctatttattctaataaatttttaactgaagttgaaaaaattgacatgactgacatggctgcaatcatgcctgacatggtgcttgcgcagcggcctgcaagtttgctaacaattgcctgtgagccaacagtctccaaggacattaccctatcctcagcaccacaacctatcgtcaatatagttggtagtacatgaggatgaggtttgtatcttagagatggtgttaggtttgtaggtgagatttaaataagcaatgaataatcaatctatccctctaaggctgcgttcgttgcctctagttcccaacttccctttctcgttttccgcgcgcacgcttttcaaactgcttaacggtgcgttttttacaaaaaaatttctatatgaaagttgcttaaaaaatcatattaatccatttttgaaaaaaaaatagtaaatacttaattaatcacccggtaatcgctgctccgttctccgtgccagggattaattaagtctcccctgttcctccatgcaccatgtctcccctactacctcgacgaactaaaggtcgacgataatcaactgagattaaacattcacgagaatatacttgcaaatattaaggatcaacggcacaaagttgcaaatatccacctgccgaggggcatttctgcaatttttcacatcttccacggacttatctgtaattgttcacctccaccatttgtggatactcaattgttgttaatttttgttatgatcgggcggcctaaacggcgcggcgtcaaaaacaagctgattctaacggagaacacaaaatgcagttggctatgactagatgttgacccaaaatccatcccaaaaacgggggcgacgccacccaaaacaaagcaggaatcagctgaaaagcatcgaacattgcaagcgcacgagaacacacgtgaaagcatctgcgcacgcgctgcggatataccgggaaatggacgcagaatctggagcccgcctcctgagagaaggggtagagggcgagaggagagggggatctcaccggtaggtgacgagggcagggagagggcagccacggagcaggctcgggaggtgctcccgcgggcggaacccctcgatgaagtcgagccggatctcgacgaggtcggcgccggcggccgcggccgccgccgcgtcggcctgcatcgcctccaccgtgcgcgacaccagcggcacgcacaggagcgtcatctctcccctcgtccttcgccggcgagcgagcgagcgatcggcaagcagtgggggtgggttggtcaggctgggtctagcctggtggcgggcgggcgcaggtggaggggaggggtgggtggggg

SEQ ID NO: 10684 - DNA, 1397 bp, Oryza sativa
atcccctaagtaaaataatcgatgcgcacagttttgcctggtctcctgctgttctactggtgcgtcccacctagtcaaatatacaaatctttgacattaattgatatctaaatttttcatgtatggcattagctgctagcaacatactccctctgttacccctcctaggttgtatttttttaggacggaaggagtaggtagctagttgacgtgactgtactagagaaagagaaccaacatgtaggtgtgctttcatgcattagtccagcatgcatgcatgtagccacggccaaataactagccactgaaagtactaacctttacactaatatatctactaaaactactataaaacatcaaataggtgtcggcactgtaggtgccggttttactaaaaccggtacctataagccttttcccacctccgtggtccgaaaacataaaaaaggcatctttaagatgttataggtgttggttctatgaaaaaaacacctataataaattaaaggtgtcggtttttttaaaaaagctggcccctttctgatcgagccatgagccgagccgcctgaggagcggataaggaaaagcgcctcggtctcatcgagcagataagggagactgcgcctttctcacgcgtctctctctctctctctcggtctcttctcttcctttctcttctccaccacatacctcctcttctcttctcttcctcctctctttctcctctcccggtggcaggaagagcggcaggaggagcggcgacatcggtattggcattgtcagcagctgcagggaggagaggcgtgcggcggcgtcggcgtcgtcaacgtgcagcgggaggagcggcggccgcccggaagtatctaaaagtaccctatttctatcgagaaagtatctcacagttcatttacataaagactaacccattaccccaaacataaatcacttatccatctactccgtagctagacatcagaagttcgtactatccatagaactagccatatgctcgtaaaaaaccaaaggacaaggttctatgcatcaccgaaggcttctactagctctactgctctccatctcccatgccccttgtcacagcaagagtagaaagagttatactgatggtgtaagtatagtatagggtcaagtataggctttatatagggcagtttccttcagcctaaaggagaacatatgtcccagattcatgatgagctggataggtagataggtttccccctctctcgtcctcacctcaagagtggttgatcctatccatttcatcaatacacagatatatttgtctgtcttcctctccaaaataattcaagagttaaaacagattgtacatagttaaatgtcatgtatagtactattccttattattattattatta

SEQ ID NO: 10685 - DNA, 1037 bp, Oryza sativa
  unsure (1)..(1037): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcactgacaccaaaagagaaaaaagctttctgtacatgcttgcgtagtttgaaagtctcgactggtttctcatcgaacattataaaacttgtatctatgaaagatttgaccatctctgggtacaatgctcacgactgtcacaagatgttaactgtcttcctacctattgctataagagcggtcaagccagttcacactaagttggtgataacaaagttgtgctattttttcaatcgagtatcacataaggtttttgatcctgaagagttaggcccccttcataaattcgcaatcgagacagcttgccagcttgagatgtttttccctccatcttacttcaatatgatagagcatctgattgtccacatcgtccctcagattatcgaaattggtcccctatatctacatcatatgtgggcgtatgagaggtacatgtcagttctgaaatggtatgtctgtaaccaagctcatctggggggatcaatgatagacgggtacataactgaggaggtggttgaatgctgtatagattatatgaaggacgccacactcattggtatgccccctcctgtacacgagggccggttagctgggaaggggaccgtaagcaagaaatggttctatgatgaggcctataaagttgtagcggaagcacatagcagcatgctgcaacagcgcgccatcctcgagccgtacattgaggaacacatgaacgagatcagagctt

SEQ ID NO: 10686 - DNA, 872 bp, Oryza sativa
ggtccaatctgtttttttagggttctgacttcctacaggctagtaataaattattgattgaagaatctaataaaggtttcagtggtttgcctaaaaatagccacatggacaagtgcatagtgttctttttatcctcttaatcaatataatgcttaaagttatctagttctttgcgaggtcttggaatgtccggtggaatcttgctaagcatatatagatgcgcatctccttgctattttttactattttgagaatgttttactgtgttatattcattaattggatgatatatacttttcatctttgacttcacattttgtaataccccagtatttcctatattaatttgtgaactaggcaggccggtctcaatttaataatacgttcacatactgtatatttgtatgcacattaaatagttcatcataattttgacacttaattaattatgtcacatcagctagatttttagatatttttttcatatatagtagtattatcttgccagcaagttgccagtagataaatgtataaccaagtcagcgcgcggtgtaagtcccaactgaaatgaggcgtatatacctgcagcaatacacgtataatacaagatatatatgtataggtaatactgcaaggaaagtggtgtgtacgtgtacgtgtacgtatagtatacgtacccgaatccgtgcttggcgtagtaggggaggttggagagggaggtctcgtcgatgtcgaacacccagatctccttgccgttgccggagagctggaggctctcggcgtaggcgatggcctcgtcgatgacgacggcggagtcacggcggtagtggccacccgagcatgtagtggccgacgtagcccttcgcacctgg

SEQ ID NO: 10687 - DNA, 675 bp, Oryza sativa
caacagacagaagtggggcgcataatcagaagatgaagatgagcatgacatgtttataccttctccattgggcggtgaaatggttgatgtggatcacgatctgctgcaagacatgttacgtgacggtgaagacccagcccagaatgagagagattccatgaagttcagcaggttggtcagtgattcccagacgtctctgtacgctggatgcaaagcaaaacacactaagttgtcagttaccttggacctaatgaagctgaaggcaagtagtggatggacagacaagagtttcacagatcttttaggaattttgaaggctatgcttcctgctgagaacacattgcccgagacgacatacgaagcaaagcaggttctgtgtccactggggttagaggtccgtagaattcacgcttgtccaaacgactgcatattgtaccacaagcaatatgcggacttggatgcttgtcctgtctgcaaggcttctcaatacaagcgaaagaaaagtgctgacgaaggaaagaagtcaaagaggggtggttcggcaaaggttgtgtggtatctacctatcattgatcgtttcaagagaatctttgccaacccgaacgaagcgaagttagtacattggcacgccacggagagaaggaatgacggtatgcttagacacccagcggattc

SEQ ID NO: 10688 - DNA, 1126 bp, Oryza sativa
gtcattgcattgatctcatgcatgtagaaaagaatgtgtgtgagagtttggttggcctgatgttgaatattcccggaaagacaaaggacgggttgaacgcgcgccttgatctacaggacatgaatattcgcagtgaactccagcacatacgagatgcagagacaggttgagtgtacctccctccagcctgccacacattgtcgaaggatgagaagatcgcaatgttatcatgcttgaaggatattaaagttccatcgggctattcagtgaggataagtaagtatgttaaattggacgactaaaacttgttggaatgaagtctcacgattgccacgtgctaatcacacaaatcttgccagttgctatcagaggcattctaccatcgaaagtgcgtcacacgatccaacgtctgtgcaccttcttcaatgcaattggacagaaggttatagatccagaagatctagatgggttgcagaccgatattgtgaataccctctgtcacctgaagatgtttttcccactgtctttctttgatataatggttcatctccctgttcatctggtgaagcaaacaaaactatgtggcccggcttttctaagggaaatgtggccgtttgaaaggtgcatgggagttttgaattcatacgttcgtaacaaagctaaacccgaggggagcatcattgaaggttacacgaccgaggaggctattgagttctgcgtcaattacgtccgatgccgatcctatcggagtttctgcgtctcgtcacgagggaaggttgttaggtgttggcccaatcggaaggaatagaattaggcccgatcaagcgtcgtacgtgcaggctcattacactgtgctccaacatatggcagaagttggcccatactttgaggagcacttagcgaaaatccgagatgagaacttggggcgatctgatgcatggattaccagagaacataactctcggttcaacgaatggttcaagaatcatgcgacaatgtccacggatgtcccaaatgagacagtacagttgttggggatggaaccgtcttggaccctgggagctaaactacgtcaagttcaaggttcctttgttctgctgccgttgggtgaatctacgcactggtg

SEQ ID NO: 10689 - DNA, 481 bp, Oryza sativa
aacaaggcggagaaagatgcacgccttgaagccaagatccgggcgtcgatcagagcggagctgacatctgaattcgacgaaaagctcgagtcgatgagggccaagattaggcaaaagatccaagaagagcaacagaacccgcaggccgccgctgccgttgcgcatgaagagttaggaagtcccacccaaaaacgcagcagttgcgcatcaactgagttggcagaaaatccaacatcggttaacagcgccatcgaccacataatggtaaaagtttcgtacacaatgcatgaaaggcttaacgaatcaatatgatatataatattctaaagaaattgatgaatctatcgcaggaaccaacgagctgcaccctcacagttagggtgatgccgaccttcacagttccagcagccgagggacttgcgtacaagccgaccccagagacaagagtgcatggattgcaacttaggggcgactgtgcaaa

SEQ ID NO: 10690 - DNA, 530 bp, Oryza sativa
tgagtggtggggagaggataagatggaagagaagatatgataggggacttagtttattttatggaggtataatttttgcaggcggaccacataagctaccttgtgcaaaaattcaaaaatcatattttttttcaggcggaccacttaagaggtccgcatataaaaataaaggtattttcgtaggcggacctcttaagtggtccgcctggaaaaattaatttccgcaggcggatgatgaaaattcacctcggtttatattttcgtaggcggatatttggctctgggtgtcatatccacctgcgaaaataaagatccaacgttggcgaaaatgctttttctagtagtgaaatatgtgacgctgcagctagttaataatgccaagtgatacttaatgatcgatacaaatacgagactgtgatactttatatcctgtggaaactgatttaccgctcggggcaagcaacatacagtcatcaaaagttggcgcatacatggatcacatgcacgagacaattaccaacgattaatat

SEQ ID NO: 10691 - DNA, 890 bp, Oryza sativa
ctatacattggttgataaattttctcctaaaaatttatttgggaggtccaaatataagtcaatcatagagtaattaaattataacgtatgtataaccacaaaataatttgtatgtaattaaaagtctcacacagtaacatattattttcatgaagcagaggtcgctatgaccaaatctccttacccatgtacacgctatgatattttgtattcctaacttaacggttttaacgtacaagttacattgcagttttatgtaagttgcaatataagtaattttagtgtatttatatatgatgaaattttagaaagagaaaatttatcgacaactatatagaaaaatcattctactgaatattattccagtcatacaccatgatacttcagggactacaaacgcatgggtaaattttatagtgcaaaccataaatacattgaaaatctgaaaactatatcgttggatcgaaaaatagacatttgaggataaatttactcctaataaatttttacttaggaataaatctgcgagttgagtaaaatttttacttgtgatgacgtggataaatctcagacatctatattttatccaacggtagttttatgtttccactccatatgtagaagatgtggcgtctgcccaaggaggaggtggactggatcctctctcagttcaacgagcctgtctgcgcctggttccgggagctgaagcgcgccaacccgtccactagtacagatccttccatctgtgacggcccctaacaagactggaattcgcgggccgtcacaaggaagtaatctcaatcgggccgaagtttcgcccgattgaaatatggtcgcacagccatggtagatcggcataaaactaagggtcataattgaggcccgattga

SEQ ID NO: 10692 - DNA, 651 bp, Oryza sativa
gagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccagcaacagccaattggccggaacgatcgaagttctggtactatgctcacggtggaacgctcaacccagctgatggctcactagtcttcggcgatcagatacgagaggctgcgcgacgactaacagatgcagtggaagcctcctctcagggcacgttccgaccagacagagatagggacgagctgacactcgccctggaaactccagagcattcaggacgaacacgagggaaaggggtgattccttggaagaatggtttcaaggaggacattcacacgtacaggagtcggatgaggagcaagagagataccgag

SEQ ID NO: 10693 - DNA, 331 bp, Oryza sativa
agtcgtagtcgtacctcgaccatctgaagttaaggtggggcgctagagttggtttattacatgtgcatctcatctggccagcatgactcacatacccaacttgtagcatatccggatgtccgtccacaatcatgtcgggtgatcaagccgacatcgtttgcgagtaattatccgttaacaacccttttctcaaatagcccagtcatagccggtgctatgagataggtcgtcggtcttcgttggtaggttggctgcgacaaatctgcatttgtctagaacgttctcgataatggggagtgctcgaccacaacctaatcgagtgctcaattgt

SEQ ID NO: 10694 - DNA, 1271 bp, Oryza sativa
acacaaaacattggtttgtaaatttaattcatttttagttttccatacatattataacatgtcaccctttgagcatttgctcgggggccatttctatctaatattcttttctgagtgttgatttcatgaaaattctattcgacattgtcgaagactccatgtctctattgttctacaccaagatcgactaaggcgagtatgacaaatgttgacaaggtttcgtcgcagactttgcgccttctcgaccatttgagaacggctggtggatctcaacaaggaatacggaatgaaaagatggtgtacccgccgagataaaatttcttgacttcaatccaaattctcgattacagcaagacaggaaacttagtcgtatgctctgtaccttcttagttgacgtcggagattgactcagacaaaccctatacggtgcctgcacaaggcttataagggaagtctagcgttatctctgaactcaccgagaacggtcacgtgacctcgacaacagttattacgaggtcttcggattgagaatatgtactcgttcatttgcattaaagccgggggctactgtcagggttatggataccacatacctaaatagaggtgactaaaatttcgggacgacccaacacataccaagttttatacgaaaacaaccttcgggtatagaaggagttccagataaggaaagataaatagagttctatatggaaacgacaaggattactcagattgtatccatattggtttccctagttctacttggaaaaggaaacacctatgggtataaatacaagaccctctaagaggagaggggggatggaacaatagatcaagacacaagatcaacatacaagccaacatacgccaagacaagacgccggatatcgacttcagagataagcatggctagtcccttacggtgtctagggatactgataggagagacatagcgctgtctttgatcttgctggatgcggattcgagaaggaaggctaccctgttgtcgactacgagtcagcacttcagaccgccaagtcgacaacagttagataggctaccccaaatattgtactggtgtgattatggtgaataagagcaacgaccggcttcggccaacaggagtagggttattaattacctggcaattcagggaaccgaacctgtataaaaatcatcgtccccatctcttttacctcaatctcacatatatcctagtaccaacgatccccatattatacaaataccgtagacgtgacatcaaacgtcga

SEQ ID NO: 10695 - DNA, 3222 bp, Oryza sativa
  unsure (1)..(3222): unsure at all n locations
agagtgccacgtggcgatgggttttgcgattagggagaaagagagaggcatggacgggagtgggctcatcggtatcgcactttggtagcgcgacactagcgtcggtagcgtgtttttagagcgcgagagcgttggaaaggagctcgccgccgagggactggatcaccagtggagtcgtcggagacgaaagagtttttgcgatggagcacgtatgaaagacttagccggaaaaaggggatttcaaagtagtggcctctacagtcaaaacagaaacccctagattgatgcgggttcgagaagagcaaaatccgccgcattatataatatacaacggaattggggggctgctgacgagaaatccgcgctcagccgatggtgccggaactgtgttggcacgaactaagttgatgaacacaatggcctgagagatctgcttagctctagtgcaggtccaaaacatgatggcatgcgggcatgctagtcagtttgatcctacaactgacaagatatataaatagtagatcaaatagccgatcagctgacaagccgctggagtagttccggtcgatgccgatactagccgatagcgataaggttttgagctattggctatacgtccaatgtgggatctgatacttgagtaaataatgatacatagacaatcggctgataataatgtaacaatacaacaatataatccaatagaaaccaatcggctaacaatatgatagaataagtattgatccgaaggttaaagcatacatcggctggaggtctgatgtcattaaatccacaagattagataaacaacgaaacctttgttgcgatcggctaaatctaacttgtatgtaatccttataagccgatgcaacgtccagataactcatcagctgaaaccccgatgaaacccttattataatcaaaggcaggttagcttttccgattcaagcacgactagggatgatatatcgcaaagtatgcaaagaagcataaagtctaaacaattaagtctttgactaatcttcagggcagtggatatcttagctaatctaatatgataaagcaatttagccgataccagcataaacccctaaaacaaatcttagccgatacaagtaaattgaactaccaaaatagattaactaagatatatgatagataggtgcttacattgacaagattagagtgtcgaagccctagccccaccggtgcaaacagccatgagaagtataaactcgtcgaaaaagtagaaaagcaaaaagagtagtgatgctccgagagtagttgtattgatcgttcagatagattacaatgacctcgggtgtacatatttataccnagggtagatgctagtccttgttggaaaagaaagaaactttcctgaggataaaaggaaacttacatactcttccgaattaatagataatctgcttgtcgcatccttctttaactcggtctctcctggataaacttcatttgattgattaatttccttaaccgaatatagcaagaatccgactattaccgacgtgataatttcatcggccgattccaggactctgaagctgaaactcactctaggccgatgatgacttcggggcttaccaaattccactgttaaaacatgccccccaattttggagtatgagaactcatgcttcaaaattatcttctttttgatcttgatgactccaaaattgatcctcttctgtatctcgcaatccgctttcaacaaaaaaagggggaaaaaattgaccacaccaacaaaaggggaaaaaaattgactaccaacaacggagtagttgagaagactacaaaagctaagcttagttccttctgttgaatcgggaaatttgggccgttgattgaatcgttcaataattaattgttcttacaagcttccaatcttcatcgtcaagatcggtgtgggaaggataatgatgatccgacaagtgtcccaaaacctccacctgtgtttccttattcagcctaatcgcgtcctccctgttggcgaaatagtcatagtccacctccacgaatcctttgcgagcgtactcgccacaaacccaggcctgcaacttggcgaacttggcctcgtcctcatagaagtcgtgggtccacttgtagaggagcatggtgtactcacccttctcctccggcaacggcaccagggaccactagaacggataccctcatctcaatcaggcagtaagccccatctcaatcgggcacggcgtccgtcataggctagaagttactgatgtgaaaagtaatctcaatcgggcaaatggccgtcacagatgaacctatctcaatcgggccctaattaaagcccgtcaccgatagctttgacccagtctaccaagcgtactatagcccgtcacagatgacctatctcaatcgggccacaaatagagcccgtcacagatgactactaacctcaatcgggcctaaactagagcacgtcacatgtgacactcatctcaattgggcctaaactagagcccgtcacagatgactgctgacctcaatcgggcctaaactagagcccatcatagatgaacatcatctcaatcgggcatttagttatggcccgtcaaagatgagtataatccacaaaaaaaaataaattttgtttttttggctagcctcaggcctttgctagccatgcccgctgcaaaaatgacagaaacaaatacagatatctaatatccccagctccccagcatcacccattcatacatatgcattcacatacacagacatcaatatatttcacacaaccacacattgacagccatctcatatttcatatccattcacatatttcacatccatttaaatatttatcgtatttcacctgcaaaaccgagttaattggatcaaatatttatttagcaagtcttaacataaacatatgaaatatatacataaatataagcatcacagttacatcatcacagttgcataataagtgttcatcattctctagacataaaagttcaacattgctcatcattttagtttaagcctaaacattcctttggggttaattatttcacggaggatgaagctggctatctcctcacgaatctcctcaaagctggtaggcagagacttggttattgtgccctacattgtcataattccagattacttgatcgatcatatataagtactaaaatgtagttagtctatcacaattgagaccaccgacctcaa

SEQ ID NO: 10696 - DNA, 280 bp, Oryza sativa
ttgcagctcctgaaagcctgatgcgtgagatagctgccaaatacacataacaggttcattcttcatcttttgccttttcatttctatgcttctagtcaagtagtcatgatgggttagcatattagattctgttagcatattacaccatgccaaatccacaagggcaagatgtatatgtaatccaacccatagaactaatatagtttaggacccaaactacatataatgctaataatgataggctactagttacttcctccgtcccaaaatataagggatt

SEQ ID NO: 10697 - DNA, 443 bp, Oryza sativa
gaggacactgagaacaaagctaagtgtctttattttcctttttatgtaatattttccattgagcaattttttatatctgctcatgctaactactcgtccagcgccggacgcctagttttatcattatttatcatattgatttttaatctcagattaatctcttgctattttttgttgttgttcgcatataattacgcggcactattgaggcgattaatgctggtcatggagtcgaggcgtctcagctttccggtcgatcggccgcgagtccactctgccggcttgtcttcgccaccgccattgctgataacaacaacgacttcaccgccggcctgcctccgtcgccgccgagtggtgcctccgcctacacggctggcctattatgccgccgctgttgggcgtctacgacttcaccgccggcttgcctccgtcgccgacgagtg

SEQ ID NO: 10698 - DNA, 660 bp, Oryza sativa
aaaaattccaccaccatttgtggaatcaaggcaatgagaaaatattttctttgtcttccctgctgcagccaattgtgatagcaatgtctgatttgaattgccaaaaccaataattccatcaatcgctagttctgaattgtttaagcttccagtttgttgttaaaccacacctagaagcacaggggagccatttcgtcgaattattatcacggatttgccccacgtccctaaaaatatgtttgctaaaaaatattcttctactgcataggatagattactttccaagccatttgttaagattgtttctcaagtagacaatccacaaaaataatctagtaataatttgtttcaaacatggccttagtgggccaacttatatagtacacattcttagatagcacagctacgataaaacacaattaatacagcctacccaccttatggagaacaaggcataaaaaatatcaaaatatacctatgaccgccataaccaattattgtcatgtgatgagttcatcagagatttacatgaaaagaaaataaatatatttacacaaaacccataaccggcatcaacgccaatttctaaaccagcagaggccagccgacactagtgatctcggctatcaataccggtggctgaaccgacagcgatgctca

SEQ ID NO: 10699 - DNA, 5640 bp, Oryza sativa
  unsure (1)..(5640): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggtagagttacctgacaagtctagaatctccatcttttccatacctgagaatatgaatgtgaatggatccttttcatctttggttgccgtatagtcttgatcaatcatcttgattacacgaagcttctgtatcttgttatgctgccgtttccaaatatgtctcaagttgtgcggtttcactccctcaacattgagctccctgacattgttcatttcctcaatcatctgtggggagaaaacccactgtgtgtactgtaggtctagcacccacaaaccatgaaaacagttccaagactgaacctcctctccagcatcaatgttcagatcaaggcagttatcaagcccaaggaatctcaatccgcggcaacagaggaaaggaggtgaagcaaatctaaaagtacagaggctaagttttagcactctaaggttctctgcatgttgaaacatgtcattataattttgtaaaagatgtgcaaggttgagctttgacttaaaaaaatattctactagttccaccgtgtcttttgattctgtgtcaatttggtgtgctgccaagaaaaatgatgacactgtttgagccactgctgaggcagccaggaacccataattacttgaaatcaggtgatttgttgaaatccagttgtcagtgttccgcatcatgtggtaaagtccagggtcgtcccattcttgccacatctcttgttgtagagcatcagcaatctcccattcctgaatgatcccatcacacacccaatagtttgaagcatgaactgcccagtcatagtcaatgatgtctctgccaacaaaattaagtttcgatatatacaaccaacatttggcaattgttgttgggtgcagcttggctactccggaacatgtgttggaagcaatttctgccgcctcctcacacaatatatcccaccaatggctttgatcctggaactccatcccatatattttgttatggaattcggcagcaagaaaaacatctgccacttgcaccttgtcttgaattctggtactcagccgaaacctgcccctgaaggtccacaatattttgtttcccttatacggttgatatagaggcagaccaaaattagttacatcttttatttcattatcactcccattatgaaaaaccacaagaaatcttctactcattaggacatcattaacagctattccaacatcattgatcacgtctctggagctttcatcttttccattgatatcatcagcctcatcctgctcatcaataagatcttttgcttgggtcatctctagtttctctgcaattttcctctgcatttcccttctgcttttccacctcgagcaatcaatgtggattatcttttcaaacttcaattctgggtctgcgatctggaccgttgtaagccgtttggcaacagctctgaggacagcagatgcacccaatccttcccaaccatcaaagtagaccacatttgatacatctgatttctttagtttgtcaattatactatcaacagcctcagcaacattctctgcggtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctatactccactttgagctgtcaccaaactaggtatgctgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaataataaaatgatttggattgaaatatcgtgaaaaagatgatttggcatgtgcatatttattttgggagtacctatagaacatttgacatttttctaggagaaaaacttaaatgtaattacaatctaactagtatgtaactagaggtttactctgatctaacaaaaagtatcttgaggtatcagtacctcactgtatcaaatcgtttccgatcgttggatccaacaatgcccatcctgtccagtgagatccaacgatcggaaacgatttgataccgtgagataccagtacctcgaggtactttttgtttgaatagcgcaaatctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaaaggatagagtaatttatatgtaagaaagttttgatcgaaggcgggacctcgagcccacgagtcgcccacgcgccagcggctcgggggcaaaccctagccgccgccgccacccaccctcctcccttctctctgcctcgccgccaccggagttcaccgccgaacaaccatgcggggagccaggatggcgggcggggccataccgcggcgacgcgtcgtcactggcacgagggaggcggggcgaagcgcggagcgcggtgagccgagcggagggcggcgcgctcgatggcgagggaggccggggatccggcaccgcggtggctagatccggtgctcccgcggccggatctagctgcacggcgcagggcgacggctctatcatgggcacggaaagctacggctgaaggccgccagcggcggcggcagcggcacgagggccgcgtgccggcgaggggaggactgtcgcccgcttggcagcatgctcgtgcctctctccggccggcctggtggtgtgcgcggggaggagctgtggggtggtggactgggctagctggtggctgagaagatgatgtggtggttcagcgacggttgttgtgtgaggtggtggtggcaatggatggaaatcgctggcgaaagccttgcttagcacttggctggcatgacgacggcgacgccctttggcgccgtttcctttcttggaggcgtagttatggcatttttcttcatcgctatcaatctccaggtgaaaactatgttccggtttccggacggacggtggcggcgtttcatgtcgtatccttcattggggcatcgtcttggagaaccttacccttgcttcgattactgttagcgaactcctgtgtcagctcgaagcactagatgcctaggttttggcgaggccttctccttcctggctccattcttgtattggtggcatccagcttcttcatttgtctctgtcaggtggagtcgaagctgtaacgtcgttggggtgcgacgttgcttggcaacgataacatttgcagtttctctctagggatgttggtgttgccagtgcaggttttggcgcctcaggggctttggctgatgtctaaagtatgagcttgctgttgttttgctcgttttggcggtgcctccaatgatgttatgatcgccgtggagtcggagctctgggtcgctgggcggcaaaggttggcaacgatgacacgtgccttgtgatgtcaaagttgtatgccgcttcttcagcttttcgacatcgatgttcgcctttggattctgccgtcgtagtttggttagagttgtgtggtgctcagtgtgttgtgttgtttgtaccggtcgtggttgaggggcttggcgagtctacttgccgagaggttattttttctttttctgtaacccgtctagttttttacttctgcttaattgaaatataatttgcagttccctgccggtttagtttaaaaaaaaattatatgtaacttgatcatttcctttttcaaaaaacacagcatcccaagtggctagtgccgttgacttgcaagcagcaagtcttgagttcgattaccaacttgcgcgtggaaaatttgtaagttttgaggaaataaatcttaaaataaattgtacatatatttagtatatgcttaaatgttgagttttgtgtgctttacggtagagccaaagctcaaacgatgagaaccttagccacgtactcctttcgttttttaatatatgatgtcgttaacttttagatatttatcttatccaaaaactttgtgccaacattttaaaaatataagtcatgcttgaataaccttaatcataaaacatcataaaaaataaataatgattataaagacgaatagtcaaacatattaaaaaaagttatttgtattatatattaaaaaatgaaggtaatactacttaaaaacttatcagtgttggacaaaaatagcaacacacatagaagagagaacagcaggacgtgctgcgtcaggtggcatcgcgtccaggtgagccccgtcatacatgaatcgataaatcatcttgtgcataaatcatattgaaaacaatatttttgccaataaatacctctcggagcataatgaattgccctcaagaccagcaaatcagggcaagtggaacccagatctcaccaatcagcatcacaccctacaaaaagacatgcattcagtgttggtttcttcgaaaaatttagatcggttctccaaacagaaaaaaagattgaaattttactagttagagagaagggacagaagaatcacttctcatttggagctgggagagaaagggagagagaccaattaagaaatgatagtgaaattgaggcaataagcaaagtgcgtgtctgaggatatcaggcagaagatagatggagcttagcaccagtgatcgatgcaactggtatgaatatattgtccctagtttgagtttcgctccttttaacaaagcttctaatgcgtatcacttttgaacaaagcaaaaggcaaagctctagcatcacttgtctgggtagtttataccttacttcctccgtttcacaatataagtcattctagcatttcccacatttatattgatgttaataaatctagacatatatctatctaggttcattaatatcaatatgaatatggaaaatgctagaatgacttacattgtgaaacggagggtgtacttatgagcaacaggaacaaattgtgtattgccatatacggaacactaacacacctttaagaaagcgaattacgtgatgtactccctccgtttcaaaat

SEQ ID NO: 10700 - DNA, 2463 bp, Oryza sativa
  unsure (1)..(2463): unsure at all n locations
gtcaaacattttgaaacggagggagtataaagttttgagatatcattgaacacctccaaaaaaattcttacagtgatgcatgctgcgccgatgaagaaacaaatcacaatggtagctgtagatgttactttctccgtttcacaatgtaagtcattctagcatttcctacattcatattgatgttaatgaatcttacatcaatatgaaggtgagaaatgctagaatgacttacattgtgaaatggatggagtaattattctctctatctttattctcttttcgctttaccaaaagagaattggcaacatgatgacagaggctcgagagaatgaagacagagttagggtgaattcttttgtgtttgtgtgtgcgcgcgtttttgaaatcgaatgcttttccctgttcattgatctaaaatttgcaatatgctgatgataatcgttcgggatcggatgcctcttccgaatgtacttctttccatccaacatcgaatgtactaattcttataataaacgactacaatcatgttagttgcagtgacctaaatagcactctaaagtcctgagtttaaatcttcatatgagcgaatttcatattggattgtttgaggggctaaattctcaatttaaaaggttgcatattttatttgggcatcatttgattttggcatacagatggctttgcccagtagtttaaattttataaataacaaaaagggtctagaaatacaaatacaaattacatgggaaaaaaagaaaaactcaaagctttatgaagattataacctatctaaaactctcttttagatcattatattcatcctccaagatacaagagaatctcattcttgaaactagctaaccatctgtcgacattaggtgctaggtgctcaaaaaaaattaagcattccgctgcttccatatatgtcagcatgaagattattactatcttcaagaaatctttcattcaaaagcacaatcttgcaaaaactttcatcttggtagaaagacaatgacgtcttccaggaaattctaaacttcctccagtagggcttactaaaagtgcaatcaaatacattcttgtttcccctatcaccactcactcactcaggcaaaatatgcacatgataaatccgtgtcctgtggagcacaatgttgatcatgtcattgcacaacagccaaagaaacacttttatctttatgacacattttgatttccatttgcatgataacggccttgcatggctgcttaaaaaaaacaggctatacattcccgaatttttttaaaatagtaattaataacctgaaaattaaattaatagtaaatgaaaggtttaattcactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtaacaccaaccgggactaaacaccaaccgggactaaagatggctcagccacgtggccggctaagccatctttagtcccgggtggtgttaccaaccgggactaaagatcgagctgaccttttttttttttttgcatggccctgttgctgcatggattatatatatatatatatatatatatatatatatatatatatatatatatatatatatatatatatatatatatacaccctattataaaaattgaatatgtttccacggtctgtcatccgtgtttgagtcggttataaaaattgaagatgtttttgtcggtattttggtaggtcatccgtgtatgagtcggtttttaagttcgtttgcttttggaaatacatatccgtatttgagtcggtttttaagatcattcacttttttggtaatacaaaaggaatcatataagaaatctatttataaagaatcagatactaacttgagacaatcggactcctaactgtagctcatgattttctaaaaaatatatatccaagcgaactcacatagtgaatttcatcttaactaaaccatataacaataatatgattaaaatagatttcactcgttgcaacgcacgggtattttgnnatatatatatatatatatatatatatatatatatatatatatatatatatatatatatatatatatatatatatatatatatatatatatatatatatatatatatatatatatatatatatatattgcatttcacgttaacgttcgtcctcgttcgttcgctcgttcacgttccctagctcgttcacgttcgttcgctcgttctcgttcacgttcgttcgcttgttctcattcacgttcgttccctcgttcttgcttgtcttcgttcgatcgttctcgttctcgctctcgttcgttcgatcgttctcgttcacgttctcgcggcaacgtacgttgacgtgttcgttctcg

SEQ ID NO: 10701 - DNA, 24169 bp, Oryza sativa
tcttcgttgatgaatccatgagttgttcttgaaccactgcgataaattccttgtgtgtggcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacgtaaccgataccaagccctacatggagtttaaagatatgattcgtagtataaataattaacataacaagaatttcttaattaacagagaaacttatgccagtacctgtctataagttcgaaaaccttgtcaaacgtagactcttttttatccattgagtcatatacattgacggtgcaggccgacaggtcgaagaataaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccttcaggagatggacgagattgtcctctgtttcctgtttcctgcggatattggtcgagcattgcaacgtttactctccgagggtcgatgaatccagtatcgaaaaccctccgccatcgggccctttgaatctccattctacaacgataaaagggagtattttattttatatagtctacttatatacaaggacctaattaattaaaggagacgtagtaattaagaattataattgaacaatatacttacaaagtccagcaactcataatagagacgtcgagggcgtccagctggtatacttcgtagattcccttgaaattgatccagagaatatcatctccttgcaagaagtccaagtccctgatcctcgctccgatcatctctctaccggtggcgctcatctccacgtacagctgatggaacctgtacatttgtgtgggtagggactgcaccagcttgggcttgacaagcgatttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagggactggtttagactttccagaagatgctttcttcagcgttcgctcatagtccgatagcttgatggcctccttgacaggtgcagacatacccctgaagaagttcatgacactggggtctataggaatcttcttttctggacttcgaggcttgaattgtctcttgacttctgatgcaacgtgtcacaccctgaaaattcaaaatatataaattgttgtttaaatggaatttttagaatttattttaaaagtcttgaagagaagatctaattttaattaataaattccaatataaaatgggcccagataaaatttcattaaatactttgcttaattctataattcctagatttttctgggatttatttgagctaaggaagtatttttaacaaatggaattgcatttaagaaataatttaaattgaaaaaggttttaaaaagtctcttttggctttgggcccaaaacctttctctctctcctcggcccagtccggcccagtccgccgccgcgcgcgcgcgtccgcccgctgacaggtggggcccacctgtcggacctatcgtccaccttcggccaccgccgcccgaaactctagcgccgcgccgccgccgtctccttccaaatccggccgctcctttccgtttccggccgaattgatagaggggaaatgatcttctcgatctcctctacctcttctcctttggaaacatcggctaaatcggtttggaaatcgatggattcgagttggattcggattcgtttttcccgaagtttccttctcgtcgccggccgccgtgggccttcgccgtcgcctccgagtccctttaaaaggaccccccggtgtctcctctactcgtcgccaccctcgccttcgcctctcgtcgccggaaacgccctagcgccgtgagacctcgagccgccgtcgccgccgtcgctccagccgtgcgccgccgtcgttcccgtcgtcgtcatcgctcgggaaggccaccgtcttggtcgccgtagcgtcgccgtcttcgtccgccccttcgccgccgccggagaccgccggagcaccgtcgccgtcgtcaagccgaagagcgccgccgcttcttcttcgtcgccgtcgccgtccgttgatcttccgccgtcgctttggtcgccagtgagtccgccgtgccgtccgctactcgttggtgccctccgttcgtgccgaagcgccgccgttcgccggcgggcttgtgcgtccgagccgccgaaccgccaccgccggtggtgacgtcatcgctgacgtcatcggggccgttcgctgtgagccggtcgtggaccgatcgatctcggccgtccgttttggatcgattgatctcggccgtccgttcgtgtgaaccgccgccgtgcgcccggtccaccgaaaccctagcccgctgacgtaataatcctccttttccttttcaaaaataattcattattgcgtcataattcaattaaaatcaatttaagtgttttaatccgatttaatcttcaaaaattcataactaattcatcttagctccgttttagttggttcaagtctctaaatttttctaaaattgagatctacatgttaaaaatatccacatgtactgttcaagcttgtttatgtgctgttttggtgattttgcttctttttgtttagattccgtcgtttccggagagtccgttttcgcaggagaagagtttgaagagttccaaggccagcaaggcaagtcacacagatcccaaacaaccctttgagcatgttgatcctatttaaagctattgtttctattcaaatattgcatttgttttcgaatgtcattgggtggaattaacctattgtttgttatagcccttttgttcttgattaccttattccttgataccttgggttattataatttgactagttgagctttatttatattggttcaactagatattagatataattgcttagccctgcttagaaacattagctcacttctgggataaattatgactcactattgcttaatgatggcttaatgatagttcacgatggtcaatcgtgattggttaattaattaatgtgccaactaaaacctggtaatggtgggttgtgagcacatggttttgatggtcgtgctcatgacaattaaggaccagttcacgagtttcggttgtgaaacattaaccgtgccaaccacaagccagcatgggcaacggctttatcttttgtatagcatgtttcattgcggggcaccagactgagaagtggcggagataagcccaccggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgaggggttgtgtcttgtgggtacagtggtacacctctgatcagagtaaaactattcgaatagccgtgcccgcggttatgggcggtcaaacaatgtctttcgtgattagtctcacacttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgttgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttatttttccgctgcttagatctttattgattgagatgaactatctacctctgtaatgacattttattcgtttattaattagagtaataattgtactctattatcaatttgttattgtgtacctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactatattaatggctcattttccagcaaaagttttacaatgttgttttatttaatcttgctgcaacaaaataaatttagcaagttgattttataattttcttttatttcttttgaaacctgatgttcaaaagtacaaaatttgtaaccttgtttccaactgtttcaacttatcttgcaaagcttggtttactttatttacttacctttttactttgattttctaaactttattcaaatcaatccaaaaacttgtgctattaattggataaatgtcttaactccctcctttcacttgtctttagatgccgcgctacaagcctgagtacttgtttgatgttgagggttttgtccaggagtcgcgtacgatgtcctttgtcattggatttgggactgcccctttttatgcccagattcctcatgatcgtcatgaagagaagtgccaagtcaaagtcaccttgaacagtaatagtgaagatatcccctcagtgatgttcgaagctagaggaagaaactacatccatgcatgtcaggaggtggcaaggatcgccataggagagctccgtgatcgctacagtgatcagttggccgacactgagtatcgttaccatcctcgccaaccccagggaagtgaccgtggcagctaccttgagactgaaggaattgagaatgatgctactacaagacatttggttgagatgctgtgggctatggatgaaagtcgtgcggagactgtgttagcagctcaagatcgtgaagaccggaatcgtggtaagatttgcaagctagaagacaaggtggatcgtttggagaaggaactagccgcgttgaagggagaagcaccgccgcagaaggccaggattcgtctcaccgcaaggaagagagctctatttgtccctcgctatcaattggcgccaaaggtccgtgtggtggagaaagaagttgccccaaccctagcagattccccggtcaccatcataagtgatgatgaagaagaaggatccaagcgcaaccattccaagattgagtgggtagctacccaagatgatgaagacgagccgaacgagccttcaatcgacctccgatgctcggaagaactagagtgacttgttaagtcgttgtcttcgatcgttgtgttagcttgcttgttttaagtttggttgtgtgtgtctcgcatgtgatttacatcagtggtgggatgtaagtgcatgtgtttgttttcttttgagtgttaggaaggggggcagccgcctccgccggatctgggtggggcacggtcatccgccgctgagagcccgctgttccctgttgcccgccaccgcgagcccgcctctcctagtccactgccgctacgcgcctgtgccgtcgagcccgccgctcttggtcgcccgccgctgcatgcacgctgccgagccgcgtggtgccgccggctacgcccgcaccgtccacgcccgggagtgagaggtaagagagttagagaggatagagagatgagagagtgagagagagcgtagaaaggataaggatgaggatgggtggatgagatgaaattttgaagtgttgaggagggaaaagaggaggaaggatagacttgtaggcaggtttttaagaggcccgcatgtgaaaatcgattttcgcgtgcgggcattttaagaggcccataggcgaaaataggcttatttttttgtgcgcacccttacgaggccccttgcgaaaatcaattttctcgtgcgggcctcttaagggtccgcacacgaaaatgggaggccaatttttgcgtgcggacgtgaaaacggcctgtctgtaaactaagtagctcctcgtccaggaaaatcgtttctctaatactccctcaattccaaattgatctacatatagtttttaatgatctacatatttgtgttaatttattaggtctattcgttatttgtgcattggagtaaatgaacattgatgcatgcatccatgcacacaagtatttatagcacacatgtaatatcttgatttgctattggctaggaaatagtggggatggtgcatgtatcgagtttgttgctagagtaaatatagtattagagagttattagtttttcttgattttggtgtacctatgaaatatgttgatcaatttggaatggaggaagtagtgggcagtactgccgcagccaaactttgtttttggtgactggattatattcggtaaactattttcataccttaagtaacatccccttgtttttcatatcactaaaatagctatcaaataatttgaaaaaattaatatgatagatcaatatgaaatacaaatttaataaacaaaaataagtataactgagttctaaatgatattttggtcattttgtaaaaactacagacataatttcacgtttacctgatgtgatggcaaaaaagaaagagtattattgcacgtaagatggcatgttgttgaactattgtctatcaacggtattttacaatcgtacacttcagttctaattcaaaaaatttcacatacaaaaatttcttcaatggacacaactcacccgaatgtgaggctggtgttagttgattgagtcagcccattcccagagagttgattatagtgcacaagatcagtgacaaaggcgcctattgttgatccaccatcagcataggtcgcgatgaatggacaaagtaagcttgtgttgcattctggctgcacatccctatcgggcgaagtgcagaacatatcatcacatttcaccactttttaacttactgagctcctagggtcatataatgtcagctttttctgcacacaagaagatgtacgacaaaccatattatcattcagaatttcacatctataatgtacaaaaccctaaatggcaaaaagaatttttgcaaggtactgaaaaataaactctaaacctaccaatatatcgctcttgcgagggcattgcttgcaggggatgcagttaacccaaaatgcactgctgccagtgtccacctgcacatagtattccattgcgggtgtcccaatccctatctccgtgtagtatagtctgtgtcaaactctatcagatcgtaataagccaacctaccaagaagaaatggatagaaccaaaggaacattgaagcatataccctgtgctggatgtgctgatgccaccaaggccaccaagtgagaagtccgcagccacaaggcgactaagatggcggttcctatcgtgggtttgtaatgcacctatgtcactccccttacacccaccgcccatgatagagaatttgcggcgcacctggaataacccaatggccacggtaccacgagtagaggatgctaccaatagggccgaaaggattgctgatagaaacaaaggagccatctcttcagcaaagtatgtaccattcttttcctttatgtttttatgaagctttaaacagtaattcttggttcgtcatctggtcctcatccatcgcagtggactgttctatgagttttaatatgaaatggggtacgaacatggagccaaaaaatgcggggagccatgaacaggaaacatctagtggaagaagtcagcaattgttcgctgggagagtcagggaaaataggaaactacgtggtttttgcggttgagagtggaattgtgcatggggctacgggcattatgcaggccatccattatgtctgcaatttttgcacctattttgagaaaggctcccaggtctaagcttcttatctttaattatggttatgaaaatgccatgcatggctctctttctttttgggaaagaaactgctaatctatgataactaaagagtagtgattggctgcctaaactaaaatctaaacgtattactgcgtagtctatgaagttagaaaactaatcccaaaaaaactatgatcctggcaatctgactacctcaactgctagttggagagtggcttggctacctggactgctcaattctgttcagaccatcagcctagttaccatagacttgatgagaaaaaataattttctatgtcacaccatgccccaaaaattcacaaaccagaattccaagcagaacgtgcattaaaccactatccaggaacagctagggtagttgaactaagcatggctaagcaattcctaatccaacatctagtcatgttacatcccaagtttacaaaggaataaggtacaaaaataatagggctgagaacagtaggtacaacatcccatttagtaacattataaaacaatgcataacttaaaggaaaacatagagcatttgcaatatgggatcaatatattcaagtgacaaggatgacttgccttgctctgcggctagagggaccttggcgactatcttgaaatacaccggagcgttgggagagccgaaatctatgtgacatacaaggcaaacaatacaaataggttataagactactaaaacagataacaaaaccatttttaatggattcttcgctttttttttgatttactgagacttgaatgggcttaaatggagcacgaatgaattgtcaatgaattttagaaggttatctgtgtttttactataaacaaaaaaagccttaatcgatttattgcgcaataaaggtcctggatgatgtcatcggagaggggtggcgctgacaggtgggccccacatgtcaggctcataggtcataggctcatggtgaaccaagtccacggaaccggggatgggagcaccacgtggcgtcgacgtggcggccacgtggatggcctcgtgggcggcagccgaatggccccgatctaccgagtggtagatcggatggctgggaacgcatggcgatgcacgggcatggcttgagccagcccggtgggcatggcgcacgacggcgctagtgcggagcgggcagcggcaaccagcggcaagggatggcgcgcgacggcaccgcggctagcggtggcaccatggcgacatggcaccgcgatgcgacggcaacgcgcaagcggctagcggcggagcgacaaagagagaggagaggaaggggagggcctcaccgatcacaaacaaggatggtgagtgacggagggaggtcggcgaacagcggacgacgtcaggagagacctagtgtaacgccctgaaaatcgctctaaatttaaatcatgttttaatgaatttctagaaattttaaaagcctaaaagagcctccaacaattaaaattcaccaagatttatatcaaattggcttgtgggtattattaataaattccccatatctcaaaatgtttaaccaatttttacttgaattttcagagcatcctaaataattttaaggcaacaaaacaattaaagaattttataaaatggaaaagctaaaagaaatcctcttcctcctgttgggttgtttccagcccatctctccctctcttggcccagcccagccgccccctctccttccctctctcccctccccctcccaatccttgggccggcccagctgctctctctccctcggactcagagacaggggtgttccactcgatgacaggtgggtcccacccgtcatccctaacctccagccctctctctcctctccggccgaatctaccacatgtccacctccgattcgcctcctccactcgccgtttcatcaaattaattgaggggaattaattcccgccttatcctctccaatacccccataattttccactcaatccccgtttattcgtggtggattttgatgatgttctttaatggtgagctccaccatggcctgcgtcgggctcccatcggttgcccatttggcccaaaatagcttatttggcttattagaaaattaaaattaatttataagtaaaacttttgtagatttgttcgtagcaacttaaaagccaacattaaccaaaattacgttaaaagaatttcaaaatcaacttcaaagtcaagtttaaaaattcaaattttggcttattcttttactgtttaggccaaacgatggggctgtcgatcgccctacccggcgtctctctccctcccctccagcctataaaaggtacccccgactccctcctctctcccctcacaccgccgccctctccctctcctctctccgcgccgctctcttcttgtgccgccgccgtcgcaactccggccgcccctcgccggtggtcggaacctcattggagcccagcgtcgccaccatctgcttcgccgcttccttctcttccccgtcctcccctccgtcgagcacgaggaccgcgggaacgatgacgacaacgacgacccgaagcttctcgccgtttcttcctcaccgccagcaacaccgccgacctctcgccgccgcgtctgctcggtgagaaccgtcacctcctcccttttccgtttttcctcttcccgtgctccgttgcaccatcgccacgccgttggccgttgccggcgtgccgcctggctcgggtgcttctccttcctggccgtgcttgtgcgccgtgagccgccctcatggtgtaccgagcggctgccaaatgggacccgcccgtggaccccctctctctcttctctgtgcaataaatcaatttcctttagaaaaataattcacaaaattgcaaatttccatttaaacagcacctaaacttcaaatggccatatcttaaccgtttgaactccgaattaacctgttcaaatctctaatttctcctaaaaatgagtagatcccattgatgtgccttattgcttctgttcatatggtttttattagccttttttatttcttcgcgttggtcgtgtagatcctgccgttccagaagatcagctcttcatcgccgttgacgccgaagactttgtgagcgatcaaggcaagtcatatctatcttgaacatgttgaatcccatattgtgaaaattatgttgttttacttatattgcattgctttataaattataatgttcattattaatattgttttattggttattcctatgctctttgttatggccatgttattgatttcatatccatgattgttgtgaaccctagtaaaattataacttgactagtctagtgccctacatgatggactgactagttgctttaggtaaatgcttagtcctgcttagttccaacttagaacttttggataaactagactatggtggttaacaactaaaactggattagtattggactattgactggtttgtcaatagatgggtgataaaattctttgtgcaactaaaacatctttttgggctgggctcggggtgcaagctgattactttggtagtcgcaccccggctaatataagaaccggtctttgggcctctgttgcaaggcatcttcgtgcaaccacaagtctagtgggtaagacctgactggaagtttagatcttctcaaaacaaagaccattggttggaagggtgtggggccaagattaaggccgttttttcaccgggcgcaagggggggcctgtctcatcccgggggatccggcaacctttaccttgtcggggaccggcgggcggcgaaacctcagcaggttctcctgttttgggtagacctagatggatagtcttgtcacgacctctatccgagtaccgtggtggtacccggcgcgtggcaacgcgtgttgaggttgtgtcttgtgggtaaagttgtacacctctgatcagagttaaaaactattcgaatagccgcacccaaagttacttttgttttacaaaaccttgggagggtgaaatcatgatgatgtagtcatgtggtgattagcctgggttaaggcaggttcgttggctcatgagaccttgatgatattaaaatattggcttagaacaggatcgtgttttaaaatgagctttaacctgattaaaatgtttaaactatggctttctgcaaaataaaccctattaggccatttttcttgttttccctatgcattattattgcatttccggtgtgacttgttgagtacggtggtggtactcactcttgctcacaaaaataatccagaggatggacctgagaaagatgaaggcttggatctctagttcgctccgccgtcgagtgcctgtggctgctgctgttccgtagtcttccgctattttatttgtttatctttgagcgtgaggacctagagtcgcccatgaaataaagtacttcctttacgtttccgcaaataatcaacaatgctatgtgtacctcgcctcctgggacgaggattaatgcactgagcgtttggaaatggtgtatatttccgggcgtgacacctagggaacacaatgagaggggctagagggagattagaggtccgtggtaagctagggtgtgccgaccaaaggcggcggccatggagagctcaccgacgtgaggggagtgggctccggcgacgaaatttgacggcggaggggtggactatgtggccctcgggcttgcgaatccgacggcatcgacggcacggcccgacgcgacggctagcagcggctagcggcaaccggagtgtaggaaaagtggcagtaagtgggtgcgacggcgctagagcggaggaaggcacgagagcgatcagcggaaaaaggaaaaagggagaggaggaggaggggtccatttatataggggcgggaggtcaggaacggccgggagtggcgcggattcaccggcaaagtgggggaggtacgggaggagagagagaggtgggattcaaaaattgaatcctggccgtttccagcgcaggcgtgggccggagagggggtagtggggtgcggggagtgggtggcgtgcgcggggcgaggccattgtggtgcggtggaggctggacgtggccctagaacagcgggagcggcagttgtgggaggcggtggcggcctccggaggttgggggaggacccgacaggtgggccccacctgtcagcaaccccaggagacagaggaggggcgcgcgggctgttgggcctcggcctgaggccagcccagcgaatgggcgctggagggaaatgggccgaaggcccaagaagaagtaaaaaaggaggaaaatgaaaaagaaaaagggaaaaaggaatttccagggattctttaatgcttgtgctcgatttaaattgactagtcgccaacccgtgcgttgcacgggctcatattattgatagaataaatgataaaatttttaatcacacgctaaatagttggttacttacaaaattacagttgcttgatcattactaatttgatgttataaaatgaaattattaaaaatactaaatgagagtttgcgatttgtccaacttagtatttattaattttgaattttaaaattataacaatttatacaaactaaaaactaaacaatccatggtattttcagtttcatgttttatttaacacaaattcatgatacacatatggatgatcattacattccttaggtcatatacatacatatgcgttttaacttgcagttatattttgttgtgtcaagagcaaaactttcacaattcgaaattctctatatttataaattccaaaaagggattagaatgaactttatttcacaattttaaatactttatttagtatttcattacttaaattactttgtcaaagaagttcaatagcaaactattggtccaacagttaaagttttagacatattttttgcaagcatattaaaataatgttagaaaatactatattatttatacttaatatatatcttttaatccttatttagatgcattaattagctgctgttgtggaagtcggccttaattcaatgttttatttttgtgttgaaggataaaaaactaatgcaaacaataattattctagttgcatgtagaaaattcaagtatgttgaatccgtaaaagaaaaatatgaaaagattattgctatattccgatcgccctaaattagaggagagcagcagcagcagcatgggcaaaaatgcgagtatgttgttagtgtgaaaggaagagtagaagatatgatgagtatacttcagctgcatgaatattggcgtggcctaggccattcaaagtgcttgaaatttatgtacattttggagtgactgaaaaataggcagactcatatataaactattataaccgagtcaaaatcaaataaacacttggtgcactatcataagattcagtattgctaacttaatctccatgttttgaggtggctttgtatggctcgatctatctatgtgatcgatgttagcatttgccaataatcttttttaaacaaagtatgaagttaaaaaaaaaattgcacggactaaccttgttggattaagccttcaacatcttgatcctatacatgcaccatgtgtctgtcttagtccgtccatatgattcagccaggcaattagcttggctgatggatacggactgaaaaaaaaaaaagatagacatatatataacatcagggttaatcgataatcaatggccttaactgaaagcatgttgttaacaaattaagggtacatctctggcagggatagtcagccttgcgctgagcctctcatggtcaaatccatgattgtttttctatgcgctgaatcaatggggatacggagaaattactcacaatgaatcatgcatacatgcatttgcctgcaacaacagcctgcaaggacatggccgtgtggtcagcgtacatcgtcaccggcatatgaagcagcggcgccctaggctcgcaccgagatgccacagctttggcaggcgcggacattgcagcggcagaagccgaggcgactcggcgacatcgacgtcgagtggcgacttgatgtgagcatcggcgtaagctgcatcgatgctttccatagacgtgagcggcttgcctgaagaattaatcgtcttgccgcgctggctttgattccttttccatgtctctctattgacgcccaaggtgttgcatgcttcgttgattttcttctcttattgtgttgtgaattatagatagatctaatcatgtacttaacgctcaacagcaacagaaatattattgcctctcgcatatcctctcttatctgttccttcgtgaggtggtgttagattggtttaatttacacgtggcccacaaagttaaacacacatggaatttacaatctacagggatgataatatcatttatttaatcaatggccagatctttctgattaacgtgagagttcgtagaaagtgatttaatcaatggccagatctttctgattaacgtgagagttcgtagaaagtgcccaattagtataggtatagatggccagatctttctgattaacgtgagagttcgtagaaagtgatttaatcaatggccagatctttctgattaacgtgagagttcgtagaaagtgcccaattagtataggtatagatagatagatagatagatagattgtatccaatgcatacatagattaattaaatttaattgaacttactcaattcgaagcataatgtcacggatcttgcttatccaacaacttgtttgtgtttcttcgatttgtcctatgtaagatgctaagccaacaacatctgcaaaatgaaacggtgaaggttatgtatgtgttaattaatttggatgctagtaaataatgtaactaaacaacatattaccagataaatatgttttgctgtatactcttttggaaagactctcaatggttgaaaatctaaaggtttgttctagttttggtttgttttctagggttttgatctcctgaactttggcagtgttttgagaagttgagaattttgtcattgtgaactggacgatattctgctactgaagaaaccttgaaattagatatcatggacactgatccttcttgaatgccctgaacctattgacctgaaatttctttacagtagcatgcatcatggtgtcattcaataaataatataagtgagaaggcaaatgtaaatatcaacattatttgtgagaagaacagttatgctaacctcttcatcaatcagtatcatgtcaaggctaataagctcgttgctgttaggatttatggcaacccaaagtctaattacccattgttaacagctttccatgtttccttttcattgttaacagcttgaagcatatcacatgccattgtagttatccttcagttttgataaaaggaaaaataattttgaatcaggcaaccaatttatatgtcaatgggaccatgtagtaagtgagtctataatcagcaaaagttgatatgacgacaacggtttaagcaaatgaatataaaaaaatgaatattttcggttttgatgaaaaaaaaactctcaattaggctactatataatatctgtctatgggaccatctattaattaaactacttattaggaaaaaggtgatataaggatcataatccaaatatattttatctgcttcttctaccattaaacacaacctcaaaagtcagaagtgcgctttctttattaggcttttaacctagtagtttgttaatatagctcaacagcaatagtgatagtgtctttggtctattattgcgctattcagaaaattaccagtaaattttaacttctagtacaattagataactcgattcattgtcaaaatcacaatcggtaacatagcagtagaatatgttcgtcagaatagcaaacagtccattcaacaggcaaaagatcagcaaataattctttattaaaatcaaaatcacaaatcgagtcccagtttcgatgaaatacctttgtgtattacagatgcggcggagacggatgcaagtatgctcctttttgccaacgcaacgacaaatatgcgatagttgggaaaacggatgaactgtggaacaaacatactgatccctgaaatttataggattattaacgatggcgaaactgagtcttgtacggatcgtatcgttgcacatcagaaatcaaatttgattaacgaaaagaagcaccctatctggagttcaaatcggagtctagatcggtattgttaaatatgagaaactgatttagattagggaagagaagcaccagagttccagtcggagacggttcgctcgttgataaaagtcatcgccgcgagaaccgatgatctccaactcgcgctcgccgactatcccgcgaacggagagacggagagctggatgcggcgcgttgaagataaggtcgaccaatgcttctcctgcttcgttgaagataaggtctcagtcttatctgcctaaaatctagtaaatgtgcttgtatagttacgtagattttgatagaacccggcccacaaaacagtttttagacgcagctattaatccaagcccacatataactaaaactaataaaggcagatcacgtgaaaaatctacggtttagattaaatcacttatttaaccaacggtcaaaattctctgattaacgtgggagctcgtagaaagtgtccaattagtataggtatagattagaattatctccaaggttttgaaaattccattaaaaatcatgttagcctattttgacatgtagaactcaagaaatattccacatgccattttttattattatttgcatttattactttagagtttcactcttgccattaaacaattgattttcttgcaacaatttattaaattattttaggcttaggagaacaacttcagggtgtgacaacatcctaaccttattgcaatcagttatcattattcctaaaataaactaatatatgcaataacagtttaaataataatcgttagcgtctaaatttattaactacaatcttgatagatctaacctaactcagacaatatacactggtagagaagtagtttgtagtcccagtttgcaaccccaattagtcctgggttgcataccaggactacgaatccgggactaaacatcactatcttaagtcccagtagaaataatcgggaccaaaaaagcatcaacaccaactgggacaaagatagtagtgccatgtgaatggaaacgccaccgcactccccgcgcgacggccgcgccggcctccgtcgcctgccaccgccaggcgccgacctccgtgacgtagaggaaaagcagaaggggatgagggaatcggaggaggaggagaaggagatctcaagaaggagtggaggaggagaggggataaggaggagcggcgtgtgcacgggtggcgctcgtgtagataaaggaagagggagagagagcaagagatgcccaagatgtgggagagagatatttagtcccggttggtatcacccaaccgggagtaaagttcgttgaccgtgtgacatggtctgacggttattgaaccaatactaaaaatgatctttcatcccggttcccgattgttgttaccaaccaggataaaagatcaaaaagtacccctgggcttttgaatcgggagtaaagatattttttagtcctggttcctattctaactagggctaatgtggttttttgagtaaccaagcaaaaatggtttctccatgcagcaacagggccatgcaaaaaaaaaggtcagctcgatctttagtcccggttggtaacaccaaccgggaattctacatatgtattgaaacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttctacgtagtagtagtcgctgctagctcagaagctaaggaccggtgaattgtttttccgtcgtagtagaattcacccttgggatcaaggatttcttcgttgatgaatcccatgagttgttcttgaaccgccacgataaattccttgtgtatggtcaggttatccctcatgcgaataaactatatgaatgtatgaaattgattagtaattaaacaagaaatcgctacgtaatgaaattttgaatttatttgtacgtacatcgagctctcttgtggtgatgatttgttctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcaggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggtaggcggtggagctgggggggcccttgactttgaaggtgccggaagaggagcttgcgggggagtaggtgtaggagcatgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacaccgcttgtcgcccagggaggatgatgtaccgcctgcgccatagaataatggcatggcatgtgtctcgtagatgcgtctcaccgtcttctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattattttttagtaatcaacatatataagcagcaactagcggaatggctaaatcttacctttattgataagttcttcaaaggaatatgcagctcacatggtgtccgctgagtgatgtcatcaacgggacaggtcgattcatcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcatagctcgatacccggaactctagctctgcaatcttcgcctcggtatctctcttgctcctcatccgactcctgtacgtgtggatgtcctccttgaaaccaatcttccaaggaatcacccctttcccccgtgttcatcctggatgctctggagtctgcagggcgagtgtcagctcgtctctatctctgtctggtcggaacgtgccctgagaggaggcttccactgcatctgttagtcgtcgtgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatatatcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgatgtacatagttcttggcggcttcggccggggcactaggacgtccatcttcttccacttccgttatgatgtgccgaccctcaagctttttcgctgcacctcgttgcccacgtgccctcttctgtccaacggagggttgactaccactagcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaacatctgttcctcatcgcggtcagccatctgttgatacaagaaacatctgctaagtcacgagacatttatgttttaacaatctaagtcatgtatgctaagtgtaaatgtcgtacattagaaccatacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttgtattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaacttaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattatgtcacttgcctactccaattccttctagggctagctcttccactcaggcttgacggacgactccgacaacacgtcttttctgcaagatacaaaaagatgtattaggataaatgcgaagtaacatatatatatatatatatatatatata

SEQ ID NO: 10702 - DNA, 3204 bp, Oryza sativa
tttttgtctgtaataaattaagtggataaatcgcaataagcaaatatatgacttataattaataaaaattccaatatatatatatacttagcatatatatgaatgatattattatattggtaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttgatacttttaaaaattctctagtcaattataattagcatatgaatgatagtaaattaaatgttaaaaactataattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacactataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagagggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaacgagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatacgtcattatattgaaaaatgaaggtggaaatatcaactcaaaactgacgagacattgcaccacttcattctgaagggcttctaatctatccgaatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagctaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttctgtaccgggtggtttgctgcaaggaatcgacgatgacccatgtatacaaccttcctacattgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcgacatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctctccaaattctttaaattttctgtcaatgtttccccactgcgaaccatcggcggggtgtctcagcatcccgtcctgttgatgctcttcagcgtgccatcgca

SEQ ID NO: 10703 - DNA, 8426 bp, Oryza sativa
caaacagggcatgcttctaggttctcatactcctcaccgcgatataggatacaatcgttcggacatgcgtgaatcttatgaacttccagtcctaacgggcagactatcttcttagcctcgtacgtagtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttactctccgtgggatgtccaacaattatagcttggcatgaaccccgactcaaacaagtggaaatgaatagtcttggatgcagaatactccttctaattcttacacttattgcatggacaacaaataaaacccctttgcctgttagcttcggccactctcaaaaaatagtgcacgccgtcaataaactctttggaccgccggtcagcgtacatccattgccgatccatctacctgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttattccccacacacattttctctctcatcaacttacaactaaattttggagacaaaaaaagtgtgcaaaacataggtgcaaatgtagtatgacaaaaaaaacattggaggataaagttgcaaaccttttaggcacctccgatttgtatgtaatcaccaaaataaattcaatagaaattttggcatgacctcccctcttttttgaagaaattttgaaacttgctcgggcagctgaaggaggaagaagacatatatataggggtgggactttagtcccggttggtagcaccaactggggctaaagatcaccgggatctttagccccggttggtattaccaaccgggactaaagttacgatctttaccaaccgggactaaagatcccgggggggcctgatatgacctgacagcattcgaaccgggactaaagatgaggttggtaacacaaaccgggactaaagatcaaatatgcccgttacccttttgaaccgggactaaagatcatctttagccccagtttttattgcatccgggactattgtggaaatcggccgaccgacgaaagaaggtttctccaccagtgtgtattaagttttgcgtttatgtccagtcttggtattaacttgtgattcttcgttttgcagtaattttgttcaagtttaatccatccaaaatttttataatacttcatccatcggatttggaaggattcgtgtattttttttttcttgatacattataatttggcttaagtttgacatttagttcacatttattgaaattctgagatagctggcttttgagggtgttttccttaaaccatttattagtttgcaaaccctttggtggagttgtttctgggttagtgtttgacaaaaatttatattaaaatttatcgaataaatatttcaaataacaaacatcaatgtgtattaataaaaaaaatattttggcacatgcagcgagattgtatgatatatgggcccaaaattatcaaataataaacgtgtccgaatatacccaataattggactcgttcttttcgaatagaaaatgttggtgaaaacagattttaaatttgatgcgtagtttaaacagttttcaggcgttcaaataagagagtttgactagtattagttgctcggttggaaccgatcacgtgtattacgctgattatctccagcgagaagaaattaaaaaaatcaaatgcagggcccactgtcattagcagtaatacgtgactttctttagcaatcgggtggatatgctcctccttgcgtgttatgcagataatcaacggatttcgctggcttgtgctagaatctcggaagggattaggccagggcgccatcgcctcgcctctgcctgtttaaaaggtgcagtagacggagagacggagacttgagaaaatacacagcgacgagaaaaacagagagactcgctcctgagaaatcacagccaatccatgcgcgcgcgcagtggagatcaatgttcaaacatcccttgtcatcaagctgatgtcgcaggcggagatgatcatgtgctagagtaaattccctatatgcaccttaaaactgactcaatcccttccatgtcctccaattttgtgtgcccttgagatttcgctgtgatccctcccatgtctctaccgttatttctcacagcattgactggttaatttacctggagatgtccattatacccttaagagtcacaatatgactaagcattttaaccaaggttgtcattacgctaattttctcatgatataggggaaaggtacacactaagtacatgtcaccacgggaggaacgacagcgacagccacgaaagaagagcggcggcgctgtgcgccgcccgcgtcgaggggagacgagagattggagattatttggggatttcccgctgttgctggcttgctggttgctacctagggtttcgctaggcattttggtctttttaaaaattactgacaatgtaatggatgtatacactgatagatctaacagatacctaatggtagggacatgggagagaacacaataaaatctcgagggtacacaggggattggttaaactggagggcatggaagggattgagtcagttttgatgtgcatacagggaatttatcaacgtgtgaggtggtgaataaattccttcaaagattttggtaaatttgtcattttactggatgatcaaagtacctcttttcttcatcaacttgagcgatctagaaatcagatcattccttccttcttgaattgcaaacttaggtatgtctaatcgggggatcggactatcctcgtgtttttatggtgcacatgtcgggagcgagtccactggcagatatgtgtatatatcgggattaaaaagaaaacgaaaaacctggttcccaaatcatcacacgtacctgcaatttggagactgaagagactgacacgcgccattgcatgttcaacttgactactcgtttttcacctcccccgcaactcctcttttttcgccgcgccctgctgcccgctgcccgcaacagaagagcgaagcaagtccacgaggcacctcgactccgcgagcgccgcccgcgcctgctttcgcccacgcccaccgttggtcgccgccgccgcttgagataagacgatgagttcgttgtccgccatgcgcccgcgtcgcgtgcccacttctctgactctccctccgtctcagcgtcctcggcggccggcgagccggcgaccgcgcccattactcctctcgtcgatcgtcatcatcaacaaatgagtcatgctgtcacgagcgtcgagcgatagcgtctcagcctcaacggccgagcgacgaccgccatcgacactcgaccgtcgagtcgtcgaccctgcttctgaccatcgaatcaacgatcggtgactcggcgcgttggatggcatggcattgtgtatcggaatcggaggccgctggacgacttctgttttagttcttctacttgtgtagccttttcaattttcagttttaaattttaattcttatgcgttgtgagattaaattgtactactatattgtagattgctaactgtggagacatgaagaaagatggagatattgcatccattttaaaaaaatacacaacaaagaagaatacttttaaattgtcttcttcctcgattgtggtaaaggaaacacactgaagagcaagacgtcaaggtatatgtttgatctattatattatctatacttgtatggtatttattaacattgttacatttacgatgtttagaaaagatttttaagtaggaccacatatcctaaattctagaggagcgagtcccaaattcctgaagagaaacatcctccgtacaaaataagcaagatgcaaggagaagtggagattaaaaatacataattgactctatgtccgagaccgatgagaccagacgatgcattggctaaagctgacaaagctatggccaccacatttttctattatcgacaaaattatgaccgagcgctagcaatgctaggttgctatattatttatacgtccaaacaaacaggaacagatgcaccgttgctaggcaccaacgaggcaaaagtcatcccctcattccgacacctgtttcatacaccgatgtaataataacgtatcgatcatgaccgggtttggcaaaacaaagccacttgttctgccatacaccattaaatccgcaccaacctcaaccttcggcgagcaaataatttggaagaccatgatcacaagtgcaacttaatcagaggtgttccgtaggcactgggacttagcggactgaacgtaatatccagtcagtgtacctttctattaagtatcctcgtgaaggcaacatgagaactcgtgcaggagccctcctatttttttatacattcatattaatcaatcgtgattaataaaatatacagggtttctctatttccgtgtgttcgttattttgttttaatcaaacaatttgtattgtatattttgtcaaattttgggatcgatccaacgattggtatcgaaaaaacacatatttttaaagaagtattgacttgtttttagaccgatggtcagaccatccaggtctcagtcaaaccgaccctagaaggttggataggctgctcgacgtgtgttctattggcttttgagattgggtgtgttttaatctatcaaagtttgattattatacttatgctcacataatctaccatgcatctcgttttgtaggcttagttaattgtattcgaacctacacaaatactatgtttaaccatttcaattcatggatttcccgtggaagtgatgaaatgaaagtaattcccattctgatcgcatggagaggctaagaaattgtattgtcgatgcatgtataaatccgtgaagtattaaatgtttgtagtaagtgtaattgttggatccaatacttgttggcactaggatatgatgcacggtaaatggagtcatgtactcacgacttcactagcacaaattttgtgctagccccctatacaattctactgttcatactatatactccccccatcctaaaatataaacatttttagcatagtaacaagtcaaatatttttaactttgattattaatagaaaaaaaatcaatcatataaaattgatgttactagatttattattaaacaaattatcatcatatgtaactctttttttaaaacatttttcttttatagatattattggttaaagtagcatatcggaaaccatgtcagagtctaaaaacgattatattttgaaacggagggagtatttatcagtgtatagcatgtgtacacataaccattggataaatgaaatggagctgtggtgcatgcacacctggcgagatacatcgaatggactctagccaatcgacaaaacacactaatgttcaatcgcgtaggaaaactagaacagtagaattccatatgaaaattcattattgtttcatatcaagacagatatagtggaattatatcttctatgcaaatcaaatacagatcttatcaggaaaggaattggaatcataataattgggtgaaaatagagtgtacgttgtgttagaaaagtagaaagttccacacctttgtaaccaacaacataaccaggggcatcggccattgaattctccatcccgaagaatggtaacctccttgaacagtctatattgcccctgtcttttcgtccttaattttaatgctagaggaacctagaaacgaagaaacaagtcaattacacataaattaaattagttaacaagtcattagatattattttctctatcccataatataatatttgtgcgcaatttaagatttaatttttaaaaaacatttaactaacaattaatataacatgaattgaattttatttgctgaaaataatatcattcgattaacatttgaatttaggttatatttctgttggtataatacaatatgagaaaatataagctaaaaattaattttagagaccgtaccgagtttgatcatacctcatattatataagctaaaatatagataaatgacacactagtaaagattaggaaagaaatacgagcctacgtaaatgacggcaaatgtattatccccctcccgctcaactttccagccgtgcatgccttcactcttttgtatggatggagtgcgaacagcggagagtagttgacggacagcggcggcagcggttccagtgactacagctttggtggtggcattggtgattgcgatgtgctgatggataatcacattttgtgaaaggacatgtcatgttttgtgtgacgaacaagtgatttaattatgagaaaatcactgaagattaaatcaatttcttagagataaggaacaatctataggaaaattataaaatattaaatttccaaaacctaggaaattaaagcaaaatataagatgtgaatggttcaaatataaaacctagttaggaacttccgatgttcaaattggaagttcagattgtattagcactatcaaacggtgagctctttatgatcccaaaagtcagaagtttccacaagttccaatcagaacttccggtttttcttaatgttattaattaaatgctgtatttctgcacaaatttcttcttccgacccatcaaggaattagaactaggtggaagtgcacctgcaatttttttttatcagagacaagttctgattttgccctgcgatttcttcaaattgctacacaggccaactgctacctgtgtcatcactgagctccagttcgcaccaatatacccaagagatttctcatctgaatatgattattggagcgttgttggtcgtgcctaaaatttgggagagggttttggtacctgttagagagctttgtttttgatttataccaaagagtaaatctcacttaaccaagaatattattatgaactaagttgtagaaaatcacacgatttttgtcatgtagcacgtaactttagatattctggccataaagtttcacaaaaccacggtattgatcattttgactttgaccaaccacacttttaagttctacaatcacatcttaattaactttatgagtgttttatccattatataaatgttatatgcacgtaagtaaagcttttttaaatatgaatataggagtatacaaaattgggttctctaaaattttagaactataatttataatttttgaagttatatgtcatgtactaagatcttatggttttgtgcaacttggaccatatattataggaggggttttatgaaatttaacttttgggaacatgtttataggactcttggagatgtagtagcttttcttttcctagtcttattgcattctgcgaaccttatgtacgaaacaaaaatgtaacaggctgtgtgtagtcgaccatcctttaatctaaaatcacacttctttttagcaattttggaaaagaatttgatatatgtcgcacagaaattaacctttcaaagcataattcggatggatgatcatgcaccgtactgtacatgcattgagttaattgatctccatgaaacagtatattatatatatgtattgcattctgtcgatctttggataaagtggtggtggttgttatcaatcgatcggtttattagattttactatatgcccctttaaatatgttatagtgcgtagtccggccaaccaaccgtgagccacccaggtcacattgggcctactccaccacaggcccaaccggagccacaactttaagttctagggctaaaccacccaaaagactagtctgatgggtgaggaccgtccccaccttataagtcgtgctcccccatcattaaattaccgatgtgggattaaacccaacaatctcccccgtcacacattgggcccgacaatcttccccgacacatcaacccatgcgacctcaa

SEQ ID NO: 10704 - DNA, 23308 bp, Oryza sativa
ctctccaagggggcaaaacccaccccccacctcggtcaaaggtcccctacctcggtcaaaccagcctggtgctttccccgccacctccactcttatcagctctcgtctcagaacaacgtagtaacgtgatgttcatcgtgcagtaacaccatgtcttacttgaagtaacgatactccaacccacctcccctctctccaagggggcaaaacccaccccccacctcggtcaaaggtcccctacctcggtcaaaccagcctggtgctttccccgccacctccactcttctcagctctcgtctcagaacaacgtagtaacgtgatgttcatcgtgcagtaacaccatgtcttacttgaagtaacgatactgaaatatcatcataatatagtcatgacggatctacttttgataaacatttttttttctaacatcatggtgcaaacgggttttaaaaatagtgcatgatgtgagagatattacccttcaaagattggttttttaaaatttaactctccacaagcagtaatactataacataattattactattgtctactatgtgttactgcaaccacatcatatcgttactacaagatgtagtaacgagtataagttgcacaataacatagtgtgttactgtaattacttgataacgttactgcaaggatatatatagtaagaaaaaaagtgcagtaatgtagagaggggaattggctcgctttactcgtggggcaagggtagagcgaaccttcaaatattggtcttttgaaatttaactctccacaagtaataatactatatcataagtgttactacttcctgttgtacgttattataatcccatcatgatgttactgtgaaagtgtggtaaatactataagttttgcagtaacaaaacttattactgcaattcttgaatagtgttactacacaaactttgtggtaacgtgtacctgccatgtagtaacacttacacttttgtgcagtaacaagtatatggttagcatgtatacttttaacccatacatttttgtttcgattccttgtttactacaatttcaccatgatgttattaccaaaactacagtaacgtcctatatgtttggtagtaacatatactttcacagtaaatgaaaatttgaatagagggtgcgtcgggagggtgaggggagagaggtaaaccatcaagtaaatctctatggaatcgttaagcagatgtaacattaatcttgtgaaaattgtgtagtaacaatagttcttacatgacgtaacaacatatgtgttttgcagtaaccaagcatgttactgtaattatttcgtgatgactttactacgaaaatgtaacatgattgatttgcatctttgatggtgctagaatgaatctaccataggttattcttggtcaaacccctatgcggacacaacgctcacctagttaaaattgtgtagccacactagtgctagagagtaataacggcttatgtgttttgcagtaactaagcgtgttactacaattctatagtgatgacactaccaggtgctagaactaaactatcatatttctgtcctgaataatataaactattggtgatatcagcagcacgatttaatagttaatgctaatgaagcttgaaaacaaataagcgttaactttttaatagaaatctctactggatcaagtggttagagttgcatactatgaaataggaggtcctgagttcgaaccataacttctctgtttctattttatttttccactaggagagggaggaccgaccgctttttctggaggagggctgaccgccagtttttttatttttccactagaagagggaggaccgacctctccactaggagagggaggaccgaccgctttttctggaggagggctgaccgccagtttttttatttttccactagaagagggaggaccgaccactttttctggaggagggctgaccgccggtattttttggaagatgaggccggcgattttctttggagggagggaggaccgaccgctttttctggaggagggctgaccgccggttttttttggaagatgaggccggcgattttctttggagggagggatcgcgactcgcgagatggctggtcgtggggacgacaagctagcttgagctgaagtcatgtcgcccatgccttatttcaacgccggcaacaccaaacccgttgcgctgcccactgttgtgtgcttctgttgttgtttttgctactatcagccaaggacataggaaggctaggcaaggagtaggatgaaaggaaatatcgagcagagaaggacaagacgaagaacaaattttgagatttctttcggttctccagttcgatcacgaatcaatgggtaaacctccggggagagggctatgcgttggacgtccgatgctctagggaaaaatcggacgctacttttaaactgatttatgtgcaaaactacttttaaactgatttttctcttaaattacttatccaaatcatgatccgattacaccattaaattcgttgcaattaaatcttcaaaacaagaccacatatggatatattccgatgaaaaaaaaatttagcttattattgaattatttttaaatgttgcacgatgttccatcaggtatatcggaattgtttcactaagtagatcaaaaatgtttccctcgtttaaatctggtgttgtttcaccttatgtaaaaacaatgtttcagcaaatagcggaataatgtttcagttcactacaatattagatctatacatagtgaaacattataagtacactaggtggaacatttttcggtgaaacaaaaaatgaaacgaatttctttaattggaggtttccaaaatatgtgggtttttttgttgcaatgaaatatttcagttcactgcaacattagatctatccataatggaacattgtgagtgcactaggtgaaacattttttgtgaaacaaaaaataaaccaaattcccataataaagggtttccaaactatgtgggtgatttattgcaacggcacgttccactgcaacatttgatccgtacacagtgaaacatcatgagtacactagctgaaacattgtaaaactactagttgaaacatcaaaagagaccacatgcaacattaaaaaaatcaataaaaaaaataaaatacttttttgtcgaaatataatcatgtgtggttttgttgtaaagatttaattgtaatgaatttagtggtgtaatcagattgtagattagataaatagtttacgataaaaaatcttttgaagaaataagcaaagaaaagattctttgcatgctgcagtggcagacggcgtccgatttttctccacccgtcggtcgtccaggtgcgagcattttcgtaaacctcctgctgctagatgcataaatttgaaataggaatggctattggttgctaaatagttaatcaaattcatttttccatataaagtactgttttgaaatatggtatttattcacagagaattatgatttgtattctaaaaagaagttagtcctttttttttacgggagttagtccttttattgatgatatatttctagcgaaaactggcttctttctattcggtaagtgttttaaaagttataattgaaactcacaggatccaaaacctggtagcaattcttgttgttaactctttacacgattgatataaaatagagttaacaaaatgaattgcctctattttatattggatatcctcttagcacatttacaacagaggagtggcctctgggagagacactataaaaaccgatttttctgaacataactttttttaaagaggacataaaaacaggcccgtctgactgctgccacagtgccagttagaccgaccctgattccgagtctgatttagtggttcacgggttttcttacttgggcttgatattatatatctaatttgacgtgaaaaggaccctgtggagcaagtccaatcctcctataaatatatgggctaaagccgattgaaacaacaaccaatcaatcgtcaaaatcaatttattacccaaaccctatatattcttcatttgggctaaagccgattgaaacaacaaccaatcaatcgtcaaaatcaatttattacccaaaccatatatattcttcatctccctccttgctacctataccaaagtctattctcctaaacccccaattattcatcgtctcttgtctctatggtgttataggacgtcctggctagcctgctgagcctaggacaaaacggtgcacatgcaccctgacagggtccctcccaagtgtttgttcagcggcatctacccaatctctacgtaggcacatctcagggtgttgctgcaggttgcatataacgtgctcaaggtgtcgcagcgtaattctacatcaaaagcagccagtataaatccctatgcaaaaatccattttcacaaacagacctattaagagacactccttaaaaaataggtctattttcgctgatggtccaattaagaggcccgcctgcaagttttcacacccagccggttcatacttcctttatgatttactcccccgtccatcacctctcctcccgcatctcctctccgtactccccccttcctctccctaccacgtttggctcctctcagctctactgatgatgggagcgtgcaagcaagcaccaacgggtggtggcaccgtccttaggagcggcaggaaggggtgacgatgactagggcgatagtgatggaggtggcggcctcaaggcagcggattaggtggcaccgcccttggccccgggagaggcggatccatcatcaccgggcagccccgctacgggatccgcctctgccgacaacacgatgggcgacaacaacaactgcgtggctacggtgactacgacaatagtaaaggcttcaaggggagaggatccactcgtcccagtctcaggagcgatgctggtgaaggaaaggcaagggatggcagtggaggtgcaggatccaccgccccgccctgcgatgggtggatctatagagggtggtaaaggagtgctgaggagaggcggcaacggcttctggggcagcgacgatgacattggactgtgccggcgacgacgacagtacgaatgggagctcaggtttctggatttttttttatttttttgtagatggacggcattatgcaaaaaatctgttttcgcacacggttcagccacctgtttgggaaaataccaattttcatagacacctcagggcaggtgggcctcatagttgtttacaaatttatgttttgaccgtttgtaaatatggtttctgtaggagagaacatgactcgtagaaccgtagatgagactattgcacaagtcacttcctctataaaattttgcattccaacccttaactatttcacccttttagtccctttatttactaaaaatgttcaaattttacactacaaaccttatggcactaagtactatcatacatgtaccatttccttacccttgtcccactggccattctcgaaagcatcacattttccttaccctcatctatctccctcacacaattactccactcaccgcacattggacactgatcccaaatctgcctacacactaacaccatcgccatccccatttcctccaaagcaccagcatcgttgttgtcccttattggtgatatgccctagaggcaatcacagagatgattgtgaaacatactttgtctagaattataatgaagtgttccttgagatagataacttactattgatcaatgagtatgtgacttatttgtgatactcttcatctaatatgctactatttctaaatcatccttgattgtatatcaaacatggtatcatgattctcaacaagcatattggctaactttaggttgttaaatgctactgcacgtaactagatggctataaaggaagtctctaggtctgttatgatatatgtagtgtgtgtacacgaacctatagggtcacacacttaatgtattgaaatgacttgattggatagagatccaatagtggctccatatggatagggatctaggtaagcgtcctaatggtccttggaggtccaattagaagttctatgcattcaagggcaacagttgagggggtaaatgagacatgcaagtacatgaaccatcatgataaaccctagccgcccttgcactcatgagccaaacactagctgcaggtagacgtgtttgcacacaacgttccacgcctagatgtgtggatagcagtagtcactcctatggagtgtgaggtgcgaggagaaaatgttaatgcgaggaggatatgatcaagttgttgggattgactacatcaaatatgttgtccgacagtttgttgaaccggtttgctgtgctccaaatcttgttccgctgctcggcatctcgtggttcctggtttatatggtaagaaattttcttttaaactatcatagcctacccataaccctgcatacccatctactctcacgtcaggaccgtcgttgtcctcctctactcccaaatcaccactgccattgcctccaactacttcgattcactgtgaatgctgccatcctcgtttacttcaaagctttgagtcatcactctttaccaatcaccaccaccttcccacactaaccgtgccctcccatgattgaaggtcttgtggtaacatggatgacggatcgtgagcagcactccatggagtttgtgcatcgggctgatgagctctgtggtgccgagggctgctcggctgaaggacgatgttgatggcacagatcaggcgataagcttggcagtggtgtgtcacgcttgacggctgtggcacagatctggcaaagagatcggccgataagccttatatcaatgcagatccaacaactggcccaacaatggtgcagatatggtgtcaacgtgagcagcagggtggctgtggtactgatccaacaatgagataaacacctggagatgcttgcccccactgagctctccccgtgccgtttcctctgtggtgtttagcatcgttttattctccaaaggaatgtgcctcagtgagtgtaccctgacactactgcgagccactgcttccacctcccctctcctccatgacagcatgcctcctacatggacttgtgaggccactcgccaacatagtgcaatgtaaattaatatatataatttgagtggtttaaaagttatgacaagaacaataagtgaacatatatagttttgctagtttctcagaactcaggtttttgggctttcaaaatttatattgaccattttagatgtaatatttttcacgagcctgacaagaagtagatttgttctttaagtttgaagggttctggtacagctgataagactttgggatattaccatctttaagttaattgtgacatgaacttgttttatgtgtgatcattcagcagttttactctattcaattcacaatatctattttatgtttttaaccgacctaactattttataatccatatgtgtatcattattattgtttattattgttgcatgctattaatcctcttatatgtccatcttttcaagttcatgatgttattctccttaaataaattaagtgccacttatagtcatggaagtgtatcttcggttctttatttatgttcatgttgctaggcactgggaatgtttacttgacttcaacggtaaatgctaaaatacaaatcaagattgtccacaatagaaactactatttcagtttatgtttgattcatatagaaaatattttcttctaattcatgtttgtctaggatggaaactactatatcattaacttccgtctttttccactgaaggaaaaatgtttcacataaaggaaattcaattgtctgttgttataaaggaaataagaatctttttatttgtcagttgtttatttgtaggtcattgtgcgtatgtttcaaaatactgaattatacttgctattttttttttgattttgcaagttattgaatacttctacatataattttgtaaagttttaggaattgaaaatgtttgtcatatttaggtctggaatttgttgtttgaacttttatccatatgaaagagactatattttgactaattaagagtggagttattagaactataggattgccacccaaggaatctaaacaatcccttttaataaactctagacatacattggttttctctttgttatttggtggctaccagaggcaggaaagcccgaattcagcgagcccatgctcatgtatcagcgcgaggaggttgccctttctttctgggcaccacttttttttctctacatgctttcctaatttggaatgtttgtacagctaaagtttatacaatcaaagtttatagaccaagtttatacaatcaaagttcatacacccaaagtttatacacataaagtttatagaccaaattttaaatgtctgacaattggattcaaatatttcatacagaattttgctgcattgaatgtttatacacatagattttatgtgtataaagtttatacacatgaatatgtctgagcagatttttcttcttttgttagtatttttttcctttctaaaaatatattaaattctttcttgaaaaccatatgataagagggggggggggggggggcaaagccgtgcgttgggatgggggagcacgtctgtgcacggttgatcacatgttagatccccattaaagcatgcgtccaagaaaatatgggcaaccgttgttgcgagtgggtatgcagcctagtatttgcacttatatgcctggtagcacctactagctcatgggttcaactccggtgtgaattttcagagttggtttaaaaaaaggtcattcgctgatcccttgaactgacctacatataattacttgccgccgtcgcaagcagcaatccaagggcacaccgggtgcaccagcaagtttccttttagtttgtcatatccctagttggtaatttcctgttaattaggttataatttgatgtactattggccaataaataaggaataagaagaaactatctccttccttggacgggtgttcacagcatgatgatcccttgtcatcatgctggtgcctcagcatcctagggcactagggactaagcctcctattggacgctcgtacaacatttgcaacctcattcaccacctaaattctatccataatatattggtattagagcactctttcgccgccaccatctcgatgttgacaattgaaggcatagtacccctcttcgccgagatggatgaagtcttgagttagttgtccaccataatctacatactggacagccatgatctccactttcacaaaagatggatgaagtctgggggcatctatccaccattaaccgaatactagagagccacgatctccaccttccacacatcaagaagcatggctctggtagcggcacaggagaggagtcttttgttccaaaccaagatcagagcaccagtggcagtggtgttctgcggaacaacgagttagagttcctggacttcgatatgtgagcagttcctccacgggtgcaaggtcatggaggaggacatgctatggctgggttcttaccatacgattggcaatgctcaatgttagaacatacacttcgacaaagaggagggcgaaccatgctggccacacttctcagaaggggtgcgccacattttcacttcggactaacagccacagatcttcatcattggtcttggtgatcccctaagttatgagtattgacatccatcttcaaaaactagacaatctgggggagacaaccaccaactgcacacgtcatgactaagggcacgttagcgacttcatcagcatcatgatcgttgaccaaactaacgttgtcggctgtcagtgcaatagcggtggacagccaagctgtgaccggggaatcagcagcatggtggcagcgaccactgtcgtgactgacatctacgactgcacaagcgggttcgtctattttggtatattttcaccatttgtaaccccctcccacctccctccgaactaaatccacatttttagctatagttcgtctattttcaccatatgtacactctcctccttcaaaacccaggcacctacataagcctaaactcagtccaaagcagagtaaagaagcaagtggtgaccccccccccaaccaaattttggtgtagcttcgcatgggaaaagcatgttgctcgagattcgaatgccacactacaatccttggtggattttggttaggcgcattgcttcctgttcacggaggccaaggctcgtctcttcctgtgcacggattttggttaggagcatgtccatcaacgtttcaaaccaagaaggttggcatgagtgtccaagtccaaatgaacaaccaggggaggataagacatacatgatattttagtgttaggcttgacggggcccaccatataccaagtattatacggagtcaagcctgatatacggaaggtattccgaataaggaaagagaagcaaagtcctacatggacactataaggactagtcggattgcatccaaacttgtcttcctagttctacttggacaaggggcacccagggatataaatacaagacctcctaaaaggagaggcggcacatctagacagatcaataggagtatggctattacctgtctgttaaggtgcctgaacctatataaaattccttgtctcccatctcttttacctcaatctcgcgtatacactagcatcaacgatctgcatactctacaaaatatcgtaggcgggtatagtccattaacaacgtccatgttacttcagcccttatgaagtctcgggcatttcatcaacaaggtggcctaccacctttatctgttagctgacatcgcagtgtgctgaagtgcttccattgttagaattacttgccaccattgcaagctgcgatccaagatgcaccagccaccaacggcatagccgtcacatccaggatcaagcttaagttcattttaatttggtgtccctaattggtatttttttactattaagagtaactccacccctaaaaaggaatggattgtggaggataatcaaagggataaacaaaggtttttctctttccattcccttctcactctggcctggtgcctcagcttcctagggtggtagggccttggccactagtttggcaattgtacaaccttcacaacctcgttcacctcctaaattgtagccgtaacactatcattgccatggctagcacaaccaagatgcaggggtatagctagttcagcatccaatgcatactccttactccttgccaatgtctttattcgttgcctccatctacaagcctccatgcatccttcctagtgggctgaggccctcgctaccacactttattgataaaatttgaacgagttgaaacttacagttgtgctctgtccagctaatggcttgcttttccatgtcatagacgaccaccttatttgagatgatcatgtctgaaaaaaaacagaacaatggctctagcacaaaaaaaaatatgaaaaaggaattttcttttggacagtgatatatgcaaacctcccaaaaggatcttatccttgtgtccctgttttccagcatcttggaatccaaagcaatactggttaccctgctccaaacaagtctaagtgtgatgaacatatatctctagacttgcactataaaatattaagcaaaagcatgtataccaaacagagtagcatgcatgactgaaataactaactgtcagttgattgagaattgcagaagtcagaactcttgtcctctacacattttcatggagattatcaattggttatgtggtgcatctagttacttggaccaaaatgggactcttcacgtatgaaacaagaactaaaatttgacagctgaaggtgaaactctaaaccgtacagttacttttggagatatcatcgtctatttaatgtatatagattatttattatctctcttgtaactaattaaacaattctctacattatactgccaatggcgatgagcctaagttactctgtcagtacaattaagaaaaaaatatgacacgaagtgcatatatattcaatttagcgaatgtttgttaatgggtacccattatatgactagcacatatatctatgtagcacaagatgtggcccgcaatatgtatgggatataatccatggttggactctgaactattttagcatcatataattgtttcatgtttcatttttgtgatgtgttgataaattcatcccaaattaaagagtcacattctaaaatgaataatagaaataattaaaagcttaaaagaaatatcatacactaaaacatgttcaagaaaagtttgaatgtggcttagagtacctttcttaaatcctccatgctctaaaatgtcacctcagtttttccttgattttttcagagcatcctaaactattttaatgcaacaaaaaaatttcagaggttatgaaaataaaaaacctaaaaacaagcatgtcctctctttgggccaattctatccatctgcttcctgtcctcctccctcggctcatgagcaaagtcccctccttctcctgggcctcccttgctcggcctaggtgggcacggcccagctagcccaggaagtcgttgcatcatcgtcttccgcctccaatctgctagttcagtttccctctcctagctagcactagcaccaccaccgaggttgatctgccttgccagacgtctctcctccaaattgatttcaaaaatcatttccctacttgcatctgtccaattctgccatattttccccactattaatttggctttatatcgcggatttgaaacctcccaattcatagccgccgttaatggcctatggctcctcccacgaccattcccctccttcctctcccagcctataaaatggcgtcgtcttcctcccttccatccattttcgcagccacctcgagctctcttgctctcctggcatctcgactgcgccggcgagctccggcgccctttccagtagaccgacccaagccacgtacggaagaccacagcgctgccacccctggccgcggattaacctcctataacccagcaaccccaccattttgcctggagatcgccggaagttcctccttgctagtgatcagagaagaacgccgtcttcttcctcctttggcagtccctcccgccttgccagagcaccgccccgctgcattaacttgtctcccttcgatgtcagccttcgattcccttgtcatcctcttcctcaaccgtgcgttcttgtcaagtgaagaccatcggaacgcacccgcgccatcgacccgaatgacatcaccactatcttcctctagccactgtcccctcctcgtccaagtgcttcccgtcgtcaccctcaccaccatctccctcaagtccgcagcgccaatccctccgttgtcccctcgtcgttgaccagttgctgtcgtggctgctcaagctcgccattgtcttcctcgccaacaattccctcctcgctatttcggttgtcgacatgtttgtggcgagaatctggtttccgctctttccctcctattttccttgccttaggtgactaccggtcatgtgccgcagtcgctggttatcgtctccatccacatgtagctgcgttttcacgcacgtgactgcttgtttggtgtcatgtgggatccagtcttcagtcttttctctgaggcttacacgtaggtgcacttttcccgtggatcgtctcggtgaacctgatccacgatgaactagccgtctgacccgtgggtcctggttgtcagtcactcaattctttctctcctcgagcgatgttgtgttacacataatttatgggaacaataataattaaacaattcggaaatcttaatttaaactacagttaaattttggatggccgtatcttggccatatgagctccaacttgaccagtttaacttttgttataacttaaattacccatgtatgttgcttttatgtcttgttatcatttatttcttagagttgtggccttgttttgttgctcctatggttgttgtcatttcggaggttccagtcatgcagttcatgttcgttgctgaagtctcagaagtttgtttcgttgagcaagggaagtcacactctccttatcaaatcccaatttacggaaagtattttaatttaaatttttgcattcacttttgtcggtgacatggggccgggggtatcgtgactagaggcttgggtagccgcggtcgcctacgtggcctgaccccctcggggggtcgggcccgagggtgacgtggccacccccccctctctctgtctccccgaggggtcgggctgctcccgtttcggccccgagggctggggcgccccgaccccctgcggtgttggcgccacgtgtgtaggttaggtgagcaacaacgctcacctaaccgcatttatagcaggttaggcgagcgcgctacgccgcattcaatgcggcgcagcgcatgcttacccggtccgtgaccagtcgcggtatgtgaccggtcacagatcggtcagatcgcgggatgggtggcaacaggcggcctgtcgcgcgcctcgccctgtcccgtcagaatgatgagagcttcctggctctcgtctctagccggagctggcgtgctgactcctggagttggtatgtcagtcccggtcagatccattctaggcttcagcacaagcatggcaaggaaatcgctggccattaaatgaaggttgaaatgggcgtcccccggaaaagcggacgagcggggcaagagacgtgcgctctgcttgtcaaaggtcacttccggctgtagactagccctcattataaaaagaatgtttcctttcttaggcagctagaggcccatgtggtgacccctaaccagataaaaaaggaggcccaggcctaaggaggagggagagggattttgggaggagcctgcactctcgctcgctctcgagctcactgtaatccttcacacacagatccaccagaacacaggagtagggtattacgcttctcagcggcccgaacctgtctacgtcgcccgtgtcttgtgcgattcttctcgctgacgttcctcagatcgagggcgaagaacctcactcagcgcccccggccgaaccgacaaaggggggcctgcgcggtctcccggtgaggagccctaagctccgtcaactttattaagtttattgtgttataactgttttacttagcctttcctatattttttgttattgccttatttattaaatattgagtaattacctttgacaaccctagaaaaccataactatctagtgactactctatgtgcggtgcttattagagattttaggattatgcttagcaatgctctaagagaaacatatagttgtttcctaatgatctagactttgggaataaccatataatcttgattaatggtggattagaggcttgttgttagcctgcacatgttggacttcttttcataattctcaaacttgttttaggttgggctcaatgtgcttggttctgttagtcgcaccttggccatcatatataaggatcgttcttcggacctatgttacaaagcatattccttacaaccacatgtctagtgggtaaggcttaactcatagcttaatatggtcagaaataaaaagacatggatgatcagagtataatctattcgaatagccaagccctcggttatgggcaagcttagcaatgtcccaagttagagattttatttaattaaactggaatgattggaactgcaatttgatggcttgggttaacgcatgttcgtgcaagtgtgcagcttgactaaaaaatttgactagattgggatcatgctttgaaatgtgttttaaaactaaactatttaaaaatgggttttatgcaaaagtcaacatgtatcattattccttgtacccatttgcattatgtgtgcatttcttggtgtggcttgctgagtatggtggttgcactcattcttactcaatctttcatcctgtagtcagacaagctttgaagaagtcataagtggagtcctagcttatagcactgttgagcgcctgtgaagatggagtcatacatcctctagtccgctgttgtttttcttttgttgacagacctaatgtgcctatataataatatagatatcatcgtgataattaataaagatgtggcttttgtatcaagtctgttgtggtgaccacggattttcctacgacggggattaatgcactagcgttcggaaaaggtattttctggccatgacaagtttgaagtgttaagttgtcagaattaataagacaaggcaataccaatttgtgaacaaattgttataccaactttggtagagcataggggtgaaatgtcattacctcatattcaagaaggtaatcatatggatacacgtccaggctaagatcattctcgaaattgaaagttatctttggaaatttatcatcaacactgcacaagaaaacaacaacatagttagaataatcacaaagtaaaatggaataattatattctaccatctgaagactaagttgcatataatataccccatccctcagaactatggaacagtctaagtaatcccaacataaataggaaaccctctaaataaacccctactgcacttttgacataggttttgctgctgtagcagatgaaatagcagtttatgtgtcttttaccgagtaaatcgtataatgaaaacaatttccactactgcttctccatcgtaccttatattttgtctgaaactcatatagaaaagcgaaagtttcttttacttttatttttactctaaggttttggtaatttgggcaacttcacccatttagagtattattcaagacttaaaattgtacataacaaagcttcggtttgagtaggcagcgttctttattaggttatgacccaatgggaatttttagagaattactggttttcctcacgttcaacaaatggataggatacttgggtatcaaaacagtggtaatgttagcggactactaacaaattggagttatttgatggataaagtggaattcagaggcattgaaaagattgaattaactcaatatgaatccaatgaatcttctggtatatagtccattggtgaatataatgtctctgcactatagattttgtgttatagagtataccttccaagaaaatgaaaacattcaaaattgtacatagcacccaaggttatatccggatgcttggcaaatacctgcaattggttgagagttatatgtaaacgtaattgcaaacaattctaccactagaaaagaatagcaggtcttttgccataccgcaagtattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcactcgctcgcctcgcctcgcctggcagggcaggcggcgcgcgtgcacgacgtacgcgtcgaatggtccgaaaaaagttggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatacgcgaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaataaattaaatcattatatgcctataatctcaacagtccaaaaaccttattataggcactgtgattttactatggctggttttgccgatgcactgaggccggataaattcaccggtgtgcattttaagagatggcagatccgggtcactctgtggctgacagctatgaaatgcttccgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggctgggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagagcgatggtgggcagtccagcgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtcttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggtattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgagaagagaaacttggcaccactagaactcctacattcagatctttatgaaatgaatggggtgttgacgaagggtggaaaacgatatttcatgacattgattgatgatgctactacattttgctatgtgtacttgttgaaaatgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttagacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtctttctgggatatgctcatcatagcattgcctatagatttttaatagttaaatccgaagtactggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaaatcttttggtgatgatttcactgtgtacctcgtggatgacactcctaagtcaatttcagaagcatatgcatctcctgatgcagactactggaaggaggctgtccgtagtgaaatggattccattatcgctaacgggatttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctattgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtaagggagttattttgtgcttgtatgttgacgacatactgatatttgggacaaaccttgaggtgataaatgaggttaaatcattcttgtctcaaaattttgatatgaaggatttgggagtagctgatgttatcataaacattaagctaattagaggtgagaatgggattacactcttgcagtcccattatgtggagaagatcttgaatcgctttggctacattgatagtaagccttctccaacaccttatgatcctagcttgttgcttcgcaagaacaatagaattgctaggaatcaactggaatactcccaaattattggctcgttgatgtacctggctagtgcaactaggcctgatatctcctttgctgtgagcaagttgagccgatttacctctaatccgggagatgatcactggcgtgcgcttgagcgaataatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattagtaaactagaggagagtaccaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatatgctctacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctccgcttcgctggcctggcctggcaaggcaaggcaagcggcgcgcgtgcacgacgtacgcgtcgaatggtccgaaaaaagttggctcctcacccttgtgcagatgcagcctccttttgcaggtttgttttgctggaaattccgattcggttttgtttggaaacgttccgaaaaatccggtgcatgcaaacagcgtggaggtcggattagtacgcgcgacttatccgctttcggtacgcgcagtaaagatgtgcgggccccctgatca

SEQ ID NO: 10705 - DNA, 12119 bp, Oryza sativa
tccggttcggttacgcccagtagagatcgtgcgggcgccctgatcaagcgaaccttctctatataaacagacccgccgtcttcacgcaatatacgcgaaatcaatctagggtttgccctcctactctgtactgcgccgtcgctcgtagactactccatcccgctcgcgggcgtgcaccagcgatcgggagagcaggtctccggaacctctgcctttgacgtcctgcaccgggagaaggcggcaataaggtttttggaaagcgcttcgcgcgactgctccctgttcgttcgcaacggctcgccttcctcttcgctcgcgtgtttcgtgccttcgtagacacctgcgaaaagtttcgaccaagcagccggtcttttcgtcacctcggtacgtgttcaatatgttgcgcatatttaatctgttcatgttatactgtgtagtttacatgtgtagatctaatgatgcgttcatgctagttttcatctgtaatgtcatgatttatttatggaataaattaaatcattatatgcctataatctcaagaagtattagttctgaatatacaatctccggaaggtacaccaaggttgtaccgctatcaatgaatgtaccctttgttttggtcgtttcaaaaatattggctggaagctgaaatgttgtgccagcaacatcgatcgacttgaggttcacaaggtaatatacctcactatgtgatagaatagtgaattgatgtgagttagtgtgtgtggtgtgtgagtgggctcaaaagttccagatgccttgctgcttttaattttcagaagatacagataaacatgataagtacttctataaaaactatacatattcccacaaatttgtaaatccatgctttgggtctagtgattattatacagattcaaaatggatactatagcattagtttggtggaaacaacaatagaaccaaacaaggttggttatgatctttgtgttggaatcacgagcctgggttacacgcagaaagacatgtattctcaaaaggttacaacatgtaagaaggcatacgtgcactacaatacaaattgatattatatgcatatatccctacttgtcataaacccaacatccaacagggactggtggagagccaagatcatgtactaaagtatataaataggttttttttaaaattatagtttaaggttctagcgattccagcctaacagcacccttcagtccatgttgaagacagccaacataaattttcacatagctctgtgcattcaaaactttgaaacattgcgcctaaaaagaacactcaagaacaataacacataattttttttcacaatgtttgtaccagagatgtaccacttgacacagttcatgtttaagtggataaatgcatcatattttagggggttgataaatgcttcttaaacaagtataccagaagaagctataaccagggtaaaattatatgtatttaaagtagatccaaattaaattgtgaccataaaagaaacataataattaatagcagagaagtacatggttaactcacttattctttactataggtgttgtttttacttttggctccaccacttctcctatagcaaaaattccaccaccatttgtggaatcaaggcaatgagaaaatattttctttgtcttccctgctgcagccaattgtgatagcaatgtctgatttgaattgccaaaaccaataattccatcaatcgctagttctgaattgtttaagcttccagtttgttgttaaaccacacctagaagcacaggggagccatttcgtcgaattattatcacggatttgccccacgtccctaaaaatatgtttgctaaaaaatattcttctactgcataggatagattactttccaagccatttgttaagattgtttctcaagtagacaatccacaaaaataatctagtaataatttgtttcaaacatggccttagtgggccaacttatatagtacacattcttagatagcacagctacgataaaacacaattaatacagcctacccaccttatggagaacaaggcataaaaaatatcaaaatatacctatgaccgccataaccaattattgtcatgtgatgagttcatcagagatttacatgaaaagaaaataaatatatttacacaaaacccataaccggcatcaacgccaatttctaaaccagcagaggccagccgacactagtgatctcggctatcaataccggtggctgaaccgacagcgatgctcaggctatcatagtgaattcatatagatttggtaaatgcccaacccggctggcatgaaatggcattaatagtcaataattgttggaactatgcatggcaacccgtagtgatgggtgatagtgattagctcatgtgtgctagtgcaataaaataccattcatttgaaaaagaactagtgtgttgtgtgatgcaacatccaatggtagccccccacaggaccattcatatgaaaaagaactagtgtgttgtgtggtgcaacatccaatggtagccccccacaggagcattaacttatgccatgtctcttctgctccttctctggattatagccatggatttgctcaacgcctctaaaattgaacattcctctattgcatgtatacttattggtccacttgttctaagctatctgttgaatatatttctcaaaatatttagtctatccctataatcaaagtagataatccataaaaaaatacagtcaataatcaatttcaagcagggcctaagtgggcaaacttatatagtacgacttcttgaaaagaatatctacaataaaagacaatcaatacagcatacccaccttacagacaatagtgaacagaaaatatatgtatggtttaattattgccatgtgatgctgtaaaataatgcttcagatttaataagacaatacaactacagaaactccaatcaccatcggttcgtagttgatgcatcactatcagtttttgaactagaagaggtcatccagcagtggtggcctcacctaccactaccggttgatgaaccgacagtgatgctaggtctatcatagcccatacacatgggttggtagggaaaaaatatccaagccagcatgaaccggcattatatatagttaatcactgctagtctatagtaaccgttagaccggcagtgtttgcctactgtgtactagtgcaatgaaatgtcttttgtatgaaaaggaatattgtaagtgccatcaatatgaaagtgctcgactctataaaatgccatcaacatgcaaccactcgactctatgaaatgccatcaacaaatatgagtcaaatttggaaggagtccaaatttgaaaagattggagtttgatttgtaaagggataagttgtatacttgttcgggtaggttttctatgagattagaattacttatccatgttgaattcgtggctttgtgcagccacttcaaggtataaaaaaaagaggggttgaggcctcttggtaccattttgtgagataacagttttgaaaaaaaaaagggtttagcctaaattttgagtatagtcgaaagttgatagatgagtgttactgttacactttgtgagcacaattagaagcaataaagttgatttacttctaaaaaattgtttgatttgtgtttttctttgtttcggtagttagactagtagcatccttgcggtctgactggcggcgccacagcggtgacacaggcaacttttagatggttggaccggcagtgtcaggcgaagggagaagcaaggcgattggaccggtgactctacaccggtcagaccgacaggactagagtggtcagaccggtgcacacaagttagtcaactagacttcatcgtggactctgtaaggttagaggattatttttattccattttggtttttggtgtatgtaccattcaccactctctggtaggtttggttattgtgtttcgatcttataaatatgagttatatgttatgccaccatacatgttatttttctaccttttctccatcgctgtgaactaaccattaaggggcctatgttgtcctctaatggaaagttcatttcaccataaacagcaacaggcactcacgaaagtctgtcgagggtgtaacagagttatcaaaggtgttttggtcactgtgtaaaaaacaaaagaagtctgtcaagggtataactatgttctcaatgatattttggtcattttataaaaactagagacataatttgatgttaaccatgatgtgatggtaaaaatgaaagagtattgcacgtatggaaaacatattgttgaactattgcttatcaatggcattttacaatcgagcacttctgttgtaaatcaataaatttcatgtacgaaaatggttgtaatacattgatgtgtcatgctatgagtgcatctagattttttataacttccatttagctaaatcaaacggttgtgatgattgtcagtaaaaatttagtaagaaaaacttagtacgtgtagcagtgctatttctttaataactcacccaaatgtgacactggtgctggttggctgagtctgcccattcccatacagttgatgatagtgcagaagatcagtgaaaaggatgcccattgttaagccaccatcagagtacgccgcgatgtacggacaacgtaaggtcatgttgcatggtggtcgcgaagtgcatattgtatcatcacatttcacctcttttgaacttactgagctcctggggtcataaaatgtcagctttctctgcacacaagcagatacacatacccatgacaaaaacaaaaacatattacaaagcaattttgcaaagcagattttgcaagcagattaatggactgaaactaaagaaacactagaaggaaacctaccaatatgtcgctctcgtgagagggcattgcttgcaggagatgctgttaacccaaaatgcctcactaccggtgtccacctgtacatagtacttcacggcgggtgtcccgatccctatatctgtgtagtataatctatgccaagatccatttgttatccctaataaccacaccaaccaaccaagcaaacacagacatgaccaaaggcagagatgattaaagcatacccagtgccgtatgggatgctgaagccaccaagtgggagctccgaagccataaggttatggcgacgatggcggttcccatcatggatttgtaatgcacctatgtcgctccccttgtacacaccgtccacgatatggaatttgcggcgcacctggaatacaccattagccatggtaccacgagtagaggatgctaccaccactagagccgaaatgattgttgataacaacaaaggagctgccatctcttcagcaaagtacgtatcatcccttcccttttgtattttatggagttttaaatggtaattgttggttcgtcatctggtcctcatctatggcaatgggctgctctatgagcttcaatatgaatgggtaggggcatgctagcaaaagatgtggggtaccgtgaacaggaaatagctaaaagtggaagcagtcaccaattattgccgggagagagtacgaggaaactggaaactacatggtttttgctgttgagaaaaatgcacgtgcgttttttcagataatggatatatgtctaggctctatgtccatatacacagccaaaaaaaaatgcacgtgcatatgttgctacgttcgcattctcaagtccatccattattttttctgcggttttttttttgcacttatctttttgtggctatgaaaaatgccatgcatggctctgtttctttttggaaagaaacttcatatctacgacagccaaagagtagtgactggttgtgtacgtaaactaaaatctagaactattaatatgtactctacgaagctaaaacaactagttccaactcagaatctaaaaacatatgatcctggcaatctgactatctagctcaacaagtagttggagaagacttaactagctacttggactgctcaattctgatcagaccatcagccctgttacaatagaatcaatgagaaaattaactctgcactatagaaatgtcatgtcaggccctggtgttttaggaccattaaccttctgcattaacagcacacacatacattgcttggtgccttcgcatagcagtagataaaaccacaaatccatcccactggagaactgaccgtagcgtattagctggtaaggtatcttgtggtgggacctgtcctcttagattcaaatcccaaacttagcatgggtgcttgttgatggtccttaaatcataatatttgaccgtcaatacttacatataaataaaacatggtatctcacttagtggtagatattattactaatcatttccactagtgtaggtgaaatatgcgtatgcaggtaatttgaggagaaaccacatcagtcatgcgacaaaatgcacctccgcgcattcaggacgcgtttacacggattggaggcccaataagtcaatgaaaaccatttaggattgggccaaaacaaagcacaggttattgggggcccattaagcaatctcccggccgaagaagaggccgggaggagtgtttttgggttcggccgaacccaccagttcggccaaacctgttctggcgctgttgatcaccattttccatgtggacggccctgattacttcctgatggcgattctagggcattttggacatttcgcataggctgtaaccgtcatacctgcctataaaaggaggaagctcactctcatttccagtacacaactttgatctgaattacatgagactctattgtatcttttttacattagaataaggtagagagtgaagggaagctctggaggagtgcccggaagtttggcgccctctccgacttctttcttaacgagtgtagcttcctaggaggaattctagaggagtaccggagctgtcgatacactctgctccgggttcgaagaacttcttctataaagtaagcattcgtgttcctttcttatattatttaattactttgtctgagtaagatagatttccatctttgcgtgtacattgtttagtattcatactaagtgctctagtactaggactctggataaagaaggaagttcatgtacaagtattagagtagtaattaataacttagacgtggtgtttaggttagagattacctttgtttgttgtgtatcccacggatttgtcagaggtaggcggcaagtggtgacagccctgaatcccgtcctagtaatcctccacgtttggatacatcatagagctatagccggaaccacgctagcagaccagtaggggtcggtgcccgaagcaacagatagggaattaccttgcttagcgtagataattaaagcacatagaaagtcctctctagcctgcctgcctatagttgtccttggattctcttagccttaggtagattacacacgttccctgagttcgatatccttttggggtcacccgaaggtgaagtgctacagcggtattccgtgtgcttgcagatttatctgtggtcataagaaataccaacagtgctcttatttatgacaaattattctttcagtggtagtggtaggtgatatacccctcaacaccgagacgttatgccggtctaatcttccaaagttgagaataggatgggcatctttcgaaaaaaaattgataccactgaaatataatatgttgcatacacacaattactgtggtttttattttgtgttaagtctgataaagttgaaaagtcttacacagtttactacttcctccattccaaaatgttgctacctagaatgagatatgttattcatcctagaataactaatctgaacagtcctagccttctaggtaagaacattttgggacgaaggtagtagaaactgaagaagctacgaaaaaagaaataatagcatctgtctaaggtatcataggcaacttatagggttaagacatcaggcacaatcctcaaactcggcattacccttgtcggtttcggataatatttaagaacaaagggtgagtacttctgtaacgtccctagtttaatttaccttgaaaatagattagccttgtgaagttgtgatgtgattgcttgtttatgaatttatgtggctgaattaaaatttacaaccaaatttcagttagaagacaaggcaattagaattgaacctttcaaacttttgttctacgaaatactaatctaaaatttcaggaaattataccaaaaataatggataccgtaccgccaaaatttcatgaatttaggatgccgagatccacaagtactataccgctgacctctctaacatgtgccatcacattatatttgatagatgggatccataaaaagaatagcacccatcctcatcatgtacatgacctagaacaattaatggtttaacaagcacagtgccaaactaggaccaaaggagatgtttaacatatgagcatgttaatgccctaccgaggcatgcaccgcctaatcatcaactcgatgacaatgacccaaagcgcataccctaggagacccttctcatgctattttgcaaaaatctcaattgtttcaaacccatatccgcgcgatagtaattagttatgcattttcacctcaagcgatgacatcaagaaatatttatgtaagttctaaacatagacaaacataaagataatactccctccgtttcgttttatttgacaccgttgactttttagcatatgtttgaccactcgtcttattcaaaaattttaaataattattaattcttttcctatcatttgattgattgttaaatatacttttatgcatacgtatagtttttcatatttcacaaaagtttttaaataagacgaacggtcaaacatgtgctaaaaagtcaacgttgtcaaataaaacgaaacggaggagggagtacatctttagattacacagtagccgacctgctaaatatcatagactaaaagcaaaggaaacgtaattgattaccgatacacccatctaaccatcccacgggcaaccgactagggacgacagcccttatttaactaagaaccatcctgaaaatcttcaacacccatagcaaagcacttatcactgggtattaattttatcatcggcatcaaagtcaaccaacaacaataattactctctccatccaattttgatcagcacataattaaaacccaaaacaaaatcagaaattgatatgcgtataaaaatgtgaggacggtttttgtcggagtagaatcacagaagaacacacgtgtacgctgaaggagctgttgtgcatggaaccttatcaatgtggcttatattcacaatggaaattatttttattatccttggtcaaagtagacaaaccttatgcgcagatcagatcagttggatgaagggagtggaaagtaagagtcagtactaggggctatcaacgagccaagctcgaggaagcttccatatgtaggctcaagctcgctacagacttgagtcgagctcaagtcaagccctggtttgctgtgagcttgaagctgagctcaagctcggctagttcgagcttcgagctcttctcaagcctgcctggtggtgcagtgaaatactataacagattcatcccattcacttgaaaagttgacactgtgatgcatgattagatggggaaagtaatgctagtgatcctacgttaaagcaagccacacactagtaccagtactagccatgctctttttgggacatggaataacaaatgcatgctccctccattaaaaaaaaaaagacaaaccttggtttccgtgcccaacatttgaccgtccgtcttatttttgaaaaaaatataaaaaaattaaaaagacaaatcacgcataaaatatttatcatgttttatcatctaacaacaatgaaaatacaaattataaaaaaatttcatataagacggacagttaaaattggacacggaaacccagggtttgcctttattttgggacggagggagtatgcccttccgccctgccagtcctagtgctactctggtagatatataatttgaacgggcaaattaagagagaggagggaggaaaagcctgctagaaagaacatgcgctggatgctgaggctcgcccaagaaattcgagcttgaatcaggatcataacgaatcaaactcaagtagctcgtgagtcttgagcttttttgacagctctactcggtacatctatgtactggcaatctcttactatcgaattatgtccaacaccaaaaaataacttaaatgtaaaataccattttgagggagtaaaatgcaatttgcatagtcaattgccctccctggaagggtcttcactcttccctgtctatcggcatgtatatcgatcaaaacgcctttcaatctccctgtcatctgtcagatttcagcaataggtcatcactctcatccttcacttccaccacctccatgctatcggcttccaccagcgctgacatcatactatttgcttccattagagccaccatcgtcatccgcatccaacagcgtcatgtcgcctctatgatttcaacaattggttacttttcttactactccctccgattcatattattagttaaattttttcaagtttgatcaagtttataggagaatttagcacccacaatgcccggtcaccaatactccaatccaccatccagatctaggattctatggctgggaatcaagggagggagagatggaagagaaggaaagagatgcttttcataattccatctatactatacaccattttctggaactcaatgctcattcgtttacttctttcggatgcttctcactggtcaatatgaaatatgttatacttgaccaatatcgtctgaatatcgagcaccttgtcttcatcagctttattgagatggttaagctagcagtcagcagtgaattctcagataaaacaacaattaagagctaaacaccaatagaaaatcagaaagttctatactacttcatacttcagaatgaactaaaaaaacttcaaattttcaaccagcaagcttaatgctgacttgaatgacaataaagggataacatctttaaaagttttgttgttatgaaaacagggaaatgaatttctagattaacttgcagtacaatcacatccaaattcattaaataacatccgcaagagtagttgggctgaatttaagattaaattaaaatacagttaaaacttaggacaaatatgagtggcacaaatatgaaaaagagctcgagttgatcacgtaattttacctttctatttgcctataggaccacaattcacaagattcatacatgcaaaagtggctatgaaagaggccatgctagctaggtaaatcctactcgtaaatgttaatttgcaaacactgaataccttgcttcatctccaagggaatatcaatgccacacattcatatgcattttgcactaaaaaaggatctaaaattcagaggcaatgcaccgacaccaacaaagaatgtttaaataaatagataaaaaacgaagtgtttatagtagcacctttgcagcataaggatcacattcacatacattgggttttgcatagcaagcatagagtgcatgcacccagaaagaaatattgaggggaacatgaagaggcttccttgaggtatagatattgtccatagctggtgcctggaggacgagaggaactaccaatctgcaaggcaaacatattggtaaaaagacaattttccatcagatatatgattctctaattttgattcaagcaaatggattctctaacaatggacataaaattcaatttgtgtatcacatatggttcccagaagatacatagaatattttcttgaataaacaacagatggctatgtgggataattttctctatacaaaatagtttttgacctctaggctctaatattaccaatacgtaaagcattttaaagcaccaaaataactgtaagagaaatcgcatgtgcatgtgcagacctatttgtgcacaggaacaaacaccacctaaaaagaatcaacaagtagccgacaacgttcagtaggaactattttatactccctccatcccaaaatatttgacgc

SEQ ID NO: 10706 - DNA, 9278 bp, Oryza sativa
attaattcttttcctatcatttgatttattgttaaatatacttttatgtatacatatagttttacacatttcataaaagtttttgaataagacgaacggtcaaacatatttaaaaaagtcaacggcgtcaaacatttaggaaatgagggagtaataaacatgaatagcaagtcgatcataaagttgagtgattctttatcttggttataatctgaaattccgaactgtgatcttctcccaaacaatatgcttacgtgttcactttcatttggtggcactatactgctgcagcagttcagcaaaaataggaagccttggcaaatagcaatttcagaatcactgcattatagccaatagcagtcatctgatcatgcacacgacacatgactggatatttgcacatatggtttatattgtgatcatggattatttaattaaagtaatcagaaaacaatggtttcaaacacatgactggaaattgactgcaacttaagcccagtttttgcaccaattaagcactacatccagctcaggaccagtcaggacacaatttacccaataaaactcaaataatgacatgacacaaccaaataacaggaaaaaatggaagaatatttgactcataaaactcaaataatgctggcgcctcgtaagataaaaataccgtaactctaatcaagtcccatgtcacttttttatctgtgtacaagttactcatttcaatttatctgtttgagatcagtcacagatcaagcataaaaaaatacttactttgctggattcaagggccattggagcatttcctaaaacaagatatgtgtaagtgcaactcgatctgtcaattaacctgacataaagaactgaaaaggttacttggaatttttaaagaacataagcaagaaattcgaagcctaattataacattatatataaggcagattttgctctaaaacataacaaatatcagaacattgcagcttgcaactatctgtagccaaatccctgtaacgtaaaaataaatagcagtctaggagtgtttctttcaaccacctgagctgaagtcatcgtaagtgagcataatcaagagattagagggttggataaggaccaatgtctaacacaaatcagtggtgccgcactgccaccaccaaaccaatctgctgaacattatcaccaataaaaaagttcaggagcaagaattggaatcgaattaccagcctgatccattgtatgaaccacgatatgttatgatgttgttactgctacagcaaagcaagattatagggagtgcgagacacgtcggcctcgggcgctccggagaccagtgacggcctgaatggtttgtggagcaccatcgtcggcgagtcgcgggtgagggagagccgacggcggggcagatgccactggtggtcgcagggaggcagagaggccgacggcgctccgctgtttttgtggatcaggattcaggagcaggtggggaccgcgataatagggaggatatacgcagggcaaccgtcagtggtggagaagcagcagcggacgacgtcgtctcgactcgggatcggcagcgcccgcgcccgtgctgacgcctgcaacgacgacgatgcatggtgcttgaggcggtggattgaacggcgcggtgtcaatctggctgcgaagggggcgaggaggcgacgccgtctcgactggggagggaggcggtgtggtggatgcaggcgagcaggggcgacggggcggctgcgacgatggggaggcggtgcggcatggaggagaaagggattgggagtgccggggaggacggcagcgacggtggggaaggaggaaagggggagagaacggatcgggcatgcgggcggttgagggggttgcggtggcgtggatcagggggttgagggtaggggagaggagagagcgatcgagattcgagggagacgcgtgcgctggatgcgtaggaagagaaaggcgatctgagccgttcgattaggcgatccgactttctatatttcgcgtatctgtcaaggttggagtcaccgtcaccactacggaacttttaagtagcagagatatatcatcttgataaatggatctagacttgttgacgcgaaaaacatacactggcctgggagatctgcttagctccagtgcagaaccaaaggttagtgagatgcgggcgtgccaatcagtttgaccctgcaactgacaagatatacaaataatagatcaatgagccgatcggctgacaagccgatggagtagttccagccgatgccgataatagccaataacgattggatttaagcaatcggctatatgtccaatatagataatgatataaaggcaatcggctgatgatgatgtaataaaataacaatataatctagtataaaccaatcggctagcaatacaatatgatagaataagcattgatccgaaggttaaagcatacatcggctggaggtccgatgtcatagaatccaaacgattagataaacagtgaaacctttgttgtaatcggctaaatccaacttgtatgtaatccttataagccgatgcaacgtccagataacttatcggctagcaccccgataaaacactagcgtgaacctatcggctcaacaagatttatattatcaacaacaatctagtaggtcgaacctaaccgatacagcacgagattgtatatgataatctaatgcttgatgagctagatctgtctaatgtgatggatataacaaatctatttagaacaacattgtgattgcagagatatatcggctaagacagaagatcagacctaaccgagacagtcccaactaaaccgatgcgtctctaaacacaatgcaattagagatagaattgagatatcaggtaggcaaatatatcaaccaaaccagagcgatccaagagatcgaagcaatgcagccttgaacaacaccaatatagccaatagattcaccagggccggtggaacgtaggacttactccttcgccagagatcgaactgaaccaatgcagcctcatgtcaggtgccaaattccaccggaagataagtaaaaaacctcggtaaagagggtggcgatgcgccgagagtagttgtattgatcaagagagataatttacaatgaccccgggtgcacatatttatacccatgggtagatactagtctttgtaggacaagaaagaaactgtcctaaagataaaaggaaaacataaagtccttataggacactaaacacactttccttaagataaaaggaaactaacaaactactccaaattaatagatatatttgccatgccgcatcctccttgaactcggactcttctggataaatttcctctaattgatcccactccaccaagaatacaactgctggcgatttgacgactcccatcggctgattccaagactctaaagccgatactgactctaggccgatgatgactttgggcttaccaaattctggcgttaacaagactgttcgattaggatccaacgtgtcgcgaccgagaaaatttacattttcccgaacgctagtgtattaatccccgtcccaggaaaagccagggtacaccacacaaacatgatataaaagacacatctttattatatcaataatatttccattattacaaagacacttcaggcctgacaaacaaaagtaaacagcagcggactagcgggcctacggttccatcttcacaggcgctcaactggggcataagccaggactccacctaggacttcttctctaaagcttctcttactgaaggggggagagatagagcaagaatgagtacaaccacagtactcagcaagccacaccgggagatgcatgattaatgcaaggggtacaaggggctaataataggggttaggttttgcagtaaacaacatttaaaagtcacttagttgcccaaagctattttgcaaacacgatcctagagctacacaatattattaatcaaggccgtgaacccacacgaacctgccttaacccaaggcctacgatgattcagaccgaactggcaacccgacctgggtcccagctcatcccaagccaactcaggccaatcattccacattttagttgttaagcaagttttaagaagcaaacttctaactttggtacattgctaggcatgcccataaccgagggcacagctattcgaatagattataatctgatcagaggtgtacatctttaccctctagacacatctttactctgcattccacggccgtggaacccatcgtaaaggatgtgacataacccctttacccatcctagccgtgacaaaagcaccgacccaacctcgcctatggccgaaatcccgagacaggtaggtaagattgagcccctagcagcaggacaccggccctgtgccatgacatctcgactaccgagccgcagctcgtgtagccttcatttgccctagagatgtccatcgagccccgacttcgtccatctccatccgtgtactcttgccaggactagactgagcaccgggttaagccttacccattagacatgtggttagtacagtagtgctttgcaacagaggctcgaagaccggtccttatagtggccgaggtgctactagcagaaccatgcaccttgagcccagcctaaaaccattttaggggttttgaatagagggggaggtgtgtgtccaattccaacataagccaaccattccatactgtccaaatgatataagaattcccaaagtctaaagttataaaaccacctagtgttgcctaattaatcagcgaagcatctacctaaattcatactagtggaaccgttaatagagtacccactagttggggttttgtttatcctagggtgaacaagataataataccaatagcaataataataaggtcataacaaaggtaaataggcatggctaaataaaacagtgataacgcgggaatttaagtaaagcggtaatgcaataatttaaatcaaaataattttataaactgggattcaatatgctcaagggtgatgcgacttgcgttgctcagagagaacggcactccgaaccttcggcgacgaccgcgaagcatgcttcggaaacctccggaatgacagaagctacgcgaagcacacaagcaaaactacaagcctaaaaagaagtaataacaatacataaaaagaaagcacacggttctttaggttatgacaaacattaagagacttgaatgggtcgattaggagttcgtatgaccaagatatgatcatccaaagtttaatgctgttatatgaagatttacggattattatgattaggttttgcaactataaaacatgtgcaagcgctagcctggaaaagacaggaaggctgcgctattgacatgcggacccaacatgtcaacctaatggaccacggtagaccgaatacatagagacggtccacgggtcgacggaagcagaccccgtgtgtcaaccaaggcgagtggccgacaaacggactccactagacaccacgcgggctgcacacgtggaaaccacgcggctaccgagtgggcacacaaacacggtcaccacacgcacccacgaacgactaccgacaccggtacacgggtaccagggtcgacaaccacacaatgggcacggggcgacaccgaaaggacgaggacgggggcagcgaaaggacggacccttaccaccacgcgacgacacgtgggaacgaggacggcgaacgggcggcggagacggctcggggacgacggagacgaacggcgagggaacgacttcggcggcgatccttggacgaaggcgagacgcggtcgatgcaacgcttgacgatgcagagccgaggacgaagacgacgacggggctgcagcaaccttgacgaaaggcgggcgacgaacagcacggcttgacggagagacgaacaccacgactaccgggaacgatgggaggacgacgatgggaaccggcgaggaggcgacgacgaacgccggcggattcaactgaaggggaggcgaagccaaggacgacgttgctggctcgccgctgtgatgccgaaggtggtggttgcgcggccaacggcgcacgagtggaggaagggccgaccggggaaattccggcgaggctgatggagaggccggcgcggcacggcggtgttctggcgaaatacgggcgacgccgtggcctggccgggcaagaggacggctttccggtgccgggagaggtggtggcgacgtcggccggtgcacaagagacgcggcagaggcggccggaggcggaacagtggcggcaacgccactgttgccggcggggatgcacttccggaggtctccacgggaaacggagggcaggccggcgtagaggaggcacctgcgaggccgaggaagatggtggcgcggccagccgacgcactggcgcggcggcacgggcggctggaagtggccggcggcatgggagggagaaggaggacggcggggagaagtggtgcggccgtgggggagctcgggaagaggcaaaacggggacaggagagggaggagatcccgttttataggtcacagaggggagcaggccatggcaagggcggggacggcgccgggaatccggccggcggccatgaatgccggtcaagggagggaataaatccccggcaattggggacaggattcaaggggaaaaattaggggaattgaagagggagtaatggggtttccattcccctaatttaatttgaatgtaggcattggattgaggcggatttggggggaggaaggagctatgtttgcacgggagagagagagaggaaggaggccgggcggctggaggttgacgacgaccgggggtgggacccacgcggtcgcaatcggcgcgcgtgcacgcggctggttcggctcggcctgatttgggccgggcgtctgggccgagagggaaggagggaggggaggggcggcccagaaggaggaggagaggagggagtgggccgggaggggaaggggaggcccaagagaaggagggagagaaggagagggagagaaagagagggaggaagggaggactttggccgcgggccgggagagagtgggaggactttggaccagacttggcccaaagggaggagggggattaattttaggtttttctttttaataaactctgataattgtttttgttgcttaataatattttcggtgctctgaaaattcaagtaaaatttgagggctctttttagaccacggagaatttaacaaaaaatctccggacaacattcgaatttttcttgtacgtattttagtatttgccaatttcttttcgaattttaattaattctattattccatttagagaatgatttttatttcgggatgaatttatcacgggcgtgacacacggatgaaactttggtggcacatgatggattggcaagttttaccaacacatagtctgactttaaagttagtattaccgacatatactttgacctgaagttatatagaattgctgacagaaatagattcctactcctatattgtagcattgctgacatatggtccattcaaaccttttaccaacaggtagttagtagataattctatatttttgctaatacacatctgccggtaattttatgtcatggtgtagtattcctcgcctactctattgccgccgcctagctttggtgagaggcatcaacgttggcagtcggcagtgctcatcacttccgagcttgaggggtggcgctggcttaggtagtgctggtcactgcagcgctagggaggggagaggccattgccacacccgtcagagggaaccacagccctgtgcatggtaaggagggagagatgaaccctgttgatggtccttaaataccaaatccgaccatcaattcctacatataagcaattgaaataaaacatcaaacctagtggtagtggctattactaatcattttcacaagtatcggtgaaatatatgtatgcaaggattttgtatgaaaaccactattgacagttcttaaatcataatattggaccatcaatgcttgcatataatgaaataaaatatggtatccaactcagtggtagggattattactaatcatttccactagtgttggtgaaatatgcgtatgcaagtgttttaaggagaaaacacacccgtcatgcaacaaaatacacatccgcacaatcaggacacgtttacacggattggagggtccatatgtcaatcaaaaccacttagaattggaaaaaaatcgtagtacatgatgttgggggcccaataagcaacctcccagccgaaggagaggccgggaggagtgtttttgggttcagccgaaccattcgtggcgcctcctgccatctgttccacgtggatggccatgattactccccaatgatggttggagggtattttggtcatttcccatggtcataaccgtcatttggagcctataaaagatgagaggctctcattccaatacacacaactttgagctgaattataagagattctattgtatcttttgtacattagaaaataggtagagagttagggaatctctggaggagtgcccggaagtttggcgctctcttcgacttctacctcggcgagtgtagatttctaggaggaattcttgaggagtaccggagctgtcggtgcactctactccggtttcagagaaacttcttctatcaagtaagcattcaggatcctttcttttgttatttaattacttagtctaagtgagataaattttcatctttgcgggtttattgtttagtatttgtactaagtgctctagtactagggctctagataaaggaggaaattcctgcgcaagtattagagtagtaattaataacttagacgtggtgtctaggttagagattatatttgttttttgtgtatcccacggatttgttagaggtagacgacaggtgatgatatcccagaatcccgtcctagtaatcctccatgttcggatacatcatacagctatagccggaaccacgctggcagaccagcagggatcggtgcccgaagcagcagttagaaaattacatttacttagcttagatagtgaaaacatatagaaaatcctttctagcctagctatcctaccgatagttgttgtccttgaacagtcttagccttaggtagattacattaccggtttttccccccccccctttggtaaaaaaagtttttttttttccccaaaaaacccatccttttgtgggcacccaaaggtgaagtgctatagccgtatcgttgatgtttggtatcacgactacg

SEQ ID NO: 10707 - DNA, 21219 bp, Oryza sativa
  unsure (1)..(21219): unsure at all n locations
cctttctagcctagctatcctaccgatagttgttgtccttgaacagtcttagccttaggtagattacatacgttccctgagttcactatccttttgtggtcacccaaaggtgaagtgctatagcggtattgttgatgtttggtatcacgactacggtattttgcatagtatggggatcgttggtaccaggttatatgcgagattgaagtaaaagaaatggagacaaggatttttatacaggttcgggccccttatttgtcaggtaatagccctactcctgttggccgaagccggtgttgctcttattcatcataatcacactagtgcaatatttaggataacctatctagccgttgtcaacttggcggcctagaaaaccatcacgtagtcgacaacggggtagttttcctactcgaatccgcactcggcaagatcagagatagagctagatccctctcgttggcctctgcaggcaccagattgagtctgtctaggcatatctctgatatcgatatccggcggcatgtcttggcgtgtgttggcttgtatatgtcttgtgtattgattgtcctctccccctcctcctagggggtttatttaaacccatagatgtccccttgtccatataggactagggagaccaatatggctacaatccgagtagtccttatagtttctatgtagaactctattcgtacttccttatccgaaactccttctatatacgaggtatgattttgtataagacatgatatgtggtgggctctgccgagtttagtcaactactattaggtatgtggtatccataaccatgagcgagttgatgttctcgaccgaaaaccttggaacaactgttgtcgtgctctcttgaccattctcggtgtgatcagagatagcgctagatccctcttatcggcctccgcaggcgcatgttggtatttcttaacgtcacagataaaatcctcaagcacggatataccgatgtagcacttcccctacggagtattccaagggtatcgaatccaagggaacgtgtgtgattatctcttcctctggttcatccaaggacacaaagctaatgtgggcagagggcagagaggatttcctaatgagaaacagtgtctagggaaagcttaacattaatcctaacgcaatactttaggcactggcaacccgctgttcccagatgtcgctctactatgtacccggacagggaggacttaagtgctcttgagggctgtcaccacctctatacccacctcaaacgtactgtaggatatgcagcaaccactggagattaattacccagacaccgcgtctacgcaattaactaaccaagaagtaattctcactaagcaaaccttaattgctcagaataatgtttctattaaagcagagtaattaacaagatacaaaagtaagaggagataacagacaactccgggattcctccgattccttctacctttctctctccctattctaatatacaataaagtacactagagcctcttgtaattcagctcgtgctttggtgtgtgtgaatgagggagaggagaagggtatttatagtgtggaggtgacttgagagagtggagatcctccaagcatccaatgagcatctttatcctcctagtgccatgtgtccagcagatgacggttattcaagtaaagtcggtagaaactgtcgtggcaagtcggtaactgccggcctgtgaagtttggggccgaacggcgcagctaggggttcggccgaaccacttggttcggccaaaccctttctagcccattttgctccgaattttctcataggctttggtggataaccccttagcccaaatgtacttgcaattggcccatttgaatgtgtttcattaggtttttgggtccaaagctccataggctggaatatggatgtttaattcacatcctcctctatgtattttttgtctcaactttggtggttcgtcacctgcatccaaatatacaccaacactcgtggaaatggttagaaataaaccctaccactacattgaatgttttacttttatggttttatgcaggtattgacggcgttaatttggtacttaacagccatcaacagcgccatactggttttgtctaggttaatcacgatgtcaactgaaaaggtatggagcatgcgactaagtctcctgtcttatcgtaatcgagaatttggattgaagtcaagaaattttatctcagcgggtacaccatcgcttctttccatattccttgtcgagctccatcaaccgtccttgagtaatcgagtagtcgtaaagtgtgcgacaaagccctgaaatttgacttgactgttctaatgtccgactttcctgaaatcaatactcaaaacatttgctgaactcgctttagtcgatcctgatgtaagatcatagagacctagagtcctcgacaacgttgaatggaattttcctgaaatcaatagaacaaaatattaaacagaaatagcccccgagcgaacgatcaagggtatcatggtataatatgtatggaaaatttgagaataaattgaatctgcgtgtggcaataaaagagtattctcgccagacttgtcctcagcaaacggagttcggtacttgtcacgcccaggaattcctaaatagaatcccaagcagaatgtgcattaaaatccctgtccaggatcggccggggtacacaaacgacaaagttgacatgcagatccacgtcttacaaacattataaaagtcttacataaatgcagcggaaaaacaaaagatagctggagctaagccttgacttgaacggcagcggaaacaacactccacaggcatcctcgacggcacggacgaagcctactcctcggagaaaccgccatctgacgcatacccaaactctggggttggggaaaaatagagcaagactgagtactacccactgtactcagcaagtcataccagaacagaggtatgatgcaggatattaccaaagggtagctagagaggttctttggcataaagcgagcatttataaacagtagttgaaagcagtaaaacagttgtaataattaatcaatattaaccatccaccgttcaacgctacaccacgttgcaacaggcccaaccaaccacctgaactaatcagttccatcagactacactaaggtgagctaatcacggtgaatttggttgaccgcccataaccgcgggcacggctattcgaatagttttactctgatcagaggtgtacaactgtacccacaagacacagccccacgacacgtttccgtgcgtcgacatggcaccacgacataccggaaagaggccgtgacaggacctttcgcataaccccctctaaccaagcacaccacacctcaggtttcacccccactcctcgcaaggtagcgggcagtcccctctcgtgcctaggtgaatccggaagccggataggccgtcgcagggcccatccaaactccatcacgcccacccttgcctggatgcgtcagctagaggaaagttacactacgggccaagccgttgcccacgctcgcttgtggtaagtacaataagttcttccaaggcatcccgcgaaccagtccttaattgccatgggcatgaccatcaaaaccatgcacccacagcccaccatttaatatattttaattaaccgacaccggagcggtggcattaaccaacatcattactagaatctaatatctatgcattaatgtagtcccccattgtgtgctagttgaactaagcaaggctaagcaatccctagtccaatctctagtcatgttatatcccaagataataaaggagcatggttgtaacagtaggtaaacatcccatagtaacattttaaaacgatgcagtatttaagggaaaatggtagagcatttgcaatataggatcaacatgttcaagtgacaagcatgacttgccttacactgctgctggaggaacctcggcgactatttcaaggtacaccggagcgtcgggagagccgaaatctaagcgacatacaaagaaaataatacaaacatgctataagactactgaaatagagaacaaaaccatttttaatggattctacacatttttcttgatttactgagacttgaatgggcttaaacggagctcggatgaattttctatgaattttagaagattcactgtgtttttactataaaaagaaaaaccttaattgcgcaatatatcccagggctgacgtcatcaaggaggggggcggcgccgacatgcgggccccattagtcggtgacacaagggggaaaagaggggcactgacaggcgggccccactcggcaccggcccaaggggagtggcgaggcatcggccgggctcggcatcaagccggccggcccgccatggcaagggcggcggcgcacgcgtcgccggtgacggcaaccggcggcgggaggcggcggcgcgaaggcggctacgcgaaggcggcggcgcacggccgaagcggcggctcggcctggctcggcgctaggagggagagggaggggaaaagaggaggagaggcgcctcaccatgagttggccggcgtggaggaagatgacggcgaacggcgacggcgatggccggggaacgacggcgagcggccgacgggttccgagactccctaagagagaaaaagagaggggttagagggggagagggagtccacggcgagcgggaaccgtggccgacggcggcggctaaggaaaggctcactggcgcacggcggacggcggcctccgatggcggaattcgacggaggaggtgtgggctaggtggggttcggccacgcgaacccgacggcggcgacggtgcggtgcggcggcgaccctagcggcggctagaggcgaccggagcaatggaagagccagcggcggattggtgcacggtgcgagagcggtggagagctcgggagaggccggcgaaaaaaggaaaaatgaggaggaggaggtggagatggattatataggggcggagaggtcgggaacggtcgggagtggctcgatttcgccgaagtttgcgggggaagttgggggaggggagagagagagagaggcgggattcgaattcgaatcccggccatcttgcaacgtgggcgcgagcgggagtgggggcgtgggtgcggtaaaggcggggtgtgcgggagtgggggcgcggggaaggcggagaaagtgggcggcgcggcggtcgccggcttggggagcggctggaggttggggaaggggctgacaggtggccccacctgtcagcgcccgagggagagagggggagtcggcctggccttcgggaggaggagggaaaacgggccggcccggtaaggaagggggcgcgggaggtgatgggccgacggcccaacaagagagaaaaagaaaaagaaaaaaaaaggaattcccagggattaaatattgcactttgattattctaatgggttaaaattatttccaaggctctgaaaattccactaaaaatcctgttagcatattttgacatgtagaatccaagaaaaattccacatgtcgattccgtttattaaatgcatttattaattaaagattcaactctaggttaaattaaatcatttcttcggaggattcattttaaggattttaaagcaaggaggggaacttcagggtgcgacagtactcctagcccccagctgcttttttggaaaaaccattttccacaaaggcaacttaaatcttataacgaaccaagctgaggatggcaaatcctagcccccagccgtgaagttgggaaaaccaattctcgattacacggcttagttaatacacatccagtgagcactctgacatggtcgtttggctctgcagcatctaacaaagccttatcaactctgggcgtccctagccgaaatccccttaggtttctcggaggctctgtcagaacagcgtaaaggaacaataggactgacttcaagacgaggcgatgtaagaaaagaggatcaacggacaaatattgtacatataaacacttacagaaattgacgtagatgatgacacaacaagcacactaggcgaagaccaggtgtatggttgtacttaacaaattgcataagtagtgggagaatcgctacaccgttagtcgaagtccagttatagtcataacttggccatttgaagagaatccagagtaacagtgtcacatcctgattttcgttttaggatttataaattgttattagaatttatattaattattcattaatttacaagtgaagttaaatttgggaaataaaatttcctaaatataaagctttgctgaatttaatttttattaaattctctgtggttaattatactctctggaattttctcggatttttcagagctcaattactaattttaataatacaaagagcaattcagcaattatttaaatattaaattaatcattaaatggtctgttcataattttttaaatacttatagtgttcaagtactttctgaatttttcttgaaattattcgagaattggaagtatttttaacaattcaagcattattttagtgattaatttaattggaaaagtaaattaaattcccttttccttttcgtgctgaaactggaaaagtctatctgttgtcctcagcccgtccttcctctttgcctatctctgcttccttcctgtctccttcttcttcagggaagtctatttcttttccctttcttcttttcttttcggccaagcagaaagtctactattcgtccccgctctactgttcatcttccagctccagacaaagccaggtctccttcttcttcggggaagtctatttcttatcacttccttcttttcttttcagcccagcaaaaagtctacctctcctgcccacgctactgttcatcttccagcgccagacagagcctgagccagccgtcccgagcctgtgcatcgccgcctcctccatcaaatccggccgatagtgtggctcatttcgaaaattggttgaggggaaatattcctcttatcctcctctacctatggcccccaaaatctgactttatccctttgaatccggcgcgaatttggattcattttcgagtttatctctccgccaaaccctaggttttcccggcatggttccttgcgttccaagtaggaatccatctccccctctgccgtgcctccctcagccccacctaatcttattcaatcctcccctatataagccgtcctctcccctcctgtttcctgtttttgttgcagccgcccctagcctcctcctcctcctgtttagccgcctcctgcaccctagccgccgctgctgcttgtcgtcacccctcgccgttgtcgtcttggtcatcgccgtcatcttctccagtgagctctcctctctcccatgtcgtttaccggtgtagtttatccctagggacttaatctattctaatcttccccgcaaaaaaaaaatctattctaatctaatcttgtttggtcctagcgtcgtcatcatcatcgtgtgttgccaccgaatcgtcgccgtcttcctcttcgatcttccccggtgaggcctcctttccgttccctaggtttaatctttgtgtagctgcgttcatgtcttcgtgtagtcgctgttgtgccgctgccatgcgcatctcttgtcgtgtcgctgtgccactagatgccgccgcctcgctgctcgctgtgccacagctgctgcacgccgccgcctagtgtcgccgctgctgtccaagccctgcgccgctgccagagtccgtgccggctgccgccttgccacgtcggccgtgtcgcttgctgttgccgctgctgcggcatcgcctttgctgcgtcatcgctgccatgtcgccactgctgcgcctgcacgtcgtgcggcgttgccgtcgctttgccgagccgcttgtagcagccaccgctgtcgtgcatcgctaccgctgccactgtttaccgctttgccacagccatgcctatcgtgttgttgctcggcgcgttgctgccctagcccgtgcaccgtcgctaccggctgtgccgtcgccctaaccctagccacgtgatgttgcttgccgcttagccgcctcgccaatgcaccgtagccgctgccgcattgccggctcagccgagccattgctaccgctcggtagccgtcttgctaagtcgttgttgggtcattgccgctgccgcgccttgccgagtcgttgccgcaatcgtgccgctgctaaaccgtgtcaccgtcgctccctagccgctgccccagaccatgcaacaccaccgctatcccgagtcgtcgatgttgtggtttgttcattgcccgtagcccggtagctgagttgcaaagccgtaggtgcatccctaaattcctaccgacctatcgtttgtagtaccagggctttatcgtgaatcgtgtctagctcaccggtttagccgcagccatagttgagccgttagctcgttcgttcgaacgaggtgtttctcgtgtttcgttcgttcatccacgttgagtcgtcctttagtttagagccgttcagagctgccggttccgttcgctggtttcggttgatcatttgggtgatcccgtgtcacgtagaattgactcgttgaggttcgcttgccagatcaatccgagccatccgatcttggtcaactcggtcaagtttattctcagccatccaaaaatcaatataaatcctgttatcccttttcgatggcatattagttctttttactatatgtcgtttactaaattcgttccaataatttctggaggttgttttaatctttaatctcagttataaatcgtttgtaaattgtttaatcaatttggaatagttttttctttaataggctttaattggaattaattttgtaaaattcataactaattcatataaagtcggaatgaggccgttcaagtctcataattcatctaaaataatgatctacatgtttttttactttttatgtactgtttatttggagtttcttagtctttttcctcattttgtgtgttagcttgtcgtttccgttgtgtcgaaggttcgtgagtgcatcggaagtgttccagaagactaactggagaccgattattgcaaggcaagtcacacagatcccaaataaccctttgatcatgttgaacccgtttaaagctattgttttatttgaactcctacattattttcgaatgtcatcgggtggtgagcctttcccaattaattatggccgaagatgactttattttcgtatgggttataatttgattagcttaaaccttatatattggtttggttcagctatatgcttataatagatgcttagccatgcttagaaacaatagctcattaatgagataaatcatgtttcactatgacttatggatatttaatggtagctcacgatggtcaatcgtgattggttattaactaattgtgaactaaaacttgattaatggtgggttgtgagcacatggttttgatggtcgtgctcataacaattaaggaccagttcacgagctactgttgtgagacattaaccatactaacgacaagtcagaatgggcaacggctagacactttgtatagcaaggctcattttggtgcgccagactgtgaagcggcgagaagtccgtgggggtcgctgtggagtccatgcgtctggttttttgagggggtgattatgatccaggaaaggtgcactgctttgagttgagctatgtgaggggtcttgtcacaactatacaaatggtgacatgttcagcatgggcacatgatgatatggtgacatattgtggagttgtgtcttgtgggtaaatttgtaaacctctggccagagtaaaactattcgaatagccgtacccgcggtcatggacgggttgagcaatgtttttcatgattagtctaagacctctcacgataattattgatgctataactaataataatttacttagctcctggtttggagttagatctgtacagccgggtatggttattcaggatggttgggcctgtgcagcatgggtgtgctgttcagtgtttttttttaccggaattactgccaaggctttgcccaacattgtaattttataaagattgaaaaatatttacaaggttacagagttacaagaggaaaccgcaagaaagactatatggtttgtacccaattaaaaacaaattgctttaagggatccttcattctgcatatatgcagaagaacttctttgacaaaaagtgatctctaggcttggaaggagggttgaacgttttgaaagattaaaccattcatttgcttccatatgtgccaagctaccaaaaagaaaatctccaggaagcccgtctgagcaaacttgattcttgctagggcgatcatttggaaaaactccaaattatgattccactcaattcccaggtgctgccaacaactgatactgaacggacaggagaagaaaagatgtaaccttgtttctctgcaatccgcattgcacaaaacacatgtgaggtcatcattttctttggcacaatgtcttctatccagcatatctcttgtgttgagtctgtcacagaacaggagccaagcaaaaacttttatcttcatgacacattttgttttccacaaccaaatcatgggtctggagggttgtaacgcagaaaagttaagcttataaaatttcttagctgtgtacttgtctgaaccccagataaaattccaagcatcccccattcctgactgtatgttcagattgatgtagctgcaaaaattcaaaataggccacatctgagaggggtagggtaaaagaatcttctaaaggtcttgaacacatggctttcactgaatcagttttatacatggtcacagcaaaaagattggggtagctagtgcatttaaaatcatcattccatagatcattccagaaaagggcagttgttcctgtcctgatttcacatttggctattcccttgaagatgtctgcaagagatgtgatatccctccaccaaaatgaatccttattcacgatcaagtgtggaactttagaatcataatatgtttgtgagatcagctttactcagggtaaatcagcaccattatagaatttgaccatgtgctttaggaggagcgctgtgttttgaactctcagattgatcactcctaaacctcctttctctttaggggtgcacaccctgtcccaggaggttagagatttccttgtagaagaagggttattccccctccacagacagttctttcgagctgtgtcaatggccttgatgactagaactggtagctgcaataaggacattagtaggttgggattaatgaaaggactggattgatcaatgttaatcttcctccatgaggcagaaatatggagcatgctgtcagccttctttctatgctgtctactaacagagcaaagtccaccactctaggccatatggtgcccaaaagtaatcccaaagaaggtagagaaccaatcttacatcccagaatgccaactaacaattcaactttatcctgtcataaattgagtgggtacaagcctgtttagtgttgattaatattaatgattaattactctactgttttactactcctgaatgtttgctaaatgctgcttttgcaaatgagccctataatataccatccttttggtatccttgtgcacttgcatatttgctatgtggcttgcggagtattccatgtactcaccttgcaataatcaatcaaacctcagttgaagaaaaaggatccagaaggagaagacgtttggcttataccccagttgagctgcctgtgggagtggagctggagccatcgctagactgtttttccgctgctgttttctattcttttgtaagtatataacgttattattatgatggatttgtatattaaattgtcagtttgtgtacctcggctgattcttggacgaggattttatgcacaaataagtccagaaattaccagtgaatttccgggcgtgacaaacagatggacggcgttctcgtgacctgcaagaactgcctcctgacgatgacgaagtcgatgagggattatcgtagtcagaggttcaactcccggacctacggcctcaacctcgggccctctggaagtcttgggatctggagtttcgtcgtcgccatgtgatgtcatgatgtcgttaaccttgtccgttgtcgccctaatcttgttagtcctagacgttgtcgtccgggtgactacggcaatcctgtcagtctcggttgttgttatcatgaccatgttgactgtcgcgttaggtgtcaaaagatcactacgaccatctggttgaaaacctggagtaggcatcgctcgatcaccttggggcaactgataagcatatggaaacaaaccgtatccacaaaggcatctcttgttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttatgtcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatacacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaaccgctttgtaaaatatgatgagtgatatagcaaaatagctataaagaagcttgcatattgtgaataaagaaatttccaaagtattgggcatacgccatgcgcacactgctttaacagatgtacttaagtccctagaagacacatggtttcaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcgtgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcattcggcatggagatgaaatgaccaacatgaagacgaaattgctcatcagaagtaacggaagatgtcagtggtagtaaagatgccgccaatcaaatgtaatgaagttgcataactatggaggtgaagaaaccagtcggcaacagtcaggtcagctagcagtgaagatgtaggcgcccaacaacaacgaaagaacagtcggtggtgacaaaagcaaaccaacgatgaagacgtagacgcgcatcaacggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagagacttgacaggatgttgatgaagataaccatgtcgttgatccagtcaatagtaatgtagcagtccatgataacgatgagatcctctatcggcagttgcatagtaggccaaccgtgaagacgaaataacaagtcggcgatgaaagtcggtgatgacaaaagtaaccgacggcgaggacgtagtcaccccttagcaacggcggagacgtcagggccgatgaagtaaacgtgctggtgatgatgtcagtgacaacaatccatcaaaccattgagaagatatcgaagcttgagaagtttccttgatgtgagcgtgtgcataaagaaaactgatgcaatgcttcttgatttacgaagatgactgtagaacttagtgttacagctgttgtagatgcttcacttggaggaaagtagatgttgttgtccaactcgtctaaaccgagctgattggttgataactccaaactcccgaacatgtagattaaatcttgaacttgatacttgagaattttggagtagattatggcagcgctgagtagatatgggatatccataatctccaagttgctgaagtagaacatctgctccgaagcaaagatgaagataaagactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccataatgaagtgaacacaagtcggcggcaacagaagcaaaccggtagtgaagacgcgtagttgtgaagataaaagcaccaatcgacggcagcataatcagtcggcgacggaagatgatgatgtccatcagtagtggtagctgtataaaccagacgtagaggtaagggcactagtcagcagcagacgagacgaccggcaatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggcgaaggcaagccggtcggtgacgacgtagacgcccaacaacggcggcataaaagaccagccgtgcaggcggaaacaccagtcggcggcggcgaaggcaagccggtcggtgaagacgtagacgcccaacaacggccggcataataggccaaccgtgcaggcgaaaacaccagtcggcggcggacgagccggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccattcattggcaaaccaaacggaaagtataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggtcagccgtgtaggcggaggcaccactcggcggcgacggaggcaggccggcggtgaagtcgtagacgcccaacagcgacggcataataggccagccgtgcaggcggaaacaccagtcggcggcggcgaaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcagaaacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaggccggcggtgaagtcgtagacgcccatgaacggtggtgtgaccaaccaaccgtataggcgaggacaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcatattaggccagccgtgtaggcggaggcaccactcggcggcgacggaggcaggccggcggtgaagtcgtagacgcccaacagcggcggcatattaggccagccgtgtaggcggaggcaccactcggcggcgacggaggcaggccggcggtgaagtcgtagacgcccaacagcggcggcatattaggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgttgttgttatcagcaatggcggtggcgaagacaagccggcagagtggactcgcggccgatcgaccggaaagctgagacgcctcgactccatgaccagcattaatcgcctcaatagtgccgcgtaattatatgcgaacaacaacaaaaaatagcaagagattaatctgagattaaaaatcaatatgataaataatgataaaactaggcgtccggcgctggacgagtagttagcatgagcagatataaaaaattgctcaatggaaaatattacataaaaaggaaaataaagacacttagctttgttctcagtgtcctcctccgtatatgtgttaatggatggacatgggatcatatcggcagcttgtgacagacatgcactgtatgtggaacatgctggattataccgaattggaaaccatctgtatgtgcagtatggcttgtgcttgcatgctgcgtgctatgcgtgcgtgagtccgccagccatctgggcaagatccaacagatgccgactgcttgcatcaatataatggcaatgtgtagtggcagtcggacatgcaaatcctgtcacgagtcggtgctgatggctgagttgctttaattagtcatggttgatcagatcccaagtcggagaagattttggaaataatcgtcgcgacggtcgcgtgggacttggcttgatagtgatcaggttcctccgatggcagggcatgtatttaatggatgatcttgaaccggtgatgtcgaaaactaaatcgtcgaactcccagagattgatctcagatggcagggcatgcaacgacgcaaaccttcgggcgtgttcatgcaacatctcgactgatatttcttttttaagattaatctgaccacaggatggtgtcgacgaacatggcgatgaccagatgagaacaaagccgtcttgagccttcccgactgatttgaatctgagtcagagagaacttgttgaagttgtcggcgacgaggaagcgaaaactcccaaagcgaaaacgaagtcggcgactcatgaagttgattccatcgcactcgttgataggaaactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttatgtcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacacttgttatccacgactccccttatcaatatttgtcgtactcacttggtcgatcccggtgtaagaccgtagagacatagagtcctcgacaacgctggatggagttcaacggtccacaagtgaatttaaactgatcggcagcgagacgtcgctacaacagtctagtcattaaccaggagcaagcatctctcaatcacctataggggcgctagagttggttattacatgtgcatctcatgtggccagcatgactcacatacccaacttatagcatattcggatatctgttcacaatcatgccgggtgatcaagccgacaacgttcgcgaggaattatccgttaaccaccaattttcaaatagtccagccatggccgacgcgcgctatacatgagataggtcgtcggtctccgttggtaggttgagagcgacaactcagcctttaccgagaacgttctcgataaaagggtgtactcgaccacaacctactcgagtgcttgattgttcctgaaaaatattttgtagaagacaagatatatagtagataaaatcgagtgcgtactcaaaaaactgcatgaatcttgtagtattatcaggatataaggagcaaattaaatatcaggcattatgtaaaccataaacaagcatgatttatttaacaggaacaatgttggtatttcttacaatcacagatagaattcgcaagcgcacggatataccgatgtagcacttcccctacggagtattccaagggcatcgaatccaagggaacatgtgtgattatatcttcctccagttcatctaaggacacaagataaatatgggcaaagggtagagaggatttcctagtgagaaacaatgtctaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10708 - DNA, 838 bp, Oryza sativa
cggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtggacgcccaacaacagcggcataaaggccagccgtgcaggcggaaacaccagtcggcggcggcgaaggcaagccggtcggtgaagacgtagacgcccaacaacggcggcataaaagaccagccgtgcaggcgaaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaatat

SEQ ID NO: 10709 - DNA, 321 bp, Oryza sativa
tttgaagcatttgttgctatctaaattccatttaaggtcgtaccttatcgcccagcatcatcttattctctatttgtattccctccatctttcaaatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttata

SEQ ID NO: 10710 - DNA, 741 bp, Oryza sativa
atgaacggtggtgtgaccaaccaaccgtataggcgaggacaccagtcggcggcgacggaggcaggccggcggtgaagtcgtagacgcccaacagcggcggcataataggccagccgtgcaggcggaagcaccagtcggcggcgacggaggcaggccggcggtgaagtcgtagacgcccatgaacggtggtgtgaccaacctaccgtataggcgaggacaccagtcggcggcgacggaggcaggccggcggtgaagtcgtagacgcccaacagcggtggcataataggccagccgtgtaggcagaaacaccagtcggcggcgacggaggcaggccggcagtgaagtcgtagacgcccatgaacggtggtgtgaccaaccaaccgtataggcgaggacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggctgaggcaccactcggcggcgacagaggcaggcccgcggtgaagtcgtagacgcccatgaacggtggtgtgaccaacctaccgtataggcggagacaccaatcggcggggaccgaagcaagcccggcgtgaagtcgtagacgcccaacagcggtgggataataagccagccgtg

SEQ ID NO: 10711 - DNA, 218 bp, Oryza sativa
tataggtgttgtttttacttttggctccaccacttctcctatagcaaaaattccaccaccatttgtggaatcaaggcaatgagaaaatattttctttgtcttccctgctgcagccaattgtgatagcaatgtctgatttgaattgccaaaaccaataattccatcaatcgctagttctgaattgttaagcttccagtttgttgttaaccacacctaga

SEQ ID NO: 10712 - DNA, 580 bp, Oryza sativa
acaatcgtgccgccgctaggaaaaatacattcttgtacagtatatagattgttcccaacacgtgcatgaaaaaccctatcatgtcgcgccatgataggatgttgtcttccaagaagtagcaggtgatgttgtccgaacctccagcatggaacatcagcaatgcggcccaaatggtcaccagctgcacggactgggacgacggtgcgctgccgcggatggaggacagcttgccaagcgcgaacgtcggggcccaattagccaagtggtacgcaagccacaggaccaacgtctccatgcctgtggctttgcgccggcgaacatcgccgagaaagacgaggaggagttgtgccacgaagctggagagtattgccaaccggatcatccacgcattccagaagagctgcaagccaatcatccatccaggcatcgcggaccctgctatagtgaatgggtacatgttagtccgcaaggacaaaagattaacgcaaattacatgttaagagatcaaggacaacaactgatccaggatatataaaactgaatgaatatccgttacacctcccagtataatcactgatca

SEQ ID NO: 10713 - DNA, 727 bp, Oryza sativa
aatttggggtgaaggttgcttcttgcagacactgaaaagtaaaactaacatcaattctagttgcttctattatgatagaagttatggcattattacttagcactaaattctaattaatggtgaggttgcattcttccatattaccttattggggtttgatccttcctaaatctgttgcctaaccatgaattagtcatctacaattttacttaaccagaaacatgcttaaatgcagttgttccggacagaagcttgttcacattggagacaatgcagatgcttacaaagttgagaccatttgtccgtagatttttaaaagaagcaagtgatatgtttgagatgtatatatacactatgggtgacaaggcttatgcaattgaaatagcaaaacttcttgaccctgataatgtatattttggctcaaaggtgatttcgaactctgattgcactcagcgacaccagaaaggtcttgatgtggttcttggagatgaaagtgttgcagtgattcttgatgacactgagtatgtaagtgcaaataatccagtgaacatggttgataaacattttatatgataatactgccagtaattaccgtctgtagtttgttagaactagataatgtttactttggccactgaaagttagaaatggtctctgactgtgatatgattgcttctacacagcagtagaaacattcatcctgtattgattaaatgttgaagggctg

SEQ ID NO: 10714 - DNA, 717 bp, Oryza sativa
  unsure (1)..(717): unsure at all n locations
gtggtgttcgtgaaccaaaagacgccatgttagacagacaggtacgcgcttctcggtctctcacttgtccaagggcgagaaccgtccagttgggtatgcgcggctttaagcgctcggggctctgtgctcctcgcgcttcggtgttgaacggtcggtgacggcaancaaattttgtccccattgaacctgtagaggttttactgtttgattgggacggttagatgggtgctcgagggtcttcgctcctgttccgcttgaattccgatggttgctgtatccatttgtgcgaatgctgatggcaacgaatttgatcatcatcgcgggggattttttctagggtttattgaagtccgtactgttcatgtagcctgcacttcatttcattatacctacaagtgatttgcttatctgcaattgtgaaattgtgaatgacagtccatccaaatagtagatcccatgagattgctttctacgatttgaatagataccacaacttccttagttctggtatggtatgaaaattttctcatttgtggtagcttaattgcctacctatggctttatatgctgaaggcaggcaatacgtattagcatatgttgatcctataataagctggccatccaaatatgcttacgctgtagtaagaatcctatatgttggtgaactaaatgcgctatagttttaaggaaaaattggttgtatatgatgggctactg

SEQ ID NO: 10715 - DNA, 567 bp, Oryza sativa
agaagatagcatcagttggcgttataacaggccagccgtgctagcggtgacatcagtcagtggcggatgcggcggccggccggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccagtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtggacgcccaacaacagcggcataaaggcca

SEQ ID NO: 10716 - DNA, 9290 bp, Oryza sativa
tatagaatactcaagcttgcatgctgctggcggatatatatttgggtcgtccaaaagtttaatacagtatatatgtagaggcaagcacacagcatatatatatatatatatatatatatatgctgcacacctatgtatagcatgtacatacatacgtacgtacgtatatatatgcacgctatctctcgacgtacttattaaacacaaactacagcggagaccttcccgcatactttaaggatgtcggggattttgaccttcagattgacgagagcattaaccttgatggcttcgcaaaggcagacagcagcggtgtcgctcgggaggctggagagctgcgagcagcacgcctggttcaagagcgggttgccaagaccgacactaatgcacgcgttgagattaattaacgccagcggacacttgggaggcggcgtcggagatggcggattgacaggggcaacggtgggtgaaggtgttggtgccggcgatggcgtcgggactggagttggtgcgggcgtcggtgtcaccaccggggctggtgctggggctggagttccagtcggggttggtgccggtgcttggcatgggtttagctgtccattcacagcagaagccaagaccacaacaaccaatgcagagaacaaggcagagttcattgcctgtttgcttgccattgttgcctatgtgtgtgtgtgtttgatgctcttagggtatgtagccttgtagtatttataggcatgtagcttgcaagttgctgcagcttaagtcaataaaaaacggaaagctttttgaatttcggtgcactgatttacagatacattgtccgtttttagtttagcttaactccacacacttcattctcttcccgtagtacaactcatgcatgccccaaacttgatctctgcacaaaacctcacatagattgcacacatgcatcgagtacattcggcaaataattttgaacatccaagaattctttttttgggtgaaacaacatgtgtgttcactctaaataaatgtgaagtgtcaatcctagggtggtgaaaataaacacccttttcactttcgtagaatgcaatactagtactagggttagccaggagtgaaaagagctggaggtggcctggccgcccccaacatcccaataaaaaaaaccccctccctttatagtcttttgcctttagaatactatatttttttgttattccctccatccaaaagtcttggttctattttattttctgggttttccaaatgagatgagcttatttgtagtctccatatatctaagacttaactgaaagtgttgtcttttttttaacatgctaaattaaattgttgactggaacccaagcaggggcggatccaagaacaaaaaaattggagggggggctcaattacacagtttcttcaacctccagccatctaggagcctttagtttattattcatggtgaaaaaattgaagggggtgctccgggggtatccatgggtcttgtgggtgtagaggggactcgagtcccccctgcacccacgttggatccgcccctgaacccaagcaaccatcttaatattcattggttgcatgtatgcatattgtttcttagttttgttacatgagggatgagggatgagtcaattctttttggtcttgatgataaaagaaatatgacttagaatttagggttagaaaggggtgtatagtagttattctaaagtcacgtcgaattggatatgggtgacatagaaccaattcaaacacggataacgtaccaaaattttaacgaaaacattttcaatttttataataatagagatagagattaagtacgaagggagatgaccatgtgaatagctaaggagtgagagagtggttgagagcgagatttggtgaaaattgaattaaggggtggtggttgggtggggagagtagttcttagtattccgagtaattgtatcttatgacaactgaagacaaatggagtaaatagtaatccatattgtcaaaatattttgcaattattcatattggttacaacaaactaggatatagacattgagtgcttaaaatgcttcccgccttgttccagtccttcacatttattttctttaagaaaaaaaaactagagtttacttcaaacaaacattgcatggggttgaagatagaccatgtgttatgtacaaaacagtaagagaaacacagagggactgcctaacaagtatacacacatgtattcaacaaatggaacgttctctcagagacattgtaggatgatcccaagacttttggctcaaaatccaatcaatgttgcgtgcggttgggggttggagcagtcggtacgtcatgacaaacactattgatcatatacattgctccctctcttgttcccctccattgagaaaaaaaatgaaaaaaccacctagaaattactttaagtttaacattccacgccataagtcattttgttgcaaatgctcacccctatactcggttttgttgaaaatccaccctagtgcacacatgcttgaccgaatcaatatattttcataaattgtgaaccgtcaatgtggtcttcacataatttaatacttctagaagaatagtcttaacaatttctttttgagattctacatatagaattgctaatgaaagcttaaaaattgctgcacctagttttgctatatgcagaaaaaaatataaagaataagtttaatgcaaatactaggacaagattgactcaattagcttaacctgtggtggctctacatcagtgataacaagctgatttggttaagcatatgtgcactaggatggtttttacaacaaaaccaagtatagggtggatatttgcatcaaaatgacttatgagatttaagtaaaaaaatgtcttatatatgagatggaatatcaaacttcaagtgacttttgatatgttcttttttaaattttcccttaatggagcgatcgaggttggcagcgaacgcacacaaggacctgaagaaaggttaacaccgcgcgtcacctcacctccgtcgttgatgcatgtacaaaacctctcacggtcaagagcgaagtacatgagaataccgggttacaccacagagaattggagtttcctcacttcttccttttctttttttaaaaaatcattatattaaacattaaaagtacagtacatggataaaagatacatcttcagccattaaagttgattaaagaacttccatagtaggataaccattatgatgatataagtaagaaaaattttgacaaactgttttagtagaactattaatatttgtccctagattttttttaaaaggtagtcagccatcttattcatttatcttgaaatctatcgaatattgtagctccacctaaaattgatttactcttgatagaagaggaaacaagctccagggataactggataaggtttagttatataattctgctatcttagaagtagtacgtaccaggtcctgattgatttgaaatgataagttccttacatatgcaaattgtcagattgatatacctgcaagtttagcttgaatacaagaggtataagaaaagattttgcttgaataaagatagccttgagagttatggagtcatgaatgaaaatgccaaagcctgattgatcttccatccgggaggcatcaacatatatagcatctattttcaggcaaaacattaatagagatattaggattatcttccagagttcccatatagtcatcccttgcttcaaagctcaacattttagtgaaattattagacatgacatctgctgcattacatataatatacttacataggttcccattcttaatttccttttaaagtaatatcattcctaactttccaaataaacccagagcattatagcatgattttacgtagtattatcagatttaacagttgctagtaagcaagctagaatgtctgaaatactttgcatgttatctactatgagagttgatattgtcctctcttctgttgatgaggctttggctagcatcagggtttccaaaaccgtcggggccagggttaccgcaccccggcggtaagcacggttaccgcgcggtaaccgcggtaaccgtgaaaaactgtataaaaccgtacaaaatttatcaaaaatttaaattattttttaaatttatttgaatttaaggaggttaccgcggtacttatattaccgtaccccgcggtaagcccggtaaccacggtaaccgtacggttacctacggttaccgacggtaagtcaaaccctggctagcatccactcaaggactactaaagtatatgaaattaactaggagaagattttgattggttgagaagtaaatctaggtgaaaatattattatagtttagaaaaaaaatttaaatgctagaagttattttattttagaatggatagagtactctacgtccggaagcaacaggcttgaaattgaataccccgggattagattaattccccctgccgtgaccactagccgcacgtgtccctggcaacgaaaatgctagtcctcacagttttcttgttttagaagctactgatataaaaatgttttgtaggtaaaaatttatatttgtgtttacaaattaaggctgaaaaattgtgtttccaaattaaggctgaaaaatatattatgataaaaaaatccaaaatcaatcataaaattaaattttgagtaaaatttaaaatatccacctttatcaagttaaagttataaagttataaaaaaacactactgggcaaagccccggtagttctttcagtcaaaaaaattatagaaaatcgtatgtatctgtggcacataaccacatgagattttataagtgttttataaaaccctacctttattcaaatctcgattaatttcagcatatcctaaacaataattttttcaaagtagtgaagttaaaatatcaacttaagaactcaataattataaaaaaaagagatcataattcatagacactatatttttaaatgtaagtatacacaatatatatcgaagggttttgtaatactttataaccacaatgccctaatgttatgtgccacaaatcaaaataactagggctttataccacgtaatttaactataaatatagggttctatgaaatttactgttaggttttagctgcaattgagccaaaaaagacaatattatagaaacgattttttcggacaaggcccctctaagttgtatatgggccataactgtcgtgcctacaaaattcgctcccctgaaaagcgaataatgggtcgcccgcatgcgaaaatactaatttttgcacatacctaggtgcatgcggacgtccaaccacatgctaagataggttttgaccgcttgcaaaaatcttttctgtagtagtgagaaatcactgctcgtacgtatggggacgctgccagatcgagaaaccatgtacaagatcacctataaatccaaaatttcaaaccgatgatacaaaccatgtttggatcatatacagcgtataacctagtgttcagtcttaggccccgtttggtagggctccaaactccaactcccaactctcaactccaactccagagagagctagctcctataggagctgaagtgggtatgaaagtgtttggctagattagttagctccgcgcaaatacgttccttgttggcatttcgtcgaacacctggttggcgtcgccttgctactgccgccgccgctcaacccgtgcgccgtcaccgccacccgcctccgtccccgccgccagcggtcagcccacgggtcgccatcgcagccgtcgtcacacgtgcgtcgcccggccactgcccgcacgcctaccgacgccgacgtcaacgcagccgacgccgacgtcgacgcaaccgacgcccgtgcgcctgcagccgccgccgttgcccgcgcgcagccgccgtccgcgtgcctgccgtaattgttcgcgcctacaaaattcgctcccctggaaagcgaataatgggtcgcccgcatgcgaaaatactaattttcgcacatatctaggtgcaggcagacgtctaaccacacgttaagattggttttgaccgcctgcaaaaaaattttctgtagtagtgagaaatcactgctcgtacgtatggagacgctgccagatcaaggaactctgtataagatcaactataaatccaaaattccaaaccaacgatgcaaaccatgtttggatcatatacagcatataacctagtgttcagtctggtggacatttacacaacaaagtactaggcaaccatgtttggatcatatacagcgtataacctagtgttcagtctggtggacatttacacaacaaagtactcctagctagcatatataggacacgcatagtctagtggacatttacacaccaaagtactactgtatatgcccatgtggagaagatcttccgtgttgatggagtgtaccagtgatggagtacccaggcacccagatccatgataacatgcatgtgcctaactcagctagtacatgcgtggggtttatgcgtatatgcatgcgcagcaattttctagcctgatttttcttatagtaattaataagaaattcggtaccattagtagtcggttttgcacgttaaaggcgatatacccatatagggactttctacgtacgtacactttctacgtccacgtgtgggtattattaaccggtagtcaaaaaaattctactcctattagtttgagatggttcgtcgttaggagcttctactattaagaagctgaacataataaaaaaaatttcctcacttgatcttttttgtcattatacagaaatatgagtatataccccggtctggcctaactagcccgacggtggggtagaggtgcgatcacactggactcccaccaatatgtctgagagtaagggatgtttggttggttgtgtttctttgccaagctacaatttagtcatgtcacaacttcctaggcatgtgtttgtttcgccgtcacaactatatcatgccacactttcttaacctttggccgacttttttttaagataatagaagctttattaagactcaatcaattacaccaagatggtacaatccaactgagccaacccccggcctttgtataaaatgcacacatctaaaaaggaaccataaaagaaaaaacctcatctcaagcacaggagtgtgaaggaaacataaaattagtggttatcaatccatagactagaccaccacccatgcacctagataaaaaaattactgcgccacctggtccaaacatcatgataccactgcaatagtatcccggtttgtggagtatattccaggtgtgtagccaccgagtaactaaagtaataacctgcaaaggagaagacaccattttgttatcaaacaacaactcattcctgcttagccaaatggaccaacaaagagctactgcgcccatcaaaagatgatttcttatgtctttaggaacacgtaaaagccaaagcccaaacatataagttacatttcgaggagattttaaatttgaagccattcgaataatagaccacaccaagcaggaaagatgacattggaagaagaaatgttggatggttttgtctttatgacaaaagcaacactttcttactaccttgcccgacatgtcatactcttaaacttgtgctaactatgccacacttttgaccaactatttattggccacattttttccactatgccacaacttggctaagcttagttataacaatgtaggcatagggatggtaacgaggctacacctgtcgggttcaattatcctattcccatccctattaagaaggaaatcaatctaccccatccccgcactcggggaagggtttcccctatcactgtccccgcatagggttcgaggcacacccaccgaatagtaggagtgcagcaggccagtatgcggcagccatggcgcactcctgccgctgctgcttggacgcgtcatagcatcaggtcttgcttggaggcaacaatgacaacatgatgcgtatgaaaccaatgtggatgcattagccatggcacgacgcgaatgctcagcatggatgtggcggtgcaaatgtttagcatggagaggacgcgatgaggaggcgtggatccagtggcacggtgcaaaggacgagacgaggacacgggttggtcgcctggagtcttggcaggcttgatctagagcactcaagaggaggggataatatgcctagggtttccttactttctatacgagggacttgtgaattgggcctctcctaagtggacttataatttttatatggattgtgcgctcaagcaatatgcacatatgcctaccatactcaggggctcatgggaaattagggacggggggctagggaacgtcctcgttcccacttccccaatgcagacatattttgcccgacaacaacccccatgggtgatgattttatcccatttacatgccctatagagtaatccccaccggggttcaggacccctaccatccctagtcaggcatcaaccaaacattccctcaatagtacacaacgctacgatataggcatctagataggatctttattttaagaggcatccttaatttccataaaacattattactctctatataaccattgttgatcaaggctaaatatatagaatggaccaaaaattaattaaccactgtgatgaagattccatctaaacatacttttattatcatttagattaatctgcacaatataagcaaccaagttatgccatagcacaaggttttgacccacaaatgcccttcaagatacattgtgtgtaacagaattcaaaacaattgcaattgatgcactttttctacgaactaacttatatagaaaagggtattgctccttgaaagaagaattatcaatccacttatcttcccagaatttgatttgttaaatccaaccccccctacaaatcactaatcattccaatctcctaccctcaacttaataaaatcatcgattgtatactataaaaaagtatgtattaaatctcatgcccaataagagaagacatagggaacaacttcgctcaccatgctagcgatgcacgatgggataaatcactagtacagatccttctatctgtgacgggctctaatatgcttagaaatagcgggccgtcacaaggaagtcatctcaatcgggccgaaaagtgcccgattgagatatggtcgcacagacatgttagatgggtataaaacttaagcccgtcacggatgacacctatcagtgacgggcct

SEQ ID NO: 10717 - DNA, 22976 bp, Oryza sativa
gcccgtcacagatgaccatcatttgtgacgtgcaccaacttgaggcccgtttgagataacaactaggcccgtcacagatgactcatcagtgacgggctatatacttaatctctatcgagcattaagagatatgtgttatatattattcacaaattttacatatatgtgttatagtttataaaaccagataagagatatgtcaattttgtaaacaatgttactatcactttgtcgtatgaagaaatgaccaaaataaaagttttagatcttgatgagttattcaactttgttgtggatgactttttcaattgatatcatttagtatttgaaaatgttgtttgaagttgtcatattttcaaattcaaattcaaacggttcaaaaaatgttatatagaaaaatgaccaaaataaaagttatatattttgatgagttatacaactttgttgttgatgactttttcagttgaagtcgttcactgatctaaaattctatttgaacttttcaaactttgaatttcaaatttcaaattgtttaaatagagtcagatggagaaattaccaaaataaaaattttgcacctcgatgagttctacaactttggttttggtgacttttccatttgaaatcatttaataaccccaatttgacatcctggcctagggcataataggattaatagaatactcataccaacatgttacaattacttttccggaagccaatctctaaagaactttgacgttaagtgtgcttggtctggagtaatttcgagatgggtgaccgacctttctcatctgtgacgggctataattaatgcccgtcacagtcacagatgactcatctgtgacgggctatagttaatgcccgtcacagataagggtcatttggcgctagttgtggcccgattgagatagctcttcacatcagtgacttctagcctgtgacggacgccatgcccgattgagatggggcttaccgctcgattgagatgagggtatccgttctagtgaatcactgagcacataaaagctagatagaggtggcacgttgtaagagaaaatggacctttgaggagtattttgtacgaaattaagctataggcgggagattggaaaggacggtgacttgtaggggattatttgggttttccaaatattaataatgaaagtgcacatacttaagaacttgtcttttcataagtcccgacaaaaaatgagaatcaccagacattttcacaacttgtataattgactaattatttacatatttccttctaagtaaactctgccaaagagcatcctcatttatcaacatgaaaagcttgactacaattgttatggtggagcttgagggctgcattggacaaattctagggtagcgaggcgagggagctcaaggatggcggtctgggattgggtgcacgtacgtgagagatcgagagccgtggccagcgcacaaactcgatggcggcagctgggggtgagagcttgagagtcgcgaccttggggagttcaatgcatgcagtggcttggcacaagggcacggtggtggccaacacaactgtggcaactgcggggggatcgaacttgaggttggcggcaatgggtgacctcatgccatgaggagtttgagggtggcagccttttgcaatctcgcagctgctaaaattgaactcaagaagaaagggggatcgatggagctggccggctgccctgtccatgcctgaactcgattgcctaagatggagatgaacaagctagtggaaaatggaggtaacattacaggtatttaacttctttttttttttgcggggaggtatttaacttcttacttttgaaggaaatgaaaatgaaggacacttcatagaaattcggacggaatgctatatggaggaacgttaaacttaggtgatttttggtgatattaaaatggtttagatctttcaaatgttatatatgtaattaagcttataacttccggcgctacataactaattttgccctataactaacctacagttgacctgacccagtaatgatcagtacaccaaaaagaatctacaaatccagtcatctgttgctttttcatgaaatggtggatgccatcagaaaacattcatccatctatataagcttattatatatagtaattcatcagtagtaatttctgttccggtaatggtttgtgcgtccacaattagtagcataacgggaaaagaaattacaaatagtactgggtcaccttgctagttaatcggctatatattacaaattaaattaattagtaaattgtacatcccttaattagcttgagcgtccattacgtacatcggttaagttaatacgtaccacattaattaattaccgacacattgagcatttgatttgagcagctatagtagctagctagcacctcagcgatgcatgcatggaaccatatggatcatcactattcggagcttggaggtgcaggagggaagctagctgccgcaccgccatggcctgcaaaaccttgctgcccttcctcgctgaagctgccggcggcgccctggtccacatccggcgctgctccttgctgccacgccgggtcccacgccggaacatgccacgccggcatcatcggcgccggctgccccatcggcgggtagtagtacggcagccccgcggcggggccggccgctccaacggcgccggcgggccctcccgccgcgaacccgagcgcgctgccgggctcctccttggcctcctcccgcggcacgatgtcgacgaggaagtcgaacacgtcggtgcgcgcgatggcggcggcgacgtcgttgcgctgcagggtgcggcgcttgttctcctcggcgtgcagccacgagcggatggtgagctccaggatgaagagctcgcacgccttggcgaacagcacgggcgcctccgccgagatcatgcgcacgtcctcgtccgccttcatgatcttcttgatccgcgccagcggcagctggtggttcttgaagtccgacgccgacgcgcgctccgcctcctgccgctggtacgcccagaacgcctgcagctgcgcctgctgctgctggagcaggtggtggtgcggcaccgccggcggcccgcccgcgccaggcacgcccggcaccggggctccggcgcctgcggccgccggctgaccggcgtagggtagctgctggttgtccattgtcacctatatatacgtaccttaattacagtcgatttgtagctgtgtgtgctgtgtctgcatgggcaaaattacggcgattaatttacgtgctaggaacgaatgatcgctacatgctccacgtatgtaacaatggctagctatacatgcaaagtgtaaacgacgcttgtaggtattgtctgtgagagatcgaaggattgataagcatttctcaatatgtgtgcaaactgcaaaagtaagtagagattaggagacgtactctagagcttcgttgctccacatgtgcgacggatcaaacagatgagaactcgaggctggctataggtggcgaagtgcatgtgtgggggctacttatcttctatccagagatcatatcatgcatgaaaatgaagctaagcgcttgcaaacacacagggtgttcccaaaggagatctggaaggagagaaacaggagaatcttcgatcacaatgagacctcagtgcctggtctcctcgcagaaatgaaggaagaggcaaggatctgggccttggcaggagcaaagctactcctacagctcgtacactaaactgcttttcctttttctcctttacccttcggggttgtatttcttactgctatatattcacaatctcgtgtttggttccattcaaaaagttagttatctggtatatgataccagtaggatttgacgtggtccgacatttcttaatttcatatactactagatgtttcttatttttcagagatccataattttcctaaaccattacagatctcaccgaaacaaaagaggatcgaggccggatgacttcagaataagtcgatcatagcattatgatggctaaggattgtcctttcgttcaggaaaagtacaaaatcaaggaaaatgcagatagaacatagaacagtgatgactgataagtgaagagaactagctacttcgatgatcaacttacaaaaagctctagggagccagtcaacaagctgttttcgtttatgtagaagagggggaaaaagaactctggtttgcttttctagttcaagaaagaaagtgaaggaagaatagagaagaatgatgcagaagttgaagacactgcaaatgtaacagaattgacaaaaaaaaagctggaacaaatctaactatccattagaaaaaatgcaacaatagattcacgcatccatgcatgtcgatctcaactagttaattaagttcttaccagaaagcaaaacaggctagcctgtttgagtgaacgagctctactgcttcagatatccaaaagtatcagggtaaattaaagaacagcacagcaaaagtatcagatgcttcggcacgcatggggatcgatcgtcaggggaagcaggagtgcaggacacactcctcaccgtcctacccactgcctagtgcctgaacaaaatggccatctccactctcaactggggttcttgccttcttgctgcaattaagctgaaaaaaataaaatccatgaagtggacggagaccttggatatctgaagcatgcacgtcgttctcaggctctcggctgcttggaagctagctagaaacaattttttacagtgttcgctaatactttccactcctgcagtactgtcagcataatacccagtaaaatcgatgttactctgaaagttttagccaaaaagaacagtctgaaaagggataaacacgttgtctgcaccgtgacactgtccgtgaaaaccgatcaacgggggttgttgttgtgttgtgatttgttgttttttttggcttgtacctgaggataagaaaagatgaaggggagatccgggagagcgcgcattcgtggccaggcttggtcttttcggatatggatattatccgttctggaagtctggcagcctcacaaaattctacgcttagatttggggacgactgccccctgctactgctggatgcggccgatccatcgccgaaatctaaatctgcagcatggccgactgcacgttatgatttctggcgtgtggggttcacgtatccaaccactgctgatgaacactgaacagtgccacacgaggaaatatcttagcatggatgcatgaccaaacagatcagagatttaaatagtactactgccactacaccagaagcttgatgaagcagacactcagacagtcagacttcacagtcatactgttgtgagagatttttttcgcatgtgaaatttcgagtgtttctctaggtagtacgtagtacggagtagtaaaactccatgattgcaaagctgctgtaaataacctgtgttacagcttttcataagttttttctgcctacaataattacagtttctttggatcagcaaagagatctcatagttgatcacaccgtggtcagcttaaaatatgtagcatatgttcccagctcccacaaaaaggaaaatttctagtagcatgtttctgggccatgtttctggaaaagtacaatgaacaaagtcagaagtataacacaaccatgggcttaagtttggacctttttttgaactttaagttttgggccttaggcccaagtgaaaatgtaaattagcctgtactggaacctaaaacccaaaggaaaaagtacactgaaggaccctcaacttgtcattgagttacaaaatcatcccccaaccacaaaaccagatatattacatccctcagcttaacaaaaccgtttactttagatccttcggtggttttgaccccagttttatccgacgtagccgctgagtcagcgggagacccacgtggccccacatgtcaggatgccaactcatcacctctctgttatttcccctcctccccctttctctttctctctctccctccttctgctccccagcgtcgagcaccttgttgcaccgcacgaacaccggcgggatcaccagctccagctctgcatccttcgtcttcacgacgctcctctcacctgtcagctcgtggatctcctcgtcggtggtgaagagtcggtacaccgccgctagcctcgacatggcgctcatccacagcccgggcttgccgctgcccggccacagcgcccgccagttgtcgccgcggtactctagcctcccgtcctcgttgtcgactggctcccccgtccggatgtgcctcgcaaccacgcactccgcggcgacttggtgcggagccgacgaggaatggggtcgacctacagccagagcgccgccttcctccacaactcccgcagcgagagcacacgaagaggaaggaggcggggaggcaggcagcagctcgttcctcgtcgtcgtcgtcgttcggcggcgacgccggccgccggacctcctccccccccccggcggcgcgcggtggaggaagccgctgccggcgacttcgcctgtaacaccgccgccgccaccgccagctcccgtcgatctcatcctccacgccgtgctcaaacggcggaggatggggcacagtcgtgggcggcgcgcggcgggtgctgacgctcttgggttgccctggctattgctcccagacgaagggcaccatgccggggtggcggacggggccagagttgaggtcggccttctagtagtggcgcaccgaccggagtggtgtgcccaggtcctcagcctccgcctcgtcctcccgcgcctgccctcccacgtacgccggcacgccgccgtggcacgcccgtactgccgccgccacaggtttcagctcctagcgcagacgaagacaggcggtggtggggaagccgcggcttgcgccggccgcccgcgcgccgctccgttgcctgccgcccacgcgcggctcctccccccaccgcctacgcccgtgcagctgctccctcgtgcggcacccgtgaagaagagaggagagaggaagagagatggagaggggaggggaagaagaggctgacgcgtggggcccacgctgagtcagttgccgtatcggacaaaaccggagtcaaaaccaccgagggacgtagattgcactggttttataagttgggaaacgccggatatctggttttgtggttgggggatgattttgtaactcgatgacaaagttgagagaccttcggtgtactttttccaaacccaaacttacgcccaggattgtgatgtacttcagactttgtccattctactttagcccaaaaggttgtccctcccatttgacgggctatgtactttctacgtgtcccggcctgttttgagtttgtgatcgacctgacccgtttagtgacatgctatccacaactctgataccactcggccccacatgtcggtgacgctgctacctcccgcgaaacccagacgcttcacgttcggatccgaaagcttcgcagcccggggcaatcacgaactgccaccgcaccgtcactgacatcctggccccaccccgtcaggtgggggcccacagcccgcccccccaccggtgccccgccgcgccacgtccccgcataatagcacatggtcgacaaccccccgcctgtctccccgttcagcgagccagagaggaaacgaaccgatcgatcaggccgtcgctccgctcgccgccgcgcgacgcgacgcgacgcgacacgccggagacggacgacgagcgctttgccttccccgcgcgcgcgcgcgcgcgcacggaggcggacgctggtcggtttggtcgggtgcgaccgggaacggcggccatggcgcgcggcgggggcggcgggtgctgcccgccgatggatctgatgcggtcggaggcgatgcagctggtgcaggtcatcatccccacggagtcggcgcacctcaccgtctcctacctcggcgaactcggcctcctccagttgaaagacgtaagtccgtatatccgctacccccgtcgattcggcggctgttcgtggctgacaaattcgccgagagagggagggggattcggagtggtgcctgtcccgatcgtgtcgatctgaggcgggggatcggttggtagtgccccgtgctcgcgatttcctgggaattagcgggcgtttcccgtcggcattgtgaatttgggcattgagattgatgtggtgttacggcgtctacttgttcgcttcactttttttcgttgaaaaccgtgatattgtttgcttcactttttttcgttgaaaaccatgatatgcaggttttgcattggcgcgattgggtgacaatgttgtttggaacagaattcacgtagggatacattattctaatttcgatgcagtacagagttgtcttctctgtaatgcgcccacactagcaatagcaagtttaaagttacttttactctgttagactgttagtataaaattgtactcctgtattagtagatcatgggaaatgctgatatagtttgaccctcgcaattctggaacaactcaggatgctgcctttgttttttgtcctatcccttagaggttaaactgatgattttatttttttttcctcagcttaacgcagacaagagtccttttcaacgaacatatgctgcccaggtactttgctcgtttatcttttttttatcacttatgttatgttatggctgagactaattgataaaaagctttttacagcatgttgaaactgttattctccccttgttcttatatagccctttcagtaatgaactagagtattatctattgagatttaaaaattataagatgtgacattggtataaatgaggaaaaagtccaaatatccccccctaaactttgaatgaaagtccatctagtacactaaactttaaaaccggacatctaaccccctgaactttgtaaaactgttcatatttctatctaaagtttaggatggtatttggactttttaaagtttagggtgctatatggatttctatctatatagtatatctcatgttcatagttttcattaccttactgccttatgttaattttccctgttttcatgctgggatctactcgttgtgcagataaaaaggtgtggtgaaatggctcgcaaattaagatttttcaaagaacaaatgtccaaagctggcatatcaacttctgcacaattaactgaaatttcgttggactttgatgatttggaggtgtgtcaatcgaatggatttttcctgattgcatgcagaatataaatctagtattattttaacacttttgaataacagataaagcttggagaactggaagctgaactagcttgagttaatgcaaacaatgaaaagttaaagcggacctacaatgagctgttggagtacagtactgttcttcaaaaggtatgactctgttatcttcagtatactttcatgaatattgtcaacatcatgttgaacttgagatatagcgtgtctgttagatcttttgcaaaccacttgtttccattcctggttcctcacattgttgccagaacaatactatatgaaattgccactatcttaactccaaatgatttcacccatggggtaatgtgcacatatttttacagtacactctctctcaagtcatggtcgtactacacatgtagtacctaagtagcctgtttctctcgccaatctgctttttgctgactctttatttattattattttctttcattttcaggctggtgaatttttctattcggctcaaagaagtgctgcggcgcaacagagagaaatggaggcaaatcaatctggtgagagttcactggagagccctctgctggagcaggtaaaactatcatactgctcctccctgtacatggacattcatgtagtaccattgccatgatgtgcctcaagattgatgttgactttcaaattttaaacacacaacatcccatattgtagtaataactttaatcattcacaaatctcagagcactttggatttacaggatagtacatggaccatacatgcatatacgtgtgtaattgcaacccccaccttttttttttgttttctgtttgcctctctgatatgatcttggttacccttttaggatacgttaacagatgcatcaaaacaagtgaagcttggatcattgagtggtcttgtaccaaaggaaaaggcaatggcttttgaacgcatcttattccgtgccacgaggggaaacattttcctcagacaagagtctgttgatgaacctgtcactgacccagtctctggagaaaaggttgctgttatattttctgacgtttacagtgcattttttgttctttgtatattccaccatgttgtcctttcaaagtaatcttggtatttggattatacatctcggttcatttgcgccctgataaaaagaactttgttctatgagtgatgaagttattttttatatatcttacttcctgtctagtcatgaagttattttattatttgttccaactctaagtcttcattctttgtatgataacacaggttgccaaaaatgcatttgttattttctactctggggatagagcaaaagccaaaattctgaagatatgtgatgcgttcaacgcaaatcgctacccatttccagaagatgttgctagacaattacatgctgttcaggaggtcaggtcttggaaatgtgatttgttaatattctttgatgaaattctttctagtatttcgaaatttagatatagtcctgaattgctttcagaaggtagtgaggatgccaaccgttgagagaatcatctgcacgagttgccctttatggacattcttgtgctttgcttgtgatatgtccaatgttaccatccctattctgatgtcactgctgtcatttcaatttcgaatttgaaaaatgttaattaattattatagatttataatagctagactttgttctgtgccttccaatcattacttttgctgttggtgactaatgaaaatgatttgctgctattgcatcttgtttgcaccataaggagatatgtcattgggagaaacttgttttgcagttgtactactatgaatttcagtcaataaacatataaagtctatgcttatgaatttacaggtatctgcaaagatatcagagttaaaggcaacaattgacatgggattagcacatcgtgacaatatattgaaaaatatcgcgtctgagtttgagaattggaaccgtctggtaagctatcctcttatgtgataaattccatatgttagaaaattccgaaatccaccagtcaggtcattatttcagttctatatatatgatactaattagcatacaaatgctccaggcaaataaggaaaaaataatttaccacactttgaacatgttgagtgttgatgtgacaaagaaatgcttagttggtgagggctggagtccagtttttgcaacaactcaggtaattgatacaccaccctggtgctaacaatttattagcctactgtttccatttgtttatttgggagattattcttcatgtgatctcaatgatttacaactttattttgcagatccaagatgcgctccagcgagctactcttgatagcaaatcccaagttggttcaatttttcaagttctcaacacaacagaatctcccccgacatatttccagacaaataagttcacttcggctttccaggaaattgttgatgcatacgggtatgtttcagagggctctgagatgctacttttggtttctcttttggctttggaactgaaaataatatattttcttgtgggttgttccaagttgtttatagcaccatgggatatgagacttctattattgtccccccgcttttggtttcatctcagaaatgatgctcttttcaccattcttttgctggactcactattttcatgtgaaatcgacaaacttttggttcgcttaaagaaaagaaaggaaaattgccataattcactgttcctcttcaataggcaaagacatgccatcattccctgttatttgctcctcaattgtgcattctaagtgaaacatttccttttttgtttcccttttgtggacatgtctaccacgttgaaatcattgtgttcatattgtcaaagaagcacttaaacttgcaataggaatttccagaatttttgtgcttatgggaaatatattattttatctgaataaaattagcattgactcctgaaaaatcaataaagagcttgctgtttgtttgggccaaatggtttagttaggaactgctaactttgtattacatctgatacaggatagccaaatatcaagaagcaaaccctggtgtattcactattgtcacttttcctttcttatttgctgtcatgtttggagattggggacatggaatttgcatattggtttcgacactctatctgataatccgagagaagaaatttgcttcacaggtttgcatactggtcatcattttactattgtgttgacaatcattttgaggactttgttctttggaatatgtagtagtgatcccaaagagtttagagcaagtatttatattctgaaagccccaaaaatttacatatgtgataaagctgtatctgatgtctgtttcttattgcagaaacttggagacataatggagatgatgtttggtgggcgctatgtaattataatgatggcactcttttcaatctatacaggattaatatacaatgaatttttctctgttccatttgagctttttggtaaatctgcttatgcatgccgtgatccttcttgtgggtaagaaaaagtttcaaacaaaaccacgtttttatccctttaaaaaagaatatttatgcctacttattgtttgtcttgtggatttagagatgctgcaacagaaggattactcaaggtaagacggacatacccttttggtgtggaccctgtatggcatggcagccgcagcgagttgccgtttctcaactcactgaagatgaagatgtcaattcttcttggagttgcacaaatgaaccttggaattgtgattagttactttaatgcgaaattcttcaggaacagtgttaatgtgtggtaagtttattgtctcgtgttgaatgcccttttatgtaacactctactttgagatgagattatgaccagattattctctattgctgctgtatgcttttgtaacaggtaccagttcatcccccagctgatcttcttgaacagcttatttggttacttatccatgctcatcattatcaagtggagcacgggggcaaaagcagatctgtaccatactatgatatatatgttcctcagtccaacagatgaacttggggagaaccaattatttcctggacagaaaacagtgcaggtccgtattcgttattgttatgcagaattgcagactatgacatgaacttgtggataaatactaaaattttctccatttcttatgcagcttgttttacttctgcttgctctggtgtctgttccctggatgctgatcccaaagccatttttcttgaagatggagcatgagcgagtaagttgtatatgatatttcaaattctattgctgtttacgtgttgaattactaatgtgctgacaatacttctgtttgattctatcagaggcatcaaggacaacaatatgcaatgcttcagagcacagatgactcagtggtagcggagatgggacatcataatggctcgaaccaccatgaggagttcgagttcagtgaagtttttgttcaccagttgatccacacaattgagtttgttcttggggcagtctcaaatacagcctcatatcttcgtctctgggctctcaggtacttctagacattcagcatcaccgcattactttgaacagccttactccctcatcatcccacttttgatctataacaatgcactccttgttagccactaataatcgattaaattgtattctttatacagtcttgcacactcggagttgtcaagtgtattctatgacaaggttctcctcctagctttcgggtaagaactaagaagcctccctctccgcctcctctccttttctccctatctatgtagccgctatctggagctcatttttatgtgccttcttgtaggtacaacaacattcttatccgcatcgctggcattaccatcttcatctgtgcgacagttggtgtcttgcttgttatggagaccctaagtgcattccttcacgccttaaggctacattgggtggagttccagaacaaattctatgagggcgatggatacaagtttgcgcccttctctttcgcactgatcagtgaagaggaagactgagtttgcgcaattattgcatctattgtagcgtgtaatttcttggggcgtccttttttctcaaagcgtcaagtatttatcacggaagaatcataaacctccagtttgttccttcatcaggaaagggactagcagcatcattttttgctttgctacgaatgattcgtggcaagatgattttttgggtggccgttggcacatcgggtggcatcacccttattttggtgtaaggctaataaataataagtaaattctgcactcgggttgccatttgggcaattagttttctgcacataaataaacattgtatcaaatgttaatattccattgggttcttttattgtcaataaagagtgcggcctacattctttaaaaggtttgtagaattgtaggaacttggaatttgtctggaggtttgtagaattttctacctgttatttgtgaacggtaaaggcaatgagcaattttgttaagctggcccgtttatatattattgattcagtagtctgaaatcaatgaaacatgtatgagtatttcccctagtttcatgcctaatctcatgctcaaatcagccctgtttttcataatcaatatataatacgaacggaaagaaaatatctacatgataaaactcttgcggtaacattgtcatccatgcaagaccaaagaaaagaaaacactacactgataaaccttgttgtaagttgtaacatccatgcaacgcaagccaaagattatcgttgattatgggaaaccaatgcctatcactagtgatgtactaagctcccaatttcgggaaatttattcgtcaatggtgggcacgctgctggcgctgcgcctggcgctgctgaacgggccagtgacggtccggccgacgaacttgccagccttgctgaggccggtgccgaacgctccgatgccgctgcccacggcgccgatgcccgtgccgaccagccccacgccggagccggcggcggtggcgcccgctccgggcgcggcggctcccgcagcgacgcccgccccagccgcgggggtcaccgtggacgtcacgccgctcgccgcgtccgcggcgccgctgacggccgccgtctcctccttggtcttccgccgctcctccaccgtcttcttctccagctccagcgcctcgagcgcctccgccttggtgaacgggtggtacagcacctgcgtattatcacgacggtcagcgtcgaacaccttcgcgtctcttgtcccaagaacccaagacgcgccgccgtgtggacatgagctcaccttgatggtgagcacgcccctgtccttcttgtccttgaccttggtcgtgtccagcgacgacagcagctgcaggttgatctcctgcacggactccatctccaggtcgttcaggggcagcttggctatgcccagcctcttgtcttgcttcagcttgtcctcgtcgaacacctgcagagcagaacaatttcagaccccccaaaaagaaactaaattctccatgtgttcgatcaaagcttgagctggggaaatgcacctgaaggatcagatgctgcgtctccttgtcctcggcgatgagcgagaacgtctcgttccactcggggttgaggttgtcgtcgatgacgctggtcttctccttgaacattgggcggatgtacagcaccacgtacgggtcggacttgccgatcagctccttgttcttgagcgactccgcgcgcaccacggtcaccgtcagcttcccatgcggcttcagctcaaggtcactgcagaagagctcgaacggcagacagatcaacaaactaggttcaaacaaaggcttttattttcttttttggaagaaaatttcctgtgacaaattcagttgagctctaaaaacactgcaaaattgggcagatcatgcgaaccttacgtcgacgtcgactccgcccagtgggacgacgattctgtgtggccattggagcatgtcagcgatcaaagatgccacggtgtcctacacaaggcaaatgaaaaaaacatcacatttctccagacataaacagttaaatttctactatttgacaatgcaggtaaatgcatcagatgacatacgtcgatcatatctgaaagaccaggcattgctgtcaggcttcctccgacagccttcagtatgtagtcgatccttggttttggctgccaaagacagaaaattcatttgtcaaatcaaacagatcacgaaaccacttcttaccatgcaagtgtgcatggcaggatcagctggttagaatgattataagaagctcacctctgccagaagagcaacaacaacagcagagatgcaaggtatttcatcacacaattggaagacgacacggatgatggtgtaaacctgaaggttcttgaactgtatgcatacagaacaaacatgccaaatgttactaacatgtttaactgaagtaatagtacagtaccactagaaaaacaagaacatgaattactaatgtgaccagtaggttttacaaatcatggctagcggttgcgatttgaatacctgaatgggaagtgaagcaactagagtgtcaactgcaaggacaatattaggatccccgccccaacgaaagtcgacgtccattgtaatttgccctttcttgaagctctgaatccgaatgcctgaacaaaacagaagcaaacagatcaagatgtcatccttggaggagaataaaatgcggtaagactgacgccaaactttttctctgaaaccttcaattttcggaggaacagtccccagggagagtttgctgaacttcagtgaggatatccctgccggcctgtaatcatcaagtataggctccaccgaatccctgatgaccatagttgctgcctgtaaccaaatgtaactgcaaatcagaggcggtgttaacagcaagatgatcagaagttacttctgtggcttgaaatggaacttcatttgaagcctatgtgattctctcctaaagttctctataagaaacaaattgaagttatttgtatgtacctcttcaacaaaaggccaaagcttgctcaattgtttgttgagccatttaacctgaataacaaagcaaaatatactcaaaacatggatgaacttaagcatgccattgaatactatgatgaacaatcgtatgcctaggatgttggtctcagttttctgaatattaaagatgctatgatgataaataggcacaccaaaagagtatcattgcacctgttcatactctgggaatgacacccattctgggagattttctccacatattttcttcacgtcttcgcggtcgagagatgcaagtgcattgacatctgcagcctgatacagaattttttttaaaaaaaaaaaagttagccacaaaccaatctgtttgcaccaaataacgtctcacttatcatcaccattttatatcaacagtatacaaattcaactaaacatagaattcccaatatgaatatactccactgcatcagtcatcatccccagaaaactaagtcagagttaaatttacaatgaggtaagtccctcttgcaaaacatgtacataacacaaacgatcataaaaatcatttctaaaaggaaacaatgaataacgttcttaagcctgaatctttcagacgattcaacacattcaaagcagatatatccaaaaaattttcttcagcctttcacgaaacccttaacactgccattcatgcatgagtcgtaacagatgtcaagaacaacagatgcaaactcgtcaaaaacaaaaactttctatgactgatgactcgaaatcaaggcgtgcatcacatgcgatgaatttatgagatctgtcatgtggttgtggatttgccttggcactgcgtttggcggcgcggcgagccatcgcgcgcgaccagccggcgatgagggcgacgccgatgatcattcccatcaccacccccgatatgaaccccatttctcctctcctccttcccccctcccaacgaaaaaaaatagagaatttgaaaaggagaagattagaagatcaaacaacacttgtcgtgcaacaattttttggatcaaattgacgccaaatctctctccaaattgttgatctgctgctaacgctccattgatttggggccgagtttttcgcgtgctaatagtgaagtactgcaacgagagggagagagagatgcagaggggcaaaggtgtaattacactacgtgctattggtgtggagatggctgtgaccgtgagcacaacggtgaatttcgcatgggtgcatcagggcaatgcacgctattcacgcatcaaacctagtgattagcgcgtctcaactcaagctggagagcgtaccatgaggtacgagttaccataaggtaccaatctaatctaactgttgtttagcaggggtatgattgggctaacaaaatagcgacatcctctgagccgccctcttctcccctcttccatctgccgcatcacgtcgtttgtgctggccatctgcgccgcgccgccgtcgcacatttaggctgccgcgccgccgccgtcgcatcgaggccacccccgggaatgtccgcagggttcgtgaccttcatgcctgtgccctcgccgccagctctcgcccgctctgttctcgttccaattcaccgccctcgagatcgctctaaatcatcaagcttgtccgccggcccgtcgagctcgctccgattcttcaacctctgtccgtcggtgcactcgagctggctggtgcttggagctccttctttgcagctccgtgatgttctgtttccacaataacttcaccaatgaatttaacctgggcaaatctgcctaagtgttcatccttgttgaaaaatctggatgagagaaacccaacatctgaagttcttgatattgatatagatatagtatgtatgcatgtttcctgttcaataagccaatttatctatcaactagaaatttcaattattcagaacgttgttttcacccatggctccatcaccagtcttaaaaaaaaaactatggctccatcgtcttgccctggacgcgtagctgctgcctgctggtggccttggcttcataccatgatgcaggggcagcgtccacctcctcttccatgcacaactgcaacagttgctgcggcggcgaagctcagctcggtgcctcggtctgcatcggcctcttagcacaatgaggaacaacggccaccatccgagaggtctccgccaccgtcgtccactcccatggccgccgcctccgctgtactagcgctgaggacgagggaggagatagggtagtactctgcccgcatccccatataggaccacctcccccgtggtcaccgccgccgggaggccgactgccgcatcgggttgctcgatttgtggcgacgatagcaagcagtgcgatgttcccctccaattcatatgcgaaagtactactctgcccttccaccgttgaaaattactcggtacctgctttcctagagacgcggtaccgcgaggtaccaagcctttgcaaccgttggatggtgcgtaatggacgacttggatttggtacctcctttcttcaaggactgtaaaaactctccaagctggaagctgaaggatttgtgacggtgtccagtattaccgactacttgggccaatggtctcatgggtcacggcccatgttcattagaggctgagctgaatatagcaggcattattgcagcttaattttctttttcaacgtgtcgatggagtttaaagtgtaaaatgcaccagcggtacttaaacttgtcgggaagtttcacttaggtccacgaacttgcaaagcacatatcaagatctctaaacttggtttattgtatcatcccggtctaaaaatgcgtttgaccgtggtcttgtctacgtggcacgccacgtgaacgatgacatggaatttttttttatttttttctcccctcttccttcttttttcaccattgtgacagcccctcccctcgtgccgcctctcaccgccgaggaaaaagaaggaagaaagagaaaaaagaaggaagaaggagaaaaaaataaaaaaaatccatgtcattgtccacgtggcgtgccacgtaggcaagacgacagtcaaacgcggttttggaccgggatgatacaagaaaccaagtttagagaccttgatgtgcactttgcaagttcgtggtcctaagtgaaacctcctgacaagtttaaggatcgttggtgtattttactcgagtttaaacttagggagaattgcaaaaccatcctagaaatcacttaaagtttaacttttcatttataaattattttgttgtaaatgtccatctcctactcgtttttgttgtaaaatccaccacagtgtgagcacgtgattaaccaaatcaatatgttttccaacaaaaccaaaaccaagtaaaggatagacatttataataagatgacttatagagtggaatgtcaaacatcaagtgtcttttagggtgtccttttacaatttttcagctttgtggtgtgaaatatttcaccatgttatttaatacaaatgtgtgcaatcctttttgcacatttttctctaaaataatttaagcactgctatcacaatttcttttggagttttaaagaactgtttaattagcatttgaatatattttagtttttggctaataaagtgcgactgccaaaaatgtgataaccaaccgaacattaccctatcgagttagctcgcctaattaagttgtggaaagcgtggaagaggtgacagggatcattgtggtatttttttagtatttgacactgattggcaggtttcaaattcatagtccgcactggatttgaaatttgtatgctaaattatagtggtttaaaattatatattttatctaaaatgaaaacaaaataatccatccacgtgttatcagcgcatagattcaaatccattgatttgtcaagctaaaaaaataccaaagctctaaaaatttttagatccgaagctgtgccaaatatgaaattcatatacttcaattatagctagtgaacaaactaaaagctccatagtaccagctacgaacaaggtttgtatttcaaagaacaaaaataaccgaaatgagtatagctcaactggttgaatttcttgacataactgttgacagcgagacgcttatcgatccagtctttcggatgtgtttatagggtgagtgtattccattaaaaaaagatgtgttcatagggtgagcgtattccattaaaaaaacaagatactactaaaagctaaatagtttgtcttcatctgaacaaagtatccaatcaaaagtaatagcatagtggtctattatttaagcccaaaaggtcatgattcctaggaaaattaacctttggtatccttcatcctttgtcctgttccaaaagatatgttcaagaaataacaaatataatatgatttaaatagaaatataactgtaaaaatagataatttccaaacatataaaaaatacatttgaatagaccataagtaaattacagaaatcgaatgagagagatacactcaagccctctttgaagaaaaaaaattgtggatgaattttgtaggatttaaagtctataggattttttttcctatttggttatttgaaacaaaggatttgagctttcataatcctttgaaatccaaagaaatggttcaatacatgtcaacatctttggaagaaaagtagagctttaactttatattatgttttgaaaagactgaactagagaaaaatggaacacacgaatgtaagaggtgagagacatatgtctttattcctcatctcttctatagcctagatcgttgtattcgaatcagtgggtgtagtcatctctgttgccaagaagcttggagtcaccatcttcgtgggagagacagagatatgaggttggttactagtacacaaggggtatctctacacaagtacaaggtgggacgcatatgatttattttctttttctacaaaattacctcacttggatgccaacacttggactgagatttaaaggatcggattgcatgaatgcacgagcgcatgagattagctgtgtacctcataagttgcttcacatatactaggctaagtacccgtgagcggtgaatacggagtatgtggatgtacatgcatggtgaaacctttgaaaaaagaaattactcctattgttccaaaaagaatcaaaccataagaatgaatttaaaccataaggacaaagaaagtacatatgaagcgtcatagaggacaaaatccagatgaattaaaatcctctatgaatttaaaccataaggatgaattcaaacttacaaagaaagtacatatgaagcgtcacagaggattcaatctttgtttttctaaaatccagatgacaacttaacctttggtttctacttccctccaaccaagtccaaatttgaagaggcctttcaataattacctgctgttaaaatgatccatccaattgtcctgttcattttgtctagacattctccaattgtcctgttcatcttgtctagacatcctctacggagagaaaagtgttttgagttaatccatgctatttgcactttagtactagcactactactagtacattgtttgaagattgtaaagttgagagttgagaggcacattttgggtggtaatgtctctgcaaattaaatcgtgattttag
